United States Patent 7,868,149 (PLANT GENOME SEQUENCE AND USES THEREOF) - sequence listing, part 124

SEQ ID NO: 69110 - DNA, 9454 bp, Oryza sativa
  unsure (1)..(9454): unsure at all n locations
tatatcctaccatgttctagcataataagccctaaccaaagcactgcgtcaagttttacctcgccgcaccaagccgagcaccgccacccccgcactgctctgttcttcgccgccgcgaagtttttccggccgcaattcgtcgtttcaaccgatctcggtaagtttttccgttttaaccatctacataccacctagagtccatttttgcaattggtttgcactatcttgccaccctctgagctgccgacgtgagcacggccgccgcctagggaggcgctcgtcggcaactatgctccgcgccttgctaaaggttggcaagctgtcgaaatccctctagacacctcgtagatgctctagaacccctcccctagccatgtctaactcttatcaccttgatcgccatctcggcctaaccgtgccaccgcggccctagccgctaagccgtccacacctcaaattaactcctccgccgccactcgccatcgccggagatccctagctccctcccctcctcggtcgcaaccactttctccctctaacgccgccgcaatcccaaaccctangcgggccccccgggcccgccgtttgggggaacggccggaggttgaagaagagaagagagagagagagagactgacaggtgggaccgcacacagtgccatttcacttttattcgattttcaaactttagaagcccatatcttttaaaatataaatccaatttcagtgaaacttggaccaatattctcctaaaatcattctctatcttttgggcccctttttgctatttttgcattttattttattttctctatttttcttatttttttagattttatttaaactcctttttgaatttgaattttatatgtctaaccctaggtcttaaggattcctttgacactctagataatatcaatcaatctcaggacatcgagcaaggcaagttaccatatacctattgatcatttaagcctatattttacaaattatttatttatagccttctattcaatattctattttctatgcataaattaatcatagaaacccagataatttagtattgcttattttgcttacaatctggttaaaataccctatacttagattgggacaatacgtaagatttggatgatttccgggtggctagtattgtctcaatcgatataagttttaccaggtacttatgtcaaacgaacgggtacgaccgcagtttctagaatggggacagacctagttattaggttaattggcaatatggcacctatgtatagtggttcttatttttaagtcctcgcgcaggaggcaactatagccgcgaaaggcaactttaaccattaccatgtacaggtaaatggtttgtgatactcgagtataaactatatggtatatttctaaaccctgatcaagatgacgtggtgtcatacgatcagttccctttaaatacttcgggaatgccagaactcctcttgttgctgttaacattacgttcagagcatatgaggatataagttcatggaacaggtgcaataattgttaatgacttaatgctgggccatgactaaagccgataattatcagcaagtcgtggactgcgggtaaagcgtacatctgctgcagtagaatatctacaaaactattcgaatagccgtactcatggagttgagtaccgggactcatatggtaccctagttagaaatctaaagtttttatgttttataaattctactataatgttttccagattgtccaatactgctttttgcaaagaaccctattatatgtcaatgcataacataattccgtgataacttgctgagtattgtgaatactcatccttgctctaataacccctttttcagatctgggtcaagaggaggacccttatgattattactacgaagaccccgataacttagaaaatccctaaaggttatacctcactagtcagaatgtatagaaacttccgctgtgtactaattaaataggtgagtacctattattgtaaaacccttagtattgtaagactttaacgtatgcaatgaagaaccagttatattgtatgtatcaatttttactgatccagggattgatacattaatctcagttggatccaagttattagttttgggctccgacacgccggccggtaatgatcactatagaggaattggatacaaacgcaagagatacattgggctatcgcaccctccccgtaaggcttacaaggatatatataggagaaatctaggagtcataataggaaactaatcctataaactagagtcctattagataactaatccggatatactgtgggtccaaaattcagatcacatatttaacaatccattggaggaacttggatcttcgttcgtggtcgccgatctcggcaagctgagttcgccttggacaaactccctctgtttcaaaataagtttatttttcatctttcttacatatataccaatacaaaataaaaaagactagaatacgtttactttaacaaatcctaatacaactattcatcactttgtctactcagaatacaaatattctctattttcacaaacccagatgcaatgattactctaaaaacgaatttattttgagataaattgattgagctaaaaatgaacttattatggaacggaggtagtaccttggaggagagacacattggagatctcaacaacatagaagggacaatgagggagaaggaagaagcatatcaaatggaaaaggaggagatgaagggctcactaacaggtgggtctataaatttcttttatttttgtgtctgattgtacttaagggcggacatggcctaatagcaaatctcgggtcagcttgtggtaattttctaggaacttagcttaacaagcgaaaatcaatgttggttcatgggttcttagccgtaggccccgagccatggcctagagtgccctgggcctgggtctctcgattgtaccgtcatgctagcaccaacagataaaaaccagcttagtttgaattgaggggttatttgaacaattttaagagttaagatgtgtctagtacccgtttttaaattggggtgaattttgacaaatgtaatagttgagacctgaagggataaattgatgttagttcatgttataaaagttagtcgatatagcggaacgatgactaaccttctagatcgctttaattattgatcatctaagatacgctagatgacaacacaggaacacacgatatttgttaatgaggttcagccgaagcctacatccccgaggctttgattatgggcgctcctccccaaccaatatagcacctagccgctacgagtccatggcctcgccgccatcatctccttgcgtgtctacgctacattgtagatgccatcgttacattgtggtgcccccctctctatttaagagagtttctgagttacagagtccgactctaactccatcccctaacacatattataactccaagtctaactgtaaccaaataagactagtatattcgacacctattctaacagttcaaacacaacatacaatgaggcagagcgcagctgctagtgtccaatagctaacaatcgtcgaagcttcagcagaaaaagatgatacatttgtgagtcatcaagcttgcatgcatgctctttttctgtaagaaaagaaaaaaaaagaagcgtgcatgctctcaagtaaggaacctataaaacagaaagtgtatgctttgttacgagtaagaacattaaactaaacaaagttacttacaatgatgaccttcatgcttccaagcacacgttcgtgttctttttgtgactaacttgtgagaatttgttcgatatcaagtgggaacttcgtctcacttgtatcatgcattgcatgttaggtactagatagaacgagtgattatctaatttgttattttagagtgattgtaggaacacaaagttctcttaaaattgctgtgaaattccagtgttccaaggaaaagccaaaacttgaagattatatatggctctttgaaataaaggaaataggttgagagattctatttagaggtcttagaacacacaaatgtgtcatatatatgctccaaaatggtttaattaattcaaagaaatttttggagaaaattaatcttcttcgtttacatggattttggattttcatttgctcacttcctaagctcctaaacaatgtatttcgtgtacaaaaattatatgaaattttcttgaaatacttttctaaagtaacttttccaactttgtagtagttaagtcacttatttatgagtaccctcaaatagttattaaaaaaataaattatccatcaatttcagctatctcaaacatgtccccctccctccctccctccctctctctctctccctctctccctagtcttatatttttcctatgctgcatccaaacatcgcccttatggagttttaatgtacaatgatgcactactatacagcactgttcttcggaggaatacaaggaatctacctagctggtatacgtacaatgcaatgttgcatttctgccgagtcaaagatgttggtagagaaataaaaactttaatgaacaagatgtatacatgaatctgtatgaagttagccgacagagctgtcaaaatgccaaatttgcatcatagctagcagctaccaacatgatcagaattaatggatcacattggattcggcttggaaacaatggctaaacctgaacctgatgaacaaacataaatgatatactgtcacaccctaaaaatcccaaatatataaatttttgtttaattggaattattagaatttattttaaaagcctagaagagaaaatctaattttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaacctctctctctctcccccggcccagccggcccagtccgcagccgcgcgcgcgccctcgccgtcgctgacaggtgggtcccacctgtcggatccgtcgtcctcctcgcgtcggccgccgcccgaaaccctagcgccgccgccgtcgtcgctttccaaattcggtcgatcctttccttctccggccgaatgatagaggggaaatgatcctcgggatctcctctaccttttctcttttggaatcatcgtctatctcgctttggaagttcgtggattcgagatcgaatcggattcctctctctctcccgaacccgaagtttccttctcgtcgccggtcgccgtgggccttcgccgccgcctccttgcacctataaaaggatccccaagtccgccgctacccgccgccaccctcgcctttgctcgctgtcgtctgtagcgccctagcctcgtgcagcctagcgtcgccgtcgtcgccgccgcttcagccgtgcgccgccgtcgtttcggtcgtcgtcatcactcgggaaggccaccgtcgggatcgccaagtcgtcgccgtcctcgtccgccccttcgccgtcgttgaagaccgtcggagcaccgtcgtcaccgtcgacccgaagaccgccgccgcttcttcctcgtcgccgccgccgtccgttgctcttccgccgtggttttggtcaccggtgagttcgccgcgtcgccctctacccgttggtgccttccgttcgcgtcgtcgagccgtcgttcgccggtgagcttgcgttgccgagccgccgccagtgctgacgtcatcgctgacgtctcgttgccgttccccgtgagccggtcgtggaccgtttgatctcggctgtccgttttggataggatcgatctcggccgtccattcccgtgaaccgctgccgtgcacccggtccaccgcaaaccctagtcgctgacgcaataatcctccttttccttttcaaaaataattcattattgcgtcataattcaattaaaatccatataaaggttttaatccgatttaatctttgaaaattcataactaattcattgtaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacctgtttgtttactttttatgtattgtttatttggtttttattagtctttttcttcgttttgcgtgttagcttgtcgtttccgtcgttgtgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaatctattcctttgttatggcctgtttgtattgattactttattccttgatatcttgggttattataacttaactagttgagctatatatattggttcagctagatattagatatgattgcttagccatgcttagaaacattagcacactattgggataacttattattcactattatttaatgatggattaatgatagttcacgatggtcaatcgtgattggttaaataattacttgccaactaaaatatggtaaaggtgggttgtgagcacatggttttgaaagtcgtgctcatgacgattaaggaccggttcgcgagctactattgtgaaacattaaccgtgccaaccacaagccagtgtgggcaacggctttaccttttgtatagcatggttcattgtggggcaccagactgagaagtggctggggagtccatgcctctggtttttgagggggtgattatgattcaggaatggtgcgctgcggtggattgtgttatgcgaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacttctcacaataattatagatgttatacctggtaataatttgcttagctcctggtttggagattagatctgtacagccgggtatggttgttcaggatggttgggcctgtgcagcatgggtgtgctgttcagtgttgattaaaatttctgattaattactctattgttttactactcttaactctttgctaaatgttgctttcgcaaatgagactatattatgccatcctttggtatccttgtgcatttgcatatttgctgtgtggcttgctgagtatgtcatatgctcaccttgcaataatcaatcaacctcagttaaagaaaaaggatccagaaggagaaggcgtttggcttataccccagttgagctgcttgtgggagtggagctggagcttcgctagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttttgggcgtgtcatataccactccaaaaattagttatgttgaatttgccgatgataactggtattggatgtgaggtcttacctgacccggacgttgtatgaatttgacagggtttaattggatatctgcccctgaaaatggctcttgcatgtaccactaaatatgcagttgtctcttttaagtgcatgttctaaacttctaaggatgattatggaatgatgtcttgttagtttagaaagtgatgtgttttgttcatggtatatttcagggatgagatcatggtatatgagtttgtttttccagcccttcagaaaaatgataatttacatttgtcaggggaaattgtaggccaaaacggcatgtctaaaatggccacaaagtcataacaacctcaatttaaaaacaaagaccttaaacacaaatatagtactagctccaacataatcctgcaataattgttgcaaggttcctataaaaaataatataccttagattgatcacaatcaagctaagaccctgtttagatgggactaaaactttttaagtccctatcacatcggatgtttggaaactaattataaatattaaacgtagactattaataaaacacatccataatcttggactaattcgcgagacgaatctattgagcctaattaatccatgattagcctatatgatgctacagtaaacattctctaattatagattaattaggtttaaaaagtttgtctcgcgaattagctttcatttatgtaattagttttgtaagtagtttatatttaatactctaaattagtgtctaaatatagagactaaagttaagtccctgaatccaaacaccaccttaaatcaaggttactattgacaaatgctacctagcctttttgaaacttggcagccaaatatttagccaagcaacaaaaaggaaaaaaaaagtgtcacctcagaaaagcaacttttgataaataacacttgaactacaaatctacacttgtctgtcccatcctaaaaagttaacaacacccaatttcacactcaaagacaccagacaccagtacaaattcacaacagcaacacaccatccatccccagccaaaaaccaaaaagaaaaaacaagaacacaaactttatgcaagaaaagaggaaaaaacgtccataaataaagagagtaaaaattcaagcataaaatccaacaaaacatcacatgtttctttttcctagcaaaaataaaaataaaaataaaataaaataatcacatgtgttttttttatagcagtagcagccagcaggagaggagaggagacgactccattgccaaaaagctctcacctttgcctcctcactctcctcacactctattgtctccactcgccgcgccacgccacgccgcgccgcgcaatgcgcctccactaccaccacctcgccgtcgtcctcctcgccgccgtggcggcggcggcgacggcggcggccggtggcgaagccgacgcgctcctcgcggtgaaggcggcgctcgacgacccgacgggcgcgctcgcgtcgtggacgacgaacaccacctcgagcccgtgcgcgtggtctggcgtggcgtgcaacgcgcggggtgcgggggtggggc

SEQ ID NO: 69111 - DNA, 3110 bp, Oryza sativa
  unsure (1)..(3110): unsure at all n locations
cgggaagataccaccggagctaggcaacctgacgagcctcagggagctctacatcggctacttcaacagctactccggtgggataccacccgagctcggcaacatgaccgacctcgtccgcctcgacgccgccaactgcggcctctccggcgagatcccaccggagttgggcaacctcgcgaacctggacacgctgttcctgcaggtgaacggcctcgccggcggcatcccgcgcgagctcggcaagctcgcgagcctcagctcgctcgacctgtccaacaacgcgctcgccggcgagatcccggcgacgttcgccgacctcaagaacctcaccctgctcaacctgttccggaacaagctgcgaggcgacatcccggagttcgtcggcgacctgcccagcctcgaggtgctgcagctatgggagaacaacttcaccggcgggatccctcgccggctgggccgcaacgggaggttccagctgctcgacctctcgtcgaaccgcctcaccggcacgctgccgccggacctctgcgccggcggcaagctggagacgctcatcgcgctcggcaactcgctcttcggcgccatccccgcctccctcggcaagtgcacgtcgctcacccgcgtccgcctcggcgacaactacctcaatggctccatccccgagggtctcttcgagctcccgaacctgactcaggtggagctccaggataatctcatctccggcggcttcccggcggtgtccggcaccggcgcgccgaatcttggccagattagcctctccaacaaccagctcaccggagcattgccggcgttcatcgggagcttctccggtgttcagaaattgctccttgatcagaacgcgttcaccggcgaaatcccgccggagattggccggctgcagcagctgtccaaggctgacctcagtggcaattcgttcgacggcggcgtgccgccggagattgggaaatgccggctgctcacctaccttgacctcagtaggaacaacctctccggtgagataccgccggccatctctgggatgcggatactgaactatctgaacctgtcaaggaaccagctcgacggcgagattccggccaccattgccgcaatgcaaagcctcaccgccgtggatttctcgtacaacaacctgtccgggctcgtgccggccacagggcaattcagctacttcaatgccacatccttcgtcggcaacccgggattgtgcgggccgtacctcgggccatgccatcccggtgctcccggcactgaccatggcggccgcagccatggtggactctccaatagcttcaagctgctgattgtgctaggattgcttgccctttcaattgcatttgctgccatggcgatcttgaaggcccgatcactgaagaaggcgagtgaggcgcgtgcttggaagctcaccgcattccagcgcctcgaattcacctgcgacgatgtgcttgatagtctcaaggaggagaacatcattggcaaaggtggagctgggactgtgtacaaggggacaatgccggatggtgaacatgtcgcggtgaagcggcttcccgccatgagccgtggttcctcccatgatcacgggttctccgcagagattcagacgctcgggaggatccggcaccgctacattgtgaggttgctcggcttctgctcgaacaatgagacgaacctactcgtttacgagtatatgcccaatggcagccttggggagctactccatggcaagaagggtggccacctgcattgggacacaaggtacaaggttgctgttgaggctgccaaggggctctgctacctgcaccatgattgctcaccgccgatattgcaccgcgatgtcaagtcgaacaacattctccttgactccgatttcgaagcgcatgttgctgacttcgggcttgccaagttcttgcaggactctggcacatcagagtgcatgtctgcaattgctggctcttatggttatattgctccaggtaaaagattgatctttggttcatttgtgctgccttcgtatatggtttaaattcgcttgattttgatataccactattgtgtttctgttgtagtcttgttttaacttgttaagaattgtcttgctattctagaagagaattgatgtcttcaagttggctaatcatgcactgtgttgtgattgtggatttacagagtatgcatatacgctcaaggtcgatgagaagagcgatgtctacagcttcggtgttgtgctccttgagctgatcaccggaaagaagccggtaggggagtttggggatggcgtcgacatcgttcagtgggtcaagacgatgacggactcgaacaaggaacatgtgatcaagatcttggaccctaggctctcaactgtgccggtccacgaggtcatgcacgtcttctacgtcgcattgctttgcgtcgaggagcagagcgtgcagcgaccgacaatgagggaggtggtgcagatcctcagtgagcttcccaagccgacatcgaagcaaggagaggagcctcctagtggtgaaggtgctgtgtttgatcttgtagtgccagctgaatctgcagaggccaatgaagccaaagagcagcagcagcagcagctaaactcaccatcttcaccgccacctgatctcatcagcatatgaagaaatgctgaactaaattgttacagttcagtttgatttggtgaagtttgggtttctaatctggaatgcttagggtgtgtggtatgtaggccttcgcatttagggtgtggaaattgtaggccactgaatttcttgtgtggcatgtatctttggtatcttaggtatttgtgttgtaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69112 - DNA, 2264 bp, Oryza sativa
  unsure (1)..(2264): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccaatggtaattggtggagattttaatattattagaaatccaatggaaaagaacaacgagcgatacaatgatagatggcccttcttatttaatgctgtcatagacagtcttaatttgagggagatcttgctctcaggacgcaaatttacttgggccaactctatgccgaacccaacttatgaaaagttggatagagttttggtgagtaccgagtgggaaacaaaaaatccgttagtgacagttcatgctctttgtagagacctttcggatcacacacccttggtgctagacacaggaaaagggacacatagaaattctcaacctttgtttaaatttgaattgggatggttattaagggatgactttcaaaatcttttggtagaaatttggtcaaaggatattcaaaaggatattcaaggggcaacaaatatagaaagatggcaaaataagatacgcaggcttcgtcaattcctgagagtatgggcgaagaatttaagtggtgtgtataaaaaagagaaagctcgacttatagcaaaggcagatgagttggacaaattagctgagaccaggatcttgactagtcaagaactgattctaaaaaattcctataaaaatgccttagcccagttgttaagagaagaagaagttaaatggtatcaaagagcaaaaacaaaaagaatagtagaaggagataggaacaccaagtactaccatatgatcgcgaatggaaaacacagaaagacaaagatttttcattagaacaagaagaaggggtgattaagggagatgcacaactcaagaaatatgtcaccaattattataggggtctttttggagctccggatagaaattgtttctccatgtgtgaatcccaaaaggatgatatccctcaagtgtcaatggaggaaaatactttcttaacaaaagaatttacagaagaagaagtgaaacatgttgtttttcaaatggaacataacaaagctccggggcctgatggtttcccagcggagttctatcaagtgttctgggaagtaattaaagaagacttaatgtccgtctttagagattttcatagtggcgagttacccctacatagactgaattttggtatcattaccttgcttccgaagaataaagaggcaaaatagatccaacaatacaggcccatttgcttacttaatgtaagcttcaagtattcacaaaggtcatggcaaacagaattgctctagtagcacagaaagtcataagaccttcgcaaactgcttttttaaaaggtagaaatattatggaaggggccataattctgcatgagacattgcatgagatgcataagaaaaagtcaaatggagttattctgaaactcgatttcaagaaagcttatgataaggtaaattggaattttcttcaacaagcgttgagaatgaaaggtttctcggacatttggtgcaagtggattgatcaagttgtgtcggggggtagtgtagctgtgaaggttaacgatgagataggccacattttccagacgaaaaagggtttgagacagggggatcccctctcaccaattttatttaatttggtagcggatatgcttgccattctcatcaatagggctcgagaccttgagactctaaatggagtaattcctcacttggtagacaatggtctctcaatcttgcaatatgcagatgataccatcttgtttatggaccatgatttggttaaagccaagaacctaaaattggtactagctgcctttgaaaagttattgggcttgaaaattaattttcataaaagtgagatgttttgttttgggaaagctaaggaggtggaaaaggattacaccactttgtttggttgtaagatgggtacttttccattcagatacctaggccttctatgcatttcaaaagattgtcaaacaaagattagaaggatctagaagataaattccagaagaaacccagttgttggaaaggcaagtttttgtcgtcaggaggaaggctggtgct

SEQ ID NO: 69113 - DNA, 2965 bp, Oryza sativa
tgtggggggttggggatccaaaacctagaaatgcagaacaagtgtatgcttagtaaatggattttcaggttgatcaatgaagacggaatttggcaaagtttgcttaggaaaaaatatttgacaaagaaaaccattttgcaagtccaaaaaagactaggggactcacatttttgggctagtctcatgttagccaaagagtcttttcaaaggtttggttccttcttattacaagatggctcacaaataagattttgggaggattgttggataggagttcaatcctttgagaaggagtatcctaacctctacaatctagttagaaataaaaatgaggtggtggccaaggtaatgagtggaataccattaaatgtgtctttcagaagatcaatagtgggaagaaacttggaagcctggtatgagctagtgtcgaaagttgtttacactgtattgacagatcagaaagatcgcttcttttggaaaaacaataaagaagacattttcacagtaaaatctatgtacaagttgctcatgtatgaagggctggtacctaggaagaatttcatttggaagctcaaaattccacttaaaatcaaaattttcttgtggtacctcaaggaaggggtaattctcactaaggataatctagcaaagagaaggtggaagggtagcctaagttgctgtttttgtaactctaaggaaacaatacaacatcttttctttgattgctcaatggctaggtatatttggagtgcgctcctttttacatttgggattaggcaaccgtgtagcatgtctcaaatgtttgggaattggctgaattgtgttgaatttaggctcaagagaatattgtttgtgggcatagctgcatttctttgggcaatttggttatataggaatgttgtggtctttaatggctccaatcctacatctttcttgcaggtcattttcatgggaacacattgggcaaggacttggtctttgcttcttaagggaaccgatgaagaaatagttaagaactattgcaaagtgctggagaaagcgtgtggtggaattcttctccgtgtatggctggaacctgagaagaagattggaagcctagtcttttcttcatttgttgttcttaaaacctttgtgctgtcatctcttatgtaatgggagaggtcagttgatgcattttgtacccttttattatggagagtcttatgtactcgtgttcggatttttggctgtgtacaccccacaaaggtgtagaggccgtgtttgataatcctttatctaaaaaaaatgtgtagcacctcaaatagtgcatgattttggtcataaatttgaactgtgtagaagaacacaatacacttccatcatgtaactatatcattatttcgttagcaaataaatttatcttccaatgaaacaagtacctaacattaggatgcgcggcaaattaaaggatatggatattggatttgtttgttcctcttgcttctcctctttagaaagaacactcatatagcgcaacaacgttggtcccagcactcccgtatttttaaaatcaacatttttcttttcttttttacaaacacaatacaaacgttcatcttactcctctttagaaagaactcatatggcacaactaccttggtgtatggtgacaacatcgattgatccgattgctcacattctttaaaatcaacatgtttctttttctttttacaaacacaatacaaacgctcatcttgcttctcactaccgacgatcactgaaagaatatatatatccgtaaatgtgaacacccacatcaagtgtagaacttaaacttgaatgggtgggttctaccataataaatctaatcacttgagctacactcatttcgcaatcaatatgtttcttagaatcataactaaagaaactcgaagcaacatgattaaaaataatactgctatgtagcacttgatgtgatctgctcttttctcatgcataacaacaaaaggattcagatttgagcatgttcacactagtacagagaccgccattggtgccggttggaaatcggctacctattggtcggcaccaataagaaaagccgacacccatgccaaaatagaaccggcacctttaactttgctcgagccaaaaaaaaaaagagcgagctggctcgaattgagccgaactcaccatccacattccacagccgttcctccctcgagcccatccctactccccttcgtcaccgcctcttggatccgagataaactcaacaacaaactagtatattcatcaagaactagctcaccaagaactagcgaatagtacaaatcattaagaactcaagtttgggactagaactcaacaagaaatcaaaaagagaaactcaagaacacatgccacaggggtttcaaaagggagcacatgtcgccggccgccacatcgcccgcgccaccgccgtcctccacgctcgccgtcgtcgccgcatggggagggtgcggccgctgccgccgcctagttgcgccgccgccgcctctgccaggcaggagcccgccacctccccactagctcccctggcgtcggatctagcggaggggagctcgccgcctcccctctcgccggatctggcggaggggagagtgcggccaccgccgccgccaccacctctgccagccagccgccgaccatgggaggggagcccgctgccttcccactacctccccactgcctccccactgccagccagccgccgccgccacctctgccagccagccactggccaagggaggggtgctcgtcgctgccgccacctctgcccgccagcgcccggccatgggaggggagcgacgcgagagagagggagggagagagacgcgagaagggatgtgatcgatgtagataaggaccgtgtggtgtggacgactagataaggacgtttggtgggtgtggaccatgtggtgctgctgagccgctgatggctcgg

SEQ ID NO: 69114 - DNA, 33015 bp, Oryza sativa
gttctagcgaaaaaaccggtacaaaaactaatggggtcgggtttttaaaagaatcggcacctataatatattataggtgccgattcttttaaaaaaccgacaccaatagtatatgtaccggttttttcgctagaaccgacacctatagtgtttaaaggtatcggttttgtatttttccatcatagggaggtgggaaattgtctataggtgccggttttaaataaaccagcacttataagccgatccctatgagggttttttattagtgtcaccgcactcaccgtatgtgccaaaactatcacaaattatagtaaaagatgatacgaattttccaatcatgtctactcatacggagatgttccttttttccattgggacatagcgaacctaaccaaaattatcatagtcctatacatatcacaacacatataatactgtaatttcatcttataatataattaaagtaaaatactgtcagggttatggataccacatacctaatagtagttgactaaatctcggcaggacccaccacataccatgtcttatacggaaacaaccttcggatataggaggagttccgcataagaaaggatgaatagagttctacatgaaaacgacaaggactattcggattgtatccatattggtttccctagttctacttggacaaggagacacttgtaggtataaattcaaggccccctagtaggagaggggacacggaacaatagataagacacaagatcaacatacaagccaacatacgccaagacaagacgccgggtatcgacatcagagataagtatggctagtcccctacggtgtctaaggatactgtcaggagagacatagcgttgtctctgatatcgccggacacggattcgaggagaaagactactctgttgtcgactacgggatgattttatggccaccaagttgacaacagatagataggctaccccaaatattgtactggtgtgattatggtgaataagagcaactaccggcttcggccaacaggagtagggttattacatgacaattcaggggcccgaacctgtataaaaatcctcgtccccatctcttttacctcaatctcgcatatatcctagtaccaacgatccccatactatgcaaatactggaatcgcgacatcaaacgtcgacagtggtgcgtcagataggggatttttggtgcttcaaggttccgacgagatgggttcaagagatggattgtcctacaacctctgagcggacttccaccaccagaattctaaccggatcaaatcggccgaccacgacaaaacgcgctactgatctacaatgacatcaggttcgtcgtcccaaatttctgtgaatagattattcttgtttactgtagatcggtaatactccctccattccaaattgatctacatatagtatttttgaggttattcctaaatgatctacatatttgtgttcatttattaggtctattcgttatttgtgcattggagtaaatggacattgatgcatgcatccatgcacatatgtatttataacccacatgcaataccttgatttgctattggctagaaaatagtggggatggtacatgcattgagtttgttgctagagtaaatatagtatgagagagttattagctttttttggtcttggtgtacctatgaaatatataatagatcaatttggaatggagggagtaatagagtaatatgtacctttctttgcatatactacgagtcctactcggacaatgcgcgcctgcaagttctgactagttggacctttcccacctactcggacatgcgaccagccggcatagctacatgcaactggatagccttgctctggacatgcactatatgatcatcgggatgcccatagcaccaaaagcaactatctgcttgcctccaaaattcttatacgagacaggtagaccaaggtaattagcaagatcgatttttaattaatctactaatttcgtagagatacgtgatattttataggcaatttatcgtacctatacttttcagatcatacaatattgtcagatcaataatttattatgtttacctagagcatgtttttaatacaatatctattgtgcgagtgcttcctatgttaggccaactacagtctaacgctgggggcttgatctattttattctgtataaatcatgcttgtttacggtttacataatccctcatatttaatctgctcgttatatcctgataatactagaagatatatgcagttttttgattacatactcgatatgctctgctatatgccttgccttctagaaaaatatttttcagggacaattgagcactcgagtaggttgtggtcgagtacaccccattatcgagaacattctcgacaaatgcagagttgtcgcacccaacctaccaacgaagaccgacgacctatctcatagcaccggctatggctgggctatttgagaaaagggttgttaacggataattgctcgcgaacgatgtcggcttgatcacctgacatgattgcgaacggacatccggatatgctacaagttgggtatgtgagtcatcctggccacataagatgcacatgtaataaaccaactttagtaacttccattggtgtttgagggataattctactcgctggttctcgaaccagtaaatcgtagcaatctctcgcaccgcaacttccattggtgttcgagggatagttctactcgctggttctcgaaccagtaaatcgtagcaatctctcgcaccgcaacttccattggtgttcgagggatacttctactcgctggttctcgaaccagtaaatcgtagcaatctctcgcaccgcaacttccattggtgttcgagagataattctactcgctggttctcgaaccagtaaatcgtagcaatctctcgcaccgcaacttccattggtgttcgagggataattctactcgctggttctcgaaccagtaaatcgtagcaatctctcacaccgcaacttccattggtgttcgagagataattctactcgctggttctcgaaccagtaaatcgtagcaatttctcgcaccgtaacttccattgccgttcgagagataattctactcgctggttctcgaaccagtaaatcgtagcaatctctcgcgccttaacttcagatggtcgaggtacgactacggcaatagcgtagcggtcctcgcaccacgacttcagatggtcgaggtaggactacggctggtcttcaaccaacagtgtagtggtcttcgcaccacgacttcaatcaggcgagagataaggctactcctggttctcggaccagtaggccgtagcgatctctcgtacctcgacatcaatcggccgagagatgaggctactcctggttctcggaccagtaagctgtagcgatctctcgcacctctacttcgcgtggtcgagttaaggctacacctgattttcgaccagcggtgtaccgatacttccactagctttacttttcatggttgagttaaggttacacctggttttcgaccagcggtgtagcgatactcccactagctttacttctcgtggttgagttaaagctacacctggttttcgaccagcggtgtagcgacactcctgctagctttacttctcgtggtcgagttaaggctacacctggttctccaccagtggtgtagcaattcttcccactacatccacttccagtggttgagttatgactactacatggtcctcgaccagtggtgtagcgattctcccactacctttacttcaagtggtcaagttggggctacaactgattttcgatcagcagtgtagcgatcctcccattacctctactccagcaaaattgatatcaggtacacaatatcgccaagtgttttacccagagatcccttaccacgacgacacctagatttgaaacctatcctcatgtctctttacgccgtcctgacaaggcctctgaggaacctaagggaactttggctggggatgcccagagcggataaggccttgtcggatcatgtagagacaaacgaccatgtaagacctggtcatgtaagagttctcgccgtgcgtattaaccaagccgtgtaatcggaaattgggttttccaacttcacggctgggggctagggtaagcgctttttcaaccaaggcaggtcaagggtccaagagccttatcctccgagaacgattctccgacgacaaggctaggggcaagggagagtgtatgactcaacaagttgactgatcgaagtcggtaaaagagaagacgcccgtacacaaaacattggtctgtaaatttagtttattttcagttttccatacatattataacatgtcaccctttgagtgttcgctcgggggctatttctatctaatattcttttctaagtattgatttcaggaaaattctattcgacattgtcgaagactccatgtctctatggttctataccaagatcgactaaggcgagtacgacaaatattgacaaggctccgtcgcagactctgcgccttctcgatcactcgagaacagttggtggatctcaacaaggaatacggaatgaagagatggtgtactcgccgagataaaatttcttgacttcaatccaaattctcgattacagcaagacgagagacttagtcgtatgctctgtactttcttggttgacgtcggagattgactcagacaaaccctataaggtgcccgcatgaggctgataagggaagtctaacgttatctctgaactcaccgagaacggtcacgtgagctcgataacagttattccgaggtcttcggattgagaatatgaactcgttcatttgcattgaagtcgggggctactgtcagtgttatagataccacatacctaatagtagttgactaaatctcggcaggacccaccacataccatgtcttatatggaaacaaccttcggatataggaagagtttagagttctacatggaaacgacaaggactattcggattgtatccatattggtttccttagttctacttggacaaggggacacctgtgggtataaatacaaggccccctagtaggagaggggatacggaacaatagatcaagacacaagatcaacatacaagccaacatacgccaagacaagacgtcagatatcgacttgagagataagcatggctagtcccctacggtgtctacggatactgtcaggagagatctcgccggacacggattcgaggaggaagactattctattgtcgactacgggatggttttatggcctccaagtcgacaacagatagatagactaccccaaatattgtactggtgtgattatggtgaataagagcaactaccggcttcggccaataggagtagggttattacctgacaattcaggggcctgaacctgtataaaaatcttcgtccccatctattttacctcaatctcgcatatatcctagtaccaacgatccccatactatgcaaatatcggaatcgcgacatcaaacgtcgacaaatatatgaccaatccttaaacttgagcagagctattgcttaggtctctcaagttgaaaattatatgttcagatacatgatgttgatttagtgaaccatagtatgtccaaagcttgttttactagacctgaccgtagacgtgacgcttcacataagcaataattttgcattcatccaccttcgcatcacagtgtgacggtaatattgtacataaccccctcccccccccctccccaagctaggctaccactctgaatccccaaaccccccaaaattattagcagtgtttagtgtttattcttacaggaattttcagttcttgagaaagtaccttgaactacttaaattctgaactaaaatttttgctatctagaggtaccaatggtaaaattacccttattcttatactctttccggactaatagtacctatcgttttggacatggttaaacattacaagctttgactataaataacgttgaaaatatttgccgattaatattaatacgtattttaataaaaattatatatctgttgatatatctatatagattacaataaaatatggtggtcaaatttatcttttttttaaggttgtatctttacgaaaatcctccacgttaggcgcccggcgcggctgcaaaaaattgggcgccgggcgcccgcgccctggcgcctcccaccgtacgcgcgcgcaccgccccgccacctatcccataccgccctagtcacgtgtccctacgtatactccgttacaacaaattacccacatactacggaaaccctctattaagagaatccgtttcattttttttccacaaaaaatgttttacataatatactcacaatgtttcactatgtatatatctaatgttgcgttgaattgaaatattcttttgcaacaaatcacccacatattacgaaaaccctctattaagggaatctgtttcattttttgttccaccaaaatgtttcacctagtgtacccgtgatgtttcactgtgcatgaatcaaatgttgcagtgactaaacattctttcgctatttgctgaaatattgtttttatataaggtgaaacaacgctcaattttttgagaaaccattgtttcaaacgttgtagcaaaatatttcatgaggtaatttggttgtgtttcagctttttaaacgattgaaacattttcgatctgcttagtgaaataattactatctacttagtgaaacaattcctatatacttggtggaacaacgtgcaatatttaaaaataattcaataataagctaaatttttttcatcggattatatcaatgtgtggtcttgttttaaagatttaattgcaacaaattcaatagtgcaatcggatcgtgaattggataagtaatttgagagaaaaaatagtttaaattttatttaaaaaacttgacacatgcatggctgcatgttctgtgcatgcagtgactacagattatagtatttatgtgcatgcatatagtagctgtggggcctctgatttttttcttcccgatcagatggctggcacggacgccagattttttttttcccccgatcagacgcccgatctctactcacctccgtgtctttatcaaaacgatgcaactcggagagcaataagtttttcgggctgtaaaaggtataaaatgatcaaaatttcagcgggtccgatcataatggaagtcatacagtccggcggcccaagctattctctctctctccctctcgaccctcacggcctcacctcctccgtggattttttttttctttttctcttgagcatcagggatcccatccgtcgctctgccgccgcatcccgcccttgcttgcttccgatcttccctgtaccccgctgatcatcgcctagccctagggccgctgacttcgtcgcccacttctctctctcctgctttgctacgccgcgagggggtggagggctggaacagcgaggatggcccctgcccggataaggggagacgaaggcatcggcaagaacagctgtaataaaacgtggaggaagaagatttcgaagaagcaatctgcgcagcaaggtgctttcctttctactgttctcgcggatctgcggacttccccacttacccctctgcagcaatttttttttcttttccctggatgcccagcttcaattcagcacttaattttggttttctgcatatgagtattcagcactcttctttgcgtgcccatcttcagtaatcctatttgcagcgaatgtgcaaatgcaacatgtgcattctgacatcagtatgtctagtatggccccgttcgtttagtttctttaaatctactccaatttattttgtttttaattttggttgtctaatttatgtatgcatctttgaagtaaacctaaatcatatcactccacttttttttttccatttgttattattttagttctccttgtgaaccctacagaaagcaactctacatttgatagaatggctttctgcatatatagagtatgcaaagactaaaatttccagttaacagtacacatcagttgtgcctgtgttgatttcaggaggtgtaaatcagcctttggttgtacctcaactcttcaagttccacaagtttatgaggctctttactctccaagagatgctctttctgcgtcgaagaaagagtaaatgggagcaacaacaggaggaggtagaattgttctcagaagaggaggaatgtaagtaacttaattgcgtgctcgcttttcattttcatgtctaaaaatagagtaagttacataaaacattgtaaccataaaactggtcgcactgcaactagcctaggaagtagaaacgaatgttgttgtgttcaactctgaccacacagcaattgattttgttgtgtttaattatttgaaatacttatttatgtagtctctgtgttgggctgttagggtgaaaacgtatgaattgaaaacaatgcagttcagacaagtgatgcacatgttcttttgtctttgaatctgttctcagcttgctcatgctaacacaacttgttttcgctagtcatggttttgtttccttttaaaacccttcctaaaactgcctgaaacaatgacctcagtggaagaaaacagcaatcaaggtagctatctgctgccacagaagtgtgatgaaacagattcaatattcattgcattatctgctgaggcatccaggtgtcgatgaagaggtatcataatcttgcacggtcgtggcaatgatcatggtgcatataccatgtgaccgcttgccatcgatcttaccatactaacacatggaccctagagcatgcttgggcttgggcgcatagatgggctgagatagagtttgtgagtacatattaagcggggaagaagaaagtactatcttctacttgctctcacttaaatctctctcgttatttcatttcaatgttattatacggctctcattcagtatgccaatcccttggtgccatgccatatggccatctactctagacgtggtagataccgctgtttgattgatgttcacaccagtgatactgtgacagaaacatactggagattagcttctttttcgggtgctgatgccatatggtcatcgttcggaatactgattctatatataccataaagttggggtaaataataggcagctagtatatcaacatgtgcacaattatctcacaatggtttatgcgtgcatatttctataaaaaaagttttgtttagtggcctaagttgctgactgagcctgaaaatacgcattgaatggaattggacaaagatttgtcattctgaccgtatacatctgttgttcagtccatttttgtaaaaaggcaggaaggtgtgttcgtcgacctcttcatactgaactactgattataggactgactccattgcgcggaaggcaagtagagctacatagcctagtagacccatatctaaaacacttttttagattcaaggaagcaagagtgcaggattaacgacaggggcgggaggaggcctggcctcccccaacagccactgacccccaccccaccgaacgccccaaataatctgccattagattaggtaggttagtttcagatgacaccgtattatcctggcatgggcacgtacgtacagatgtttagcaaaaatgctacaccaatccttaatcaaaagcaccaaaggtctttatcgtagtcatacagtcatatttttccttttagactatgtaataatcgtatgtattgtttacatatggctaacatttttactttcaatttctaaaatgcaccctccatttcaaaatatagggcgcaaatatttttcttgaatgctttacaatacaaggcacgcaagcatgcatgcagttaattatcatcttccatctctaaaatagtttttctttttagttcctaactctcaagatctctaattctattgggttcatacatcgtatttattgggataattcaaacaaagggttaataatatttttttcttgatatttatattagtagtggttatgtcttatattttagaatggagggagtagttaataattgcaaaaggtagatagttgatcactcattttaccataatctagctttattgtattttcctttttatttagacttttagctcgaccattatcactgcttatgatatgtctactcataaagccaaattaaaataaataaatatatgcattatagctatatgcctatcttttgaattgttgatatgatataaatattgtttatgggaaccttcaaatttgtgtatatttttctctattttttctcacatatctaggttggccccccttgtgatcagatcctggcttcgccactaattaccgagttattgctacctcatgcaacaaattagttgtgaacttgtgatactaacacataatatagctgcaggtaacgcaataatttagatgaagaacaatattgtgaactatttctgccccatgctatttttgtgtgacaatcaaaattctcaaaagtattatattggtcagagatcactatgtttgtccatgttctttcccttagtgataggtttgtgattagagagagcaatagatagttgttttatactgccctgtgaaaatatgcatgggacactgagatgatctctggatgcaggctccactacacgcttttggagggatccggatactgagttctgcaacatctgtggagacgacaagggaaaccatctggagctgatgtgcccctacaactatctttccccggctgcgtacttcccatgcagagcgcggctcgctctctggggcaactacacaaccacgctccgttacaagtgctcgcggcacagagaggaagagcaaagcgagcccccgatgcacgacgaagcgaacgcgaggcgtctcgggttcctgcggtgcctcgtccgcgtgaacaacctgtcggagttgtgcccaccggagcagctcgttgagctgttcggccggttcgggccgctgtggatgtggtacgtcccgacgcgaggctccggggggacatgcaagggattcggctgcgtcgtgttccagcgacatcggcacgcggaggaggccgtggaggcgctcaactgctgggaattcggtggccgcaagctgcgagtcgattgggcttacccttgtctaaactgatggctctgctcgctcgtctatgttccgaccgattcagtcaaaatcgaaaaaacaaaaatgatgtttccttcaaaaaggtctaagaaatagtagtagtagaatgatctggatttttttttctatgttgaaagttcaattagtgatgggttttggtaaatggttcagtgtggaattacgaatgggtgcagtgagttgagtgcaggctcattctcacttgataactacgagtatgagttttgccttgacttggtacagcttaggagttttggctgaattgtttcaattcagaggcaccatatgaaagtcaccataggaatgaaaatcttggcaaagaaatcccttgcatttggttagaccaataattccgtcttcccattgcgtgaaactctagtatgattttgggtagttacatacattagataaaatataaatgcccagcatcctaatcaagccaaaaacacaacgggcatctatcttgtatcgagctctatccgtcccacattgtttgtcctttccattgctgaactgcgatatagccacgataaaatcatttgtaaatttgtgcggtaccaggtacgccagatacattcctagttgaaacgacccagtgttgtcgtatgaggaacagtatcgaagtgaggcatacaagttttctatatcttcttgcttgtatgcactattctggtccaactttattgatgtatgcattctggtccttttcataagctccgttttcactttgaaaaaaattgcaaacctatgcgttcacttattttttaaaactatataaacaagggatatcaaggaaataacttgtcttttaataaaaaaaagttataataagcaacagtctcaaaagaacaaactcacaagttgatcccatctgacagcgttacgagacaaacagatacgcaagacaaactcacacactcataacatcttatatagtgaaagcaacaagctttcttgcacaaggatatgctacatcataaaaaaacatattggctattaaaagagtctggataaacaatagagtgaatcaaaatgatacatgtatgcgggtgatgcggggccccggtcacccaccgggtcccctgtgggggctgcaacaggtgatgtttttcacccgacttcctttgtggggtcgggggctggggcaatccaacccaaccccgctctgccctgttgccacccctatacatatgggagaacagaaaatgcaaatgtctctctagtctttagtctctgctagtgcgtgtggaaagtttgatgtttagctacacacaagaagggtaaatgggaagtttgatttttgagctacacaagaatggtaaatggaaagtttgatatttagctacacacaagaagggtaaatggaacaagaagggtaatggaaagttttgatctttgagctacagacaagaagggtaaatagaaagtttgatctttgagctacacacaagaagggtaaacccaatcaactcgcagcctccggtcaccggcctgatagccattgagctcgtcgacggccctctccccatcctcgcgtctcttgaagacgacgaagccgaagctcatgtggattccagtcgtgcatccacacaggtagttcctgaacttgggaacattccacatgagcagagctccgaacgggctgaagaggtcctcgagatcccacaccccgaaccccggcggcaggttcgtcacgcgcacgaaacgccgcaggaactctcgatgatccctggaggtgatcctgtgctcctggggagggcactctcctctgcaggtgtcgctgaagtatcgcccgaacatgtagttgtaagggcagaagtgctccatgtgatcgtcgtctccgcagatgtagcagatgtcttgctctggggactttgcgcaggccatgattctgaatcggatcatgccaagcctccgttctggctctgttaatgtcagcaagaaaatatatgcgttagacttgtggacacatgttaaaaggaaattaattaccttgtgcagttgtccacaattaaaatgtcttgctagtatgtgcaacgagtagttttatgtttctgctcatctatcaagtttctgctcactggaaatttcagtctttgtatactctgattgcttcatactctgttgcatactctggtagcgttgttggttacttggtgttgcctatctactacatcaaatatggaattgctttctgcatggttcacaagcagtttcccactgaaataacaactaacggaacaaaaactaagtggtatgatttgggtttgggaacttcaaagatgcatgcataaactaaacagccaaaattaaaaacaaactagatttaaacaattagaggggcagatgctaacttgcaaaaactaaagacatgctgatggcagaatgcacatgatgcacactcactgcacgttcctttgatagataaaagtactgaatactcatatctagaaaaccaaaataagtgctgaaattgggcatcccagccccaggaagaaaaaaaatactcaagaggggtaattgcataggtctgcaaatccgtcaaaaaggaagcaaacaatcttcattcaagagaagaaggaattaaacaccttgctgcgcaggtcgcttcttggaaatcttcttcttcctcccagtttttgcagaattgaactggctgatgcgtttcagcttcccccgaatcctgggcggggccatcctcaccgttcccagcctagaactataggagaggagaaggagaagctcgcggcactagggctagggctaggcgatgatgagcggggttcagggaagatcagatgcgcggcggcggagcgacggatggaatccctgacgctcaaaagaaaactataaaatgaggaaaagagaccttgggcctcaacaccgacttccattattaatttataatctggcccgcggagccttcttttcctacgcgcagcaacaccccaagccgcccagttcttttaacttgggaaaaaaaagtttgatttgaatatgattcgtatcctcagtcctcaaccgtaaaattggttataatgactctatattaaagtcctctctctctcttacgtggagaataaaattctctctcgacaatattaacggtgaatattgctgacgcagcatttatgtggcatattgaactaatcttcattctacttgatgtttacgtggaattaaagtcagccaaaaaaactttaagaaaaataaatctaaatgggacccatatatcattagatgtttaaaaaatttcaaaagaatctatggagcccagatataagtcacagagtagggtctacatttttttcagataatggaataaaacatctcggactttgctcaaaaagagctacagccaattattacaaagtagcactaaaaaaagagttaagttaaacaaaacataagaaattaaaaaaaaaacaaataaccaaactaagataaggagtagacatctattgaagtctatttgagaatctccatccataatttgcaaaaagttgtataactgttgtcgcaagcatatgacatgcaacttttaaaagctcaccatcttcctcacacctttgtagctgagcccagaaccggagccaatatgttgccctgaaaattacctgcatatatgaaatagaaggtgatttatcaaaaaccatatcattcctgcttagccacagagtccaacataaggcggaagctcctacaagtataagcttgctctttttcttgtctatccccaaaagccaaccataaaaaatatgtgatatactattaggaaggtataaaccaaaagaaaattgaacggttctccatacaaactttgcataatgacattccataaagagataatgaatagtctcattcttcagtaacatcttaaactaccattccaattccgtcttaccaaattgtctttggttagaacaacaccgtaccacataaatatcttaatcttaagtggcatcttaagtttccaaattattttatttctctcagtatggccattattgattaaagccagatacattgacctcactgagaaccgtccattctgattaaagttccatctaaaacaatcagaagagagattcaactgcacatgtacaatagaagcacataaatcatgccaaaaaagaagtttctgaccaactaaagctctcctaaaagaaacattaagtggaacagatcgtataacactagcaattgaagaatttttcctcaggacaatagcatataaagaaagatacttatctttaaaggccaagttacctaaccatttatcttcccaaaatcttatttgttccccactattcacaatccacgaaccaatacttaagaaagtactcttaacttttataagaccttaccaaaaatggaaatcaccttgtttcttatcaactcgagttatagatttattataaagatactttctcttcaataagtcttgccacaccccctttttcatttattaacttaaacaaccatttactcaagagacatttattttgtatttccaaattatgaacccccaagccactgatgtgaccatggctactatcgatacaaccgttgctcacatcatgaatcaacaagaagacatcaagatcaagtcctccatgtgctgcaatctgattcggccacgtgttacgttgctgacttcaaacggccgccaaatctacacacgtgctccgttttgggcccgtgagtacttgatggaaagctctcaaagtcctctttccaacggatccagcctcatcttggaattccatctcatttggccgcaatcacagaagcaaggtattgcatcaccaataataggcctatgggcttgtaactacgtctgggaccccggcccaagtggggcccatgtggggtgcgccccaatctggtagagcacgactcttggaccctcttggtagtcctcccacctttataaagaagctatccgctgacaccatcgtcatcgcttctagatccatgagtctactgatcctaatgcatgttgaaggggatcgaatggcgaattccatcaccattgttgcaccatggcgttcctatcggcctccgcatggtgatcccttcaccgatgccagcttggctaactacaataccaacaacgactaaaggcagcgctcatagcttcatctttcactggtcagtactttcaccgaattccacataagaaatctagtgatcatgcatgggctaagttaatgatttaagaatgtgctccaacactgtggtattagagccttcttaggcatttgcatgttcccatcactccagtaatgaagccattaagccatgtcaagtaacctagcatcatcttgttcatgttttagggttcatgttgcatccaagtcaaattttatggatcatgttctgttcaagtgctattagggtttaattgatgtttaagttgcttgtttaagtcaaatttcctggattgggtagaaattaggagggaattacgaattttgagttgaagttaacaaatcccaaaaccaccaattctgtcctaaccgaacccctaatttcgaaatttccttaattcaaaaccctaatcttgaagcatcgcaaattaagaacctcaaatccccaaattaagaaaatcttgaacccaacaaatcccaattaaagcaaaccctaataaatttgggactaagcactcaccggctcaagagaactcattattagcgagatgtgcacctacatcagctcattgggggcccgtcttgcccgcctcaccacctccactcgcaagagttggctacatatggcatgacccaagccatgcgcgtgtcttcatcgacctcatgtttcaactcggaagagcccgtcgtgtgtcacatcagctcatgccgtgctcgtgcaccctactcctccgtcgccttcttgcgtgtgatgcgcggcatcaccgccaccgtgcattcgcctccaccatctcgaactggtcccattgccgcatcaggcagtagcgcgagactgaggcttgccatggtgtggctccggccacaccttggaggagaactgaggaggagagactcatggaattagctcgctaccaatgtgccggttgtcaccatcacctacgctttgctcggcattgtcgtctcctccgctttgctcggcatcaccatcactgccaccactcagctcacgctagaaatattagggaaagaaagggtaatggagcaagggtttccacctggcgcagattttgttctgggctcgatcgatctgagttgtatgaccggaattggatgaccaatgtcgacgactcgctgttttgtcgaaaataatcacccccaatagcagtttcctcaaaaggaatcaccctcaatcccctcaacacactataaaagggaatttcggtcttgtacacgggtgagaactcatgtacggtaagattttcccaaaaccataagcctgctgatcctaatgcgcgttgaagggaccaaagattgaatttcatcaccatcgccgcagcacggcattcctatcaccaccgccgcagggtgatcccatcaccggcacccgctcgtcaactacaataccaacggggactaaaggctgcttcatgtttcactgaattctgcataaaatattaggtgattgtcacgcccagaaattcccgagtagaattccaagcagaatgtgcattaaaacccccgtccaggaccggccggggtacacaaacgacaaagttgacatacagatccacgacttacaaacattataaaagtcttacataaatgcagcggaaaaaaaacaaagataactggagctaagccttgacttggactgcagcgggaacaccactccacaggcatcctcgacggcacggacgaagcctactcctcggaaaaaccaccatctaacgtatactcaaactctggggtttggggaaaatagagcaagattgagtactacccactatactcagcaagtcataccggaataggggtatgatgcagggaaatatcaaaggagagctagagtggttcatttgcataaagcgagcatttataaacagtagttgaaagcaaagaaacagttgtaataattaatcaatattaaccatccactgtccaacgctacaccacattgcaacaggcccaaccatccacctagactattcaattccattagactagtctagggtgaatctaatcacggtgaatctggttgaccgcccataaccgcgggcatggctattcgaatagttttactctgatcagaggtgtacaactgtacccacaagacacagccccatgacacgtttccgtgcgccgacatgccaccacgacataccggaaagaggctgtgacaggaccgttcacataaccccctctagccaagcacaccacacctcaggtttcacccctatccccagcgggcaacgggtagtcccctctcgtgcctaggtgaatccggaagcgacagaggccgtcgcaaggcccgccccgctccatcacacccacccttgcctggatgcgtcagctagaggaaagctacactacaagcccagccgttgcccacgctggcttgtggtaagtacgagaaattctttcagggtttcccgcgaaccggtccttaagtgccatgggcgtgactagcaaaaccatgcacccacagcccactatatgatttattttaattaagcaacaccaggacggtggctctaatccaacatcaacactagaacctgaggtctatacattaatatgatttcccccattgtgtgctagttgaactaagcatggctaagcaatccctagaccaatatctagtcatgttatatcccaagctaacaaaggagcatggtacaaaaatagcatggctataacagtaggtaaacatcccatggtattattgtgaaacaatgcaatatttgaaggaaaacaatagaacatttgcaatataggatcaacatattcaagtgacaagaatgacttgccttgctctgctgctggaggaacctcggcgactaattcaaagtacaccggagcgttgggagagccggaatctaagcgatatacaaagtaaacaatacaaacaggctataagactactgaaacagagaacaaaaccatttttaatggattctatgcatttttcttgatttactgagacttgaatgggcttaaacggagctcggatgaattttctatgaattttagaaagttcactgtgtttttactataaacagaaaaatccttaattgatttgttgcgcaataaataaaccctgggagagagagtgggcggcgccgacatacgagcctcacatggcagtgactcggggggggcggtctgcggtggaccgggtccacggaccggaaaaggggcggcgcaccatgtggagctgacgtggcgccgacgcggcggccacgcggcagccacgcgggcggccgaacggacggccccggtagatcggacggccgcggaagcgcgtggccggcgcgcatgggcggctctagccggcccggcggccatggcgcacggcggcgcggctcgacgcagcggcggcacaaggcggcgactggccggcggcggagggcggcggcgtcgcggcgacgcggacggcgatagcggcggctaagaggctaggcggcggcgcggcggctaagcggcacggggggagagggagaaaggggaggaggggcctcaccgatgacgatcgactacggcgagcgacggagggcgatggcgacggcgagacgagctctgggaccacctaagggatcaaaagggatgagttagagagggaaagggaaaccatggatggctaaggcgtcggccatggcgaagctcaccgacgcgcggtgcggacggggttccggcggcggattccgacggaggaagggtggacggcgtggccctcgggcttgcgaacccgacggcggcgacggcgcggctcggcgcggcggctagcgatggctagcggctaccggagcggcggcagcgacggcggagaggagggcgacggcgctagggcgatagaggccacgggagagctcggcgaaatggggaaaaagagagaggggatggcggtggtgcttaaataggggaggaggggtccggacgtggccgggagaggcgggaatcgccggccgacgtgggggagtgggagaggagagagaggcgggattcgtaattcgaatcccggccatctcgagcgcgggcgcgggcgggagagaggggaagtgggcgcggggaacgcgggcgcgggcggcggttgcggggcgcggcggcggctggaggagggagacgggcccgataggtgggccccacctgtcggcgacccaaagggaggagggaggcggccggctcagctgggccgtggccttcggccggcccagcggggagggggaggggaagagaatgggccggcggcccattcgaaaaaaggagggaaaaagaaaaagaaaaaggagaaaatgaatttctagggattaaatattgcttgtgctcatttttaattggttaaaaattatttctagagctctgaaaattccactaaaaatcatgttagcatatttcgacatgtagaactcaagaaaaattccacatgccaattccgattattatttacattaattcctttagggtttctcttttgcttttacaccgatattttcttgagaccatttataaattcaatttaggcttgggagaagaacttcagggtgtgacagtgatcatgcataacctaagttaatgatttaacaatgaactccaacatcaaaaaagcatgatattcagtaaaaacaacaaaggcatgatatatatggttatttacgcaagaatagacttaagctagttttagtagcagaaaggaagatggttcaacttgttatgatatgtaaccttccatggtacataacatttattgaatatgactcatataggactaggtggctagaggctaggagttcatatgcaaatactaggatggttcagttgatcaggtttatgttggatcaatactagagagcaagtaacaagaatcgatgatgttgtgtatggcatatgaccaaccatgcattaatggctgatgttctgcacggcataatgaaaaatcctagagaaatctcacttaaacaaaacagaaataatatttctacattggtacacaaccattggacaagtcacacaacaaaattataggtgattgtcaagaaattgaacagtggttctattatggggcagaaggctctggaatggacaagttgtttctttccatgaatttatctattctttctccttccacttatccttacagatagtggcggaggaggtgcatcgtcgagcctgggtgaataatagtgtttcatagcaatctagcaacttctgcaaacgttgacggcattcgatagtggaggcggcaatgacggagcccgggcagcctcccgactggtccgggagctttctctgcccctgcatacatcatcactgaatgaattcattttttatttatatatgagaactagagagttcactagcacagtcaaaggtttgtattggcagcgaagtgcttggaaaggaaataaaagaatgaacataaatagatataacacaacactaaaaatgcttgtggcgtgtatctttgcaaaattaaagtgtctcaatcttgctagggtcctttattgaggtccataaattttccatttgtatctttgctaaatatagtagttatttagtcaattgaagatgttggagaaccaaagatgacctaatcgttaattaattaagaaaaatgggacatcacatctggagtcgaacactagaaggatgggtgcattatctccaaccaactattctaccaacctctcttttaatagatattcagtaaattgaactatagtgttcaatcttattacaatgtataaaactaatctataagtcatttacattagtaacacaaataatggtttatattgatctagtgacacaaacaatatggtgaagattttactcgagatgacacacttatatgggtcttcttccttcccttacaatttcccttttgttatcacttcttatcttgatggtggcgaatatatggtatgcatttttcgtattccaattttaattccattgagtttatatttggatacatcacaatagataagtctctccatatgtgcacagttactaattctctaagtagtgtataaatttcttttggctgttttttaatgcactgaatgctacctaatataccctccaaacatacaaaaatctagatatcttttcatcaatgtaaatccgtgcttctagttatatccttacaaaaatctctatataaacagacgttccacgacagcatgttatatccatcattaggaaaaatatagccaaaggagaaccacaccttatccaataagtgatggtgaagggaaagggaagggctggcaggaaaaaggttgagatcaagcgcatcgaaaaaaaggatgcacgtgacgtttgcttctcgaagcgtcgccaaaccctatttaataaagctggtgagctttcattgctatgtaatgcaaatatagctgctgttgtgatttctcctgctggtaggggtttctcctttgcccatccctctgttgatgatgttgctgaccgcttggcctccatggccatgggcattcccaataaccattccttgggtggtgggtaccatgatagcggtgaggtgacaaacatagcgcaacagcagaaaattgaatatgtggagctccaaaagtcattggaaaagtcggaaaagaagaagagggttcaggaggcaatggagaaggagagggcaggacatcttatgcaatcactgacttctgaagttaatctcctggggcaggatgaattggaggagctgcacaacaaactctcagctctaccttacacttccattgcaaagttctaccaggtactgcaagatgcaaagggtactagaatgccattgccacagccacatattgaaatagcatgtcaatcacaatttctatttgaagagcaggctgtcacacccgcaaatgctgattttccgggatctagcacatgatgtccagtgtccagggttgtggtgactcttgcagctgcttcgatggacgatttgaagtgtgattcctattactagcctatgttttagacttgtaatggtgaagcatatatatatgcttgcaccaatcatggggaataaatcaaaattactttatgaaaactttctatgtcaaatctcgacttacaaaccaagatatatctaggatctattactgtgagaattttcttagaacatttttctttgatccaatagtatggtataattgagattatttcttctgattatgtaatatttcgcctcttgcatgatgtttgtaagagaaatgacagtgatacttcaaaagctatctgcaaatcctctattgaaaaataatgcacctatatatgtcttgtcatatgatatctaacaaagagttgtataaaaactaattagtttctgttccaatgtattgctttatcgggcacctgcaagcactcaacacacattatcaacaatgacttttcgataattgatatcagttcatgataaggttgagataataaagtccattatttgtgttaaatgataatatgattcgagctacaagttcctctgattgtgttgagaaaaaatatgggatgaagattaattatcatacaggataacaagatggttttggtttgagtgagtgaggaaatcaggtagaaaaacataatagtgcaaatgcttacatgtccctatgagtgtgtgcggtagccactatggtatctaggtttaccaatgaggatgacaagctgccagtttcatgagttatggtttccaacaccaaagctgatgacaaactgctgttgattggctgtaatctaacggtttccaacacaagcactacactggtcaaggtcacctgtgacgggcccaaaccctcacctttgacggttttgggcttggtcagtgatcagtggtcactggtaagtccagtcacctttgacgggtggccggccgtcagtggtgacatccacctctgacgggcaagttaatagaaggccgtcagaggtgttggtctaagctagactagggcttgttaggacccgtcacaggtgtctcatctctgacgagcccctaaataaaggcccgtcagaggtgatgatctccggtatatagtagccgtcacagggtgacccacctgtgacgggcccgaaagtaaaagcccgtcacaggtggctcacctgtgacggtccgacgtttgcgagtccgtcacaggtgaggttacctgtgacggatgtttcttccgaaccgtcactgatgagttaattccagaaaaaaaataaatgctaaatattggctagcctcaggaattgctagccatgccctctgaaaaacagaaacatcacaggtgccagtcaccccccctccatatcacatattccccaactgcccaacatcacagatgcatcacatatcacagatccatcacaaagcaacaatttacaacatcacatatgcaacaatttaatttattatagcacacaattcataccccatgaaagtcctcaaatgattaccaaaatttcttatattctgttcgttgtgaacctccacaacctgtcaataagggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcacataattcgcctctgatagcgggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcgttcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtggagctctgttgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgcctcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaatgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaataattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcaggtacattcgctgctgcagcggctgcatcttcttgggcccatattgcctccttgccgatgtaccctgcggtgcccagccgatgcgggtgctcattccgctgttgcagtacgcgatgtgcctcgctggattccctaaactcttgggtggtcttgagagagcagaattcctcccacaccgcttcggttatttgagggtattcatcgaacggcgtatgattgccgggcgggttgacatactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcagctactaggagaaaaaagcaacccaaataaaatagaacaagtgtagttcatctgttcttatcaataaaatagaacaagtgtagttcatctgttcttatccataaggaaaagagcaagtgcaggaaattagagtagtagcaacagcatggccatataatagcagcaataagagcagtagcagggccatataacagcagtaggggtatatatgccacaggggcagcaacagcaaggggagattcacataaacagcaacagcagggtggagattcacataaacagcaacagcagggtggaaattcacataaacaacaacagcagagggaaattcacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaaaagagcaagtgcacaaaatctgttcttatgcataaaaaaaacaagtgtagaggtatataaccactgaatcaatcatgcaaatttaaaaaacagcagcagcaagggtacagaatttgcatgattgacataaaacagcagcaggaggagtataaatgcaagtccacaaaattcaataggtctagcaacatatatagcagtacacactccatgaatgattatatgtccaaatggcacttaaatccacattcaagttgcacttaactaacagttgcaaccataggcagcagcatgggcaaacatagacagcaagggcaaacatagacagcagcagttgcacttaaatccacattcaagattcactgcaccaaaatcatgtaatacggggtatactatgaaagatatggcctcagttttgctcagaaatatgcatcaattatattcatttgcatgaagggataaaaagaggaaatcataacatcaaaagagcaagtgcagaaaatctgttcttatgcataaaaaaagaacaagtgtagatactctgttcttatccataaagaacaagtgtagaggtatatgtccaaatggcacttaaatccacatccaagttgcaaactagctacacattcaagttttaactaacagttgcaaccataggcaacagcatgggcaaacatagacagcaaggggcaagtgtagataataaaacagcccacaataatttagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggtgtacttggagacggcggcgcaggccgtagtcgtcctggatcctggtggcggcggcggagaggcagtggcgaagaggtcgaggcggtcggcggtggtcggggatcccggcgtcggggaggtcagggtcggggaggtcggggaagtcgatggacggacggcggagaggacgaccggcggcgagggcggcggtggaggcggcggcggagagggcggagatggcggcagagagggcagcggagatggcggcggagagggaggaggagaggttgaggcggcgacggtggagacgacggtggagagggcggcggagatggcggcagagagggcagcggagatggcggcggagagggcggaggagaggttgaggcggcgacggtggagatggcggtggagaggacggcggcggtcgagagagtgagtgaggaggcggcggtggagaagggcggagatggcggcagagagggcggagatggcggcagagagggcggcggcgaggagggcggtggagaggtcgaggcggcggcgaggagggtctggatcgagagagagagaggcgaggcggcggtcgagagagtgagtgagtgagagtgggtgccagatctggatcgatctagaagatgtccaaccctaggtcaaccctagtcaaactcacctgtgacgggcgccaactatgtggccgtcacaggtgaggtcacctgtgacgggcgccaaccgtggagccgtcacaggtaagaccacctgtgacgggcccaacactctgggccgtcacaggtgaggtcacctgtgacggccctacagatagagcccgtcacaggtgagtttgcctagagcaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcgtggtcgacacgtgcatattgaacttcatcttcttcttcctcctcttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttaacttcaagtaatctagctccaatatttgctcaactttaccatagtattgatcacgacgaccaccgtcactagcagcctcgatgcgtaacccactgttctgcactgtgcatttgctgtcttgctttaccgtgtgaaaggtgtatccatttatgtcatatccttgccaggtcgtggcactccattcaggaccctgtgacaaccactgaagtgtttcactagacaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtagaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctggcttaagtagtaatcccattaaactctcgcatacattcttctcgacatgcatcaaatctatgcagtggcgaacttcaagatccttccagtatggtagtctccagaatattgacttctttttccacatgctcctctcttttgtcttttgtttttccacatgctcctctgttttttcgttcgatgtgctcttctcttttcgctttccaactttcctcttttttccaaactcgttggttattcccatccctaagttgtgcacctccgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcg

SEQ ID NO: 69115 - DNA, 1225 bp, Oryza sativa
cgtgtgctaggtattagtttcaggattacgtgtgctagtaattttgtatatgttgattactttaaaaaagcaaggttttaatcgatcgatgcatttcatattattcagatccacttagtattattcggagttccttttgaagatggcggtcggatcttgatagtggatgttatcgtaaactctgcagcaaatagcacttttgatgaggtattacattaaatctatagtcgaagtatctttagatcggatggccatcgtcaagtgagattttctaaataccatgtgtgatgataaatcgaagtgattaatcaattttgcatacgaactcatgataaaactgtagaatgcacaacttgttattacatataaaactgaaaagatagaattttagtttttgaaagtactaatacaatcaattagtcgtacctcaatgcgaatgatgtattcaaaacaaattctctagccaagtaacttactatcatgatatgtgtgtgtgtgtgtatgtatatatatatatatatgtatatatatgtgtatatatgtatacatatatatatatatgtatatatatgtgtatatatgtatatatatgtgtatatatgtatatatgtatgtatatatatatatatatatatatatatatatatatatatatatatatatatatatatatatatatatatgtatgtatatatatatatatatatgtatgttatgtatgtatatatatgtatgtatgtatgtatatatatatatatatgtatatatatatatatatatatatatatatatatatatatatatatgtatgtatatatatcttataattgtgaaataaagcaggattaagaatttaagatctattctatttgtgcatattgattataagagaataattatcaacagttaatgataaccattagatgaaacatagctatatgatgcaaggagcagcacttgatggaatttactcaactagcaacgaaaaaataggaaataagttagagattgttattactcaaaaacgacagttaagttatttctatctctaaagcgccctttatgagatcaattttggatgctttgtaacttaagaagtacaaagcaccataaaagccctcattaaaaacatgtgtagcacatttatgtatttgctatcaaatccggtagtctatatacgaaacatttacaacgcggcatatattaggtttcatccactaattaa

SEQ ID NO: 69116 - DNA, 7607 bp, Oryza sativa
tagttcttggtgcacacaaaatacaagtggaaactagaaaagaaaaactcgagtcccccttgacttggcttttaagaaagagagtgagggctcaaatgcaacacccatgataaaaggtatatagtttgaaatatttgggatgaataatatctggttttgaatcttatagatgaatgttagatttccgtgatatgttaaggatgcaaaatggacttaatgcataaaagcacattaatttcctaacttaaaacaagtaaactaacaagaaattacaacacttatgtaacggaaataaccatcaatattgaggaaaacgtcatagatgggcgatttcctactagtgaattcacaattgatcctaatagttcattatatacacacacatatttaattagtatatgtattaatgatgattgggattaagaaacaaccctttaattagcacatattaattaatggtaacatatgtacgtaagagttcatagcagaatgaactgtcgttgtacatgccgtaattataatacaatatagctgataagcatattaattaaatctaattacaagtgataagggtctcaaaattaaactatatttgaaacatgtgttaccccgcaagcacctaatgtgagcataataattagttctcacctggagacatttgtctttatagtttccctctattgtgcatgaattagttaacttgactacatacgacgctaatttttttatattttagcccttttggaagcttcttttacaaatagaaatctggaaaaacttattctagctaggaatagatttttttctcaactctagggttattggcgctaaggctcaatatgatactccttgccgccaccccaccccccccccccctcctccccggtggtaggcaagtcgctgacgttgaagggtcagcaccaacctctttagcactaaggacctattcggtgctctttggcactatggatctatttgtaagaaaaatatttatattttgacccttttcataaatttatgttaaaacataggccctcgatacaaggatcattggcgccgagggtccattccgagaataagtttgtccaaggatctatttgtaaaataaattttaaaaagaaccaaatgtaaaatctagacctacaacaaacaatagcgagcatatacttagcgcaacgtcatcaagaaaggcacttatgcaagaacagggataataccaaatgttgttaagtgtattctccatgttcttgagtaagtgtattctccctgtggttacttacagaagaatgagatcgacctaagtaacttttagttctagattattatgagtcaacttctgatggtatgtctctgatggtatgtcatatttattgggcctgttcggctgcactcatttagccgtggtgcagccagcctaaacagtgttttgtgtcatcagctgcgacaatgacgtcgcaacacagtggcttcaccttgcagccgaacaggcccattgaatatgacttgtgcatgactaggttgccagaggccaggatctaccaccatgtcagttgatcaagatgtttttgttggacctatagtatagaactagtgtgttgtgtatggaatatgaccaaccattactagtatatgttgtgtatggcatactagcagggacatactagagaagtctcaaataaaactagaattgaaatagagaacaaagatacaacactgatgtttctactttggtgcacagccgaaagaagaaaatctcatttaatgaacagaaaatgttttttcgcttcctcattgagccacgtatacttatatagcttgagacattgaatttggtcaggatggttggattgatggagattaggggaagagtcagaaaacttccatgggaaggatcaatgagtgacatggtggttataaatatcctagtcgtcggtagtaactttgggtagggaaaggaacaaacaatgcaatcaaaataaaagtttctaaatgacagtaaaaggagcaactataataactcaaaatgcataatcgtattctttgatcacctaaagctcttaaatatctttcacatactgtgataacatcttagttcccaacattatcatagctcttgttggtcgtttagtacaaaataccatgcaaacctcactcttttgaaaaacataaattatactcactccagattagaaataattatcgttttagacaaggacatggtctctaaaaaataattttaaccactattttctattacaatatatatagaaatatcaacaaatgtattattttattgaagagctcttaaagattaatccatacatatggtctctatgtttctaaggtaaatattttagaagttatatatagttcaagttttaaaattttgacatcagtattgtcctaaatgacaattatttttaacctgaagcctgaaggaataccaattatagctgtcattatacccaactaaattttaacatatataattattataaattacactttgcacataaatatgcaagtcatagccttgcaattgcatgacttaattggctagttataggtgattgccaaacaattgaatagtgctgctattatggggtagaaggctatggaatggacaaggccattcttgccatgattttttccattctttttcctttcacttatctttacagcttcattctgttggcagagaagtgtttctcaactaaatttcagctcaaagaatatggaaaggaaataaaagaatgaacaaaaaatatatcccaataaatgcttgcagcgtgctaaattttccaggttttgcaaaagtgtctcaatcttgctaggttccattcgttgaggtccttaaatttccctatgcatgctcaatagagtaattatttagtcaattgaaatgttggagaaccaaagaggatttaagtgtcgattaattaagaaaaatgggacagcacatctggagttgaaagctagcagggtgggtgcatgagagcttccccagaaaactattctaccacagctctctatttagtcacttaagcgataatattaaatccagttggagtgtatgaaactaaagtataagtcatttacgttagtaacatgaacaagaaaaatactatggtttagattgatgtagtgacacaaacaatatggggaagattttactcgagatgatacacttatatgggttttcttgcttacccttaccatgacctttttttatcacatcttatcttgacgatgggaactatatggtatgcatttttcatattccaattttaattacattgagtttatatttggatacataacaatagataagtatctcaatatgtgcatagttactagtggtctcaatagtacataaactcatttgtttagttttattgcattgaatgccacctaattaataccctccaaacatataaaaatctagagatgtttgcatcaatgtaaatccatgcttctagttatatcttttccacaacaccatattatacccatcatttaagaaaaatatgtcaaacaatcacaccttatccaataagaaaaatttacctcttgcatatgttttgttcccattctcattcctccggcgaaatattttttttgagggaataatgttcatctacttcaaacactcaatcctgaatcctaagctccaacaaatctgctcgaccaaagacaaacaagactagatattgtctagcaaatcttccatgcacttctcttttgaacattatatacatttggcaatagtgtggttgactgtttgcataatattttttactcccccgagtcaaaaaaaacaatattttgcactccctccattccacattaaaaaatgttttggcggtttggcctctccatccctcgtctagattcactaacatccatatgaatttagacacatatatgatatcatgtattaatctattcatactcaaacatcttataatgtgaaacaaaaggaagtactcaacaacagttgccaagaaccgaacaagtttactcaacaagccattaacgtatgcatactccccttctctcatgttggcatggatgccagggctcactcactttgcgagggtgctatccacattgttgatagcggattaatcacaccaattgtaccatgcataagcacctactgtgcccccaccccagcatgatgtgcacgttcccgatcttccgagaagttctgataaacaacgatttgggcggagtcgcgacacaaatcgatccggcttcttgaacgcgcacgctcttgagctccgcaatcacagcaccacgtctcctctggttatcacctgtgtcgaaacgcggatgacctcgccgagaaggctaatccctgtttgccaatcgaagaacactaacaagaacgagatagaatacaaccaaaattgcatatgaatgattaagctcacaagttggggtcttacaaaccgatctagcggcgaaactgttctcgacagaataatctaagcaaaacccaaaccctaaagatgacggcgactactgatatatagagtttagggtcgtgcaaccaacccttgacgcaaccctaataggttccaacacgatacacggcccaaaggcccaaatacgatgacacagcgccggaacagattatggacgtcaacttgttcggtcgattcccattgactcggaaagaatttggacgtgggaccaaaaccaatggaaatcttcttagctttccatccatataaagaacaccccaatacaagcacgtatgcgacctgggcgcccgttttagtgcagactagtcctggactccgagttgcactcgaggtcgacttggtttaggcctccaccttgacttggacgtattcgatgatattccatgactctaagtccttctccaagtgtctccttgtcccctccattgttcctaatcacaatataataattaggtagcaatctattctcaaattcatacaaagaagaacataggaacgagctcacctctgaattcaattgtcgcgcgcgagctcgtgttatcggtccttgaatgaccgttggaggattgttgtgtgtatccgaaggagtgatgtccgcaacacagcatacacgtgcactccggtcactcatttgtatgatcactatgtacggtgaaattattattgcaggtctgacccaagcaggctaggaaaaatcattctcggtgcacacaaaaatacaagtggaaactataaaaaaaacttgatcccccttgacttagctttaaataaggggccaccaaaaccttgcgctcgaatgtgggcacaaatgcaaaacccacaataaaaagtaaatgctacgaaaagtttagggacgaataatacctggttttatctccaagaaagtcattttattgcaaaagaggagtaagacaaggggaccctttatctcctcttccttttgttttgggagaagacttgttgcaatttcattaacaaggccaatcagaacaaccttatatccatgcctatcctaacactagagaatgaattcccaattgtacagtacgctaatgacacactgcttttcctgacagcatcttcaaaggaactcttttgtctaaaggctattctaaatacttcttcctcttcaacaggtttaaaaataaattttagtaagtcttgtatgattcctctgaatgtgcagccagacaaagttgagcatttatccaagatgtttggctgtttggtaggagacctacctttcacttattggggctgccaatgggtataagtagacctaaggtaattgatttcagccctcttgtggatagaattgaaacaagattgcctgctacttcttccctactctcttatggtgacagattgactatggttaattcagtgctttcttctttgccgatattttacacgtgcactctttccttgccaaaatctgtcatcctttctattaatagagcaaggaggcattgtttatggagaggttcagacataaattccagtaggaaatccttgatcctttgggatagagtttgccaacccaagtctaaagggggtttaggagtaattgatcttagacttcaaaacaatgccttgctaatgaaaaatcttcataaattttataataggcatcttgttccttgggttaaattgacatggtcctcttattatagtgataaagtcccacatgctttatctctaaaaggttctttttggtggaaagatgctctacagtttgttgatatctttagaggtcttttaaagtgcacaattggtgatggcagaacctgtttgttttggtctgatctatggaatgataagattaggcaaaggagttatcctagagctttctcttttgcaaggaaccaaaaagactcgagaaaatcccttgtatacccctgaattttaagctaatcccttctatgcctctgaattttgcttacttccttgtatacctccaaaatttaattttgatccctttcatacccctgccatcagttgaccgtctaatttctaaaaatgattattttaccctctggatgaacatagaaatttattaattatattactaaaaatgtaaaagtttgtcgcatgagactattatagttatgagtttgttgtgtgatgcattatttatcacaaaatttatttttagatatgaaataaaaaatatgtatttatttttgaaacaaagtcatcaaaaagaggagcattcctacaaacataggactaccaatgctcacaataatttttttatgaatgctcccgataaaaaaatccattatcctattaaaatttcaaatagaaattttaatttattacatttgtttttattttcaaaatttagtctcattagtttcataaaatgcacatattgtgcactcaaacaaaaatttcaatttttttcaagcttatattcaaacctaaagcatcaagggcaaaaaagacatttgcaatcaaacgtaatagtgaaatgaatgaaaatgtagcggtaggggcataaaagggatcaagttgaaatttcaggggtatataagggatcgggtaaatttcaggggcatgaaagggatagagtgagttttcagggggtacatagggaatttactcaaaagactcagttcatctgacttccttaatggacttgtcttagacttttaccctccctttgtctaaacaggcttttcaagagtatctttcaatgctttctacagataccttagatcagctgtcggatgaatttgataaatggtcttatgtttggggtaatgataagtattcatcccagaaagtttgtgctacaaatttcatgcatgtgcaggcacctgcctacttaaagtggagctggaagagtaactatactatgaaagtttaggtttttggttggctttttatgattgataggttaaacacttgggatatgcttgacaaaaagttttgtgcccttgttggaagtaatttaaattgtgtgttatgttcatctggagaaagggaaaccccttatcatcttttttcaagtgctctttcagtacagagtgttgggtgcagtttggtattgtatgggatctctctttgtcctttaaaaatatgttgaaccatgcaaatacatcttatcgatct

SEQ ID NO: 69117 - DNA, 8801 bp, Oryza sativa
gtagatcataaaattgttgtttagaccatggtctaggaaataaaccaatgcgctatcacatgtcaggagataaaacctggtggcctgcccaaggaccatatagcaaagggttttgatcccaactaaaacacttctctactattcttagacacgtcattgccatgaagtcacgtcacctctcctcagttagttgccaacatggaccttgctcccacctttctctggctcatgacgatgccggttgcttcccttattagcgtcgctagttcttcgatattttatggaacatgttaagtctatctacataagtatcaaaaaaaatgctgattgtatatagtacattatatcatctagacttggattttcttgttccctttcttgttttctttgtgttcctcagttttaaggatttacagtctacgaactcatgtaaccttttagctgtgtatatccacatgtggatatagtggtcgaattttcatccattattaaaagaatatatagtctgcaattttcttgtccgtgtgaaattatagtattgtcaaaagataaatcactaatagaaacccctggcattacattaacacatatgaaatactgcgaactaaatgaagaggtggatacaacaaatatgttaagggaaaacatagtattattgtttgactactactacggtagaggatagataacatgggtttagacacctacaatgtgagccatataaactaaaaaaacacatgctacaatggtttgacattcgcaaggttggtgtgcttcagagcgaagcctaacatgtcttaggcagttcaccaggttgtgcattattagatcctacctgagtacaacatgtataattccccttgcaaatagcttatggtccaagtgtccaacatgcttagcacgtacggcatgtctgcccccacggtcacgcttcctgtctttatcagcgtcatgaatccccgtggcctgacattccttgtcctctttcatctggattgttgttcctctagaaacatttctcctcctgctcttcctcgtagttgttcatacccacctcgtttataatgtattattggccctcgtttgattgctcaatcacgagaagaaatcgatcacacgaatgtgggagactgttccagtaattttaaggctatgatagtttaaaacctatgtgagcacaaataagatcttaagctactatactgacgtgttgtagcaaattaaattgtgagtgtttgacttcctagaacgcacttggcccgcatcttggatgctaccctttttttttttttggagaagggtacaacataggacgcacactaacacacaccacattcacaccacaacacacgcacacacacgcgtgcgcgtccctaacacacgctagaaatgagattggaggcactaggcctcagtgcacgggaaacgtgcagtcccactgaacgcgcacgcgtatgtgtaccctattacctagacgggaccaaccgaagtcagtcccgggtaaagaggggaaaaatccccccggacgagggacgagcgtcaagtttgggactcgaacgctggtcggcacggagcgagccactggctcctgccacccgcgctacgcacggtcctcgcatcttggatgctaccaacaacccttttggtcgcctggacgtgtctccgagccaggcccatggaatgcaaaacagcccacggaaacaagacgaatcgagctttgatgcttgtcctggctcgatgcacgccacgacgatgcatccgggtgtgcaaacaccacacccccgagtgcaaaagcggggatgacgggtcaacaccctcccccctcctcttctcgtcattcctcctctcctccatcttccgttggtcatcctccctctcttcgctagtcgtgctcgctctatgtgtcagacccctctattctactggctctcaccatcaccctgcactattacaaaaactctaaagggtgccggttgggaaacccccttcggtgccggtttttccaactggcaaccaggaggcggcactgatcacccaatgtcaaaggtgctggttccaaaaccggcacctttgaggtgcccatgagctaaaaaaaatcggctcaatgcatcgagccgatgcattgagccgtcaagccgatccaatatagtacccaaatcccaaaatttcctcaaattcatgaacacaaacatagtctataatcctttaaaaaacaacatatcaacatcacattcatcaagaacacacattatcaagaatcaaacacattcatcaaaaacagacattcatcaagactaaatcggatcgaggaggaggcttgccttcatcaccaccccgccaccgccggatggagaggacgagggcgccgccaccaccgttgccgctgccaaggaagctgtcgttgccacctcccgccgccgacccgccaccgccacttccccttccgccagatctggcggaggggagggcgcagccgccgggccgtcggaccaccgccgcctcccctcctgccaccgatccgccgccgtcgggccgccgaagccacctcccctcccgccagatctggcggaggagggtgtcgcccgccgccgccgcctcttctcccgccgccgcctgttgctgccgccgcgtccctcccgccacctccttggggtgccgagagagagagagaagtcatggctgagagagaggataatgtttcccctcacctcccacgcgagtggataaggccgtctctcggctcggctcgttgtcggttttctaagaaaaccgacacctttaatatattataggtgtcggttaatttgacacctataatatattataggttccggttttttttaaaaaaagatacaaaatataatagatgccagtttttatttagaaccaatacctataattatttaaagatgccatttttttatgatttcagcccgcggaggtgggaaaaagcctataggtgccggtttactaccggcacctatagtggcgactcctatttgatgttttgcagtagtgccgtctcttccacttacaatctctattgagcaaggtaaaggggccggctaatgggcgggtgatcgcccgatcaccccccatcccccctatacagtatacactactctcttccttcctcctcttcttctcaccctactacaccataaatttttaaaaaataaaaaacacaaagttgaaaaaatttatgtatagaaatactatataaaaaaattgaattcaaattcaaatttaaaacgggtatgtaaacttttgacttataaactttgggtctataaagtaatatttaaattcaaaatcaaatttgaatcgagtatgtaaacttttgacttataagctttgggtctataaactttagatgtatagaaatactataaataaaaaatatttgaattcaaattcaaatttgaatcggatatataaacttttgatttataaactttgggtctctaaattttagatgtgtaaacttaaggtgtacaaactttaggtgcataaatttactaaaataggaaagtaatacggtgccaaaaaaggaaaccacgtggaagagagggagggcgctaggggcgatcgatcgccccttagcaatctcgttaggtaaatgcatggatggttgtctgccgcccattggaaggttgggcatccaaacgtgcccatagtttgttaaatatgtgatccgaattttgggcccacaatatattcggattagtttcatagtaggagtttctattaggtgtctttcttttatccaatatatatactcttgtaagccgtacgggaaggggtgacattcccattgttattctcctacgtttgtaataaactcctctatagtgattatagtgattattgccggtcggcgcccatggttttttcccgcaagggttttccacgtaaaatttgtgtctccgttgtgcatctattttcataacatagttattatagaggagctacgtcctcctgtaggttaatctgcaggcttgactaacctacaaagatcacaacataacacatgtggattttcacccccttcggtcagagtacacaatcatgttctttgacctagaggaagacatagttgcttcatatagggaaaaaaaactgcaaaactatggtacgattgaagatgatcgatagggaaattatcttctcgttgagcatcccctttgtcgctaaacttaaatagaaaaattgggccggtgcatgggtcaggttcactaacctagttgtcttaggacttaggagtgcatccccagggggtgtgctgggtatgcaccggcatacccagaaattctgaaaaaagtttaacatgtagtttgcaaaaacttatctaaatgatggataagtgcttacatcaaagctcgagaggcctaggtggctagcaaggccccagcaaacagcaagtcaccacccagctcgtgtgcgtgtgcgtcgatacagtattacttgcctccttctcactggtggagaaaccatctttgatcggtccgctagatttcacaatagtctcggttgtattaaaaatcgggactaaaaatatctttagtcccggtttgaaagctcagaggaattttttgatcttcttttttttttgagaatctatgattcagatctgagacgatttgtgtgtgatgtgaatatgtgatgtatttgatttgtgtatgatgtgaatatgtgatgtatttgtgatgaattttgtagaagttatgatgtaatttttttaagattttgtgatgtatttagagatattgatttgagaatttggagactattctgggacgattgatttgggattttgggatgagatagagtgaatcaatatattaaaaacaatgaagaaaagaatataataaagtagcaatcggagctagcttctttagtcccagttggtactctatcttgattaaaaatgggtttttactcccggtttttttatccgggactaaagataatgatctttagtcccgtattcgtagttccggtttttcaactgggactaagggggttacgaaccgggagtaaaaactccttatccaccagtgtcttttcatgttggccgtgcggcgtgggcaaagcagcaagtgcgacggcggccggcaagtctgtcattgcccactagcccagagaagctgagcccctgcagcctgcctgcccctagccagaacggaggcatgccggccattgagtcattggcagcagcaacgaccagccaggactagcaacgagagattttggagtttgctaaaagactagttttcacctctttacaattctacttccttcaaatatgcgatctcttttctctgaatgatattaaattgaatcaatcaactattagtattaggatgaacatggatcttatttttgtctttaacatgcatggcaccaaaaaataaaataaaataaaataaaaatgcatggcaccaaacaattatgggattcacattctgtatggtgctagatacgtttcagaagccagagatgctctcggaataattgtatcacttgataaaatttactgagattaataaagcttccattatcttaaaaaagaagatacattccagaacaaaactggttttagaaaaataaaaaggaacattatcaaacaagagtactaaagggagtagaaattagtcgtaattggtgttgttttgtactccatttatagataaaaacatcatatatccctacatgaagaatttagttttcctctttagatttgcatgggcacaaccagggtaaaaaccataggtacaccattgggtatggtgttcgattgtgaagtcagcaagtatgtagtcttatcgaggagatcatcgatgtcattatgttatattaacagtatgatgaattaaaatattgaagatataactgagagtaaggtcaataatatagcttgctactggcgctaaaattgcatacgtcagctattacagccagcacaaaatagcctattcatacaacaattatttacaactttcaaccttacatggctatgcagttttcctatttttctaaagacgaaaccatcaatccgtttctctcaggagatcgcttgaacagtgaacacactagtactccaaatctccaatcgaccattgatttgcttgtagtggctgcgaaagttgtggacagcggccacccttacggcgaagcttgttctgggccgtagctgtggcgaagcgctgcaccgttgtgaggagacgaggcgaccttgcgtcgttgcgcggccgacgcaccatcgccactgtccaagctaaagagcatcggttcctatttcctcctggtttatttttatctttagagcaggtacaataatagactataagtcagctataagcttatataaaggagataagaaaggaaagagaagagaaacagactacagatatgtaacggctgtatcacacggactccaaaacgttgtgtgtgtatgacaggtgggaccaattattaatgatatagcatatatttatatttgtagttatctattgtatgaattagctaccagatcgactacagatgatttggagcgagtaattggctatacttattaaactcgacgttctgattctggctcgatgttcccgttttgagatggtcacgccgccacttctctaggggtcgcgccgcatcgacagttgaacgggcccacaaaccgcctggggtgctgctggcatcggctgcgggccggcgacaggaaagcttcaacgctcttggagcacgcgtgcagcgagtgacaatttagtcgccggctcgccatctctctcctcgcctctatgctccagtctagctttcgaacctacgtgtcttaccttgttgctagctaatccctctctatcgtactcgctctaatagtgcttcaagttgtcaatcatgaagcacatattatcacaccatctataatgaacacattggtcatgattttctatattaaaagtaacgcaagtcctggcaatcacaataacaatcacaataagtaaaagttttactttcttcgtcccaaaataactttatttttaatcttagatatacaaaacgaggtaacaaaagaatcacatataccgaaaagtagtattagtgaatggataattgaggttggtaaggggtattgatagaacaaagctcaacgatttacatatcgaagataagaaagatataaatttttagaacagacaggtaccgttatagggtcatgttactttggagaagcgctgtaaaacccgcgagtcaaatcggacgttatcgacaagcattaaggtactacagtaaactcagtaaacggcagcatatcataaacaggtgtggactgggcggcacaatcgtaaaggagtttgttattgatttgataatcacaattgaacattaatgtcattttaaactatatcgttgtattgtttggtattgataaatatatgactttggtattgataaatatatgataatatttagtttgttactaaattgatcatgcctagagaatatggcaaatattaagtctatcctaccaaaatttgacaatgctaccaatttgccagaagtttggtaattccttcttgtgctggtgcagttgccaactccttttttttcttttttgagaaccatgcagttgccaactcgaatctacagggcataagaatatgtatgtatgagcaacgaaagcatcatctatttggaagtgaaattcccagaactcaaaaactccgccgcccaaaactccacaaataggaagcaaaggtgcccatctaacaaaaagatacaccccagatcctacaatcttgtggaacaaatttcaaactcgtcgcgaaacgttccttaaaatttcggacctaactactctcctgctcattggctgtctgtaaaatcagcatcgatgacatcaccttcctcgcctcctggcttctcggatgggccagcagagccagcggcagcatcagctcctggggtaggtcctgctcctggggcaccctgctggctgtagagggcctgccccagctgcatcacttcctggttcagagcagcgagagcatccttcatcgtctgtgtcgagccacctgcaacagcgtccttgagctccgtcagcttcgcctcaaccttacccttcacatcgcctgggaccttgtcaccgagctccttcaattgtttctcagtctggtagatgacagactctgcctggttcttggtgtcgattgcgtccctcttctctttgtcctccttggcaaacttctctgcttcttcaaccatcttctccacctgaacagtttttgatggatataagtcaatataagatcctagcaggtattagtcaataagacagtgactgcgagtttgctcgagacatacctcatccttcggcaatgtgctggcaccagttatcgtaatgtcctgcttctttccagtacccttgtctacggcgctgacagaaaggatgccattggcatcgatgtcaaacttaacttcgatttgtggaacaccccgtggggcaggaggaattccatcaagccgaaagctaccaagagatttgttgtccctgacaaactctctctctccttggaggacattgatctccacgctagtctggccatcagcagcggttgagaagacctctgacttggaggtgggcaaagttgtgttccttgggataatcttggtcatcacaccacccagtgtctccaaacccagagaaagtggtgttacatcaagaagaacaatgtcgctcacatcaccagacaacactcctgcctgttgtcaaaattttgccagtcagatattctgtagtt

SEQ ID NO: 69118 - DNA, 12467 bp, Oryza sativa
attcctgcagccccttggttcaaatgagcattaattagcaaggtatgatcatatgtacctgtcaagaagatctgaacatagctcctcaaatttagccctggtaagagttgtctcgatatgcttgggcccatcagcagtagctgtaatgaagggtaaactgaaagaagcataaccaatggttagaatcaaccaagggaatcaaaggattgctacccaaaaggaaacagtccaatagcacaatgctgcagcaaatcaaggcggtcaagcaagctaacctgatatttgtttgggtcaaggatgatagctccatctttgccttctcagctgcttctgtaagacgttgcaaggcctgcttgtcttttagtaggtcaataccttcatcattcttgaagttccccgccagccaatcaacaaccctctgccaatgacaatgatttgtgagcatatacatcttgtagaacagtaagaaatgatgctaaaagatctagcagctacagaaaattataacaaatatacatgacgtaagacccttcaaattaagcaaaagatatgattaccaaatgatgaattagaatattacgattactgagtcggtccatccatttgtttcatcatatcgtacatgtttaatgaagattcaaataattcaggcatccaaaattccaccatagagaaatttattatttattcactgtccccagtttgactagagattaagaacttcaagaaaaaccatagggcatatatatgtagtactgaatttactgccaacttatcatcccctaatcacccagaattaaaggctcataaataatcaaagatttggatggaatatacttcactacgaaactaattgagtccctaaatcaattcttaacggttccgatatgtatagttcaaaacttgagtccatatcaacacattaatactactaaaaacttaattttatatattgaaaaagactgttccttgaaatctcggaaagcaaaactaaccttgtcaaagtcatcaccaccaaggtgagtgtcaccagatgtagacagcacctcaaaaacaccatcaccaacttcaagaactgaaatcatcacccaaaatatagttaggagctgaattctcatttaagagatgaaaagtgttaatttaattaacatttgacagacgaaccaaaatgaagtacacccagaaggatgaatggataaacaaagttcaatagaacagatttgatcttatcaacacaacacaatgtgaccataacggcataatgttactataataattccttcagtctggaaatgccccttttctgaggaacctaatcattctcctgtcacaaattatcacaacgtatttggaaaattgctactattgccataagatcgtagtatttgaacatacagagtcctcatagcactgagcaaaaagttgtttagaccagcattagcctttgaaaattcattacaactgtcagaactacaactgaatgtaattaaataactgaaaaaataattgtccataacagcaagaaaaaatgtttttatttttagttttttgacaaatacttcacttggttatgttatgtcaataaaaaatacactacaacagagtacgtgaaaagatgcaaatagtggttaaaacaacaataactggttaaaacttgtagttgcaaatagtgttcagaaaggcaccgtaattgtaggatagatacctgaaacatcaaatgtgcctcctcccaggtcaaaaacaagaatggtctcattgttcttcttttcaaacccatatgccaaagatgctgcagtaggctcgtttatgatgcggagaacttccaacccagcaatccggccagcatcttttgttgctgtcctttgtgagtcattgaaatatgctgggactgtgatcactgcctttgtgactttatcgttcaagaactttgatgcatcatccaccagctttctaagcacctggagaacataaaatgatcaacactcggattaaaaacaatttgaaccataaaacttattttgcaggcatacataaaacatttgcatgcacatgctatttcagtttttgccaacagatccccaaaagaaaatggcacattcgactccaccaaaattacccatctaggcctagtaattgatgaaagaacaccagtaggaaatattgtactgatgaaaacaaagcaaacatgaagggaacccacaggatttgcactataagctgtcaagctcaaagcatataagatgtctaactcagtccatatatatatatagactgcatcaaaaatccacgtgcacatatttagatatatacaaagagcaagggctgttcagtacaaatatcctactacctgcattcccttttgtgaagtgccgttttaaaaaaaaaaaaaagaattctatagttttgtgaagaatatgctaaacaaagcatacaggatgggattctatttgtgagacaccaaaaacactgttatggaagctgtgctattgttggcatcaagagaagtcaaggcgagattaagcaattaaccattaacccattattccatagagcttcatgaacagtcacgatcctataagctagaaatcaaaactggccacatctaagcaacgcaacaggattccatcttccaaagcattctttctagattctagccgtcagaacccctcaattgatgatcaattccaacacatggtaaacaatcacaaagcgtaagccacccctatacctgggcggagatctcctcggcggcgaactgcttgccaatggcgggacagtcgagcttgacgttgccgttgtcgtccctgatgacgcggtaggagacctgcttggactcctcgtcgacttcgttcatcttgcggccgatgaagcgcttgacggagaagaaggtgttctccgggttgacgaccgcctgtcgcttggcgatctgccccaccagccggtcaccggacttggtgtaggcgacgaccgacggcgtggtgcgggcgccctcggcgttggtgacgatcgtcggcttgccgccctccatggccgccaccgcggagttggtggtcccgaggtcgatcccgaccaccttctcgcacgccacccgcagcggccgccacctccggcccccgccgcgcccgtacaccgcggcggcggtgcggacggagacggacggggacggccgccgcctgccatggtgggcgaagaagggggtcgaggtggggaaggtcgtggtcgccatggccaccgagagagaccgctggtgctagctaggtcacgaaaccctaggggagggagggaggaaggagaaggtcgtggtggattcgagtggtgggttttttgagagattgggggagaaatggcgagaggttgggggaaggataaggaaggggagggagggttttatagacttcgcgtgtggccaccacactttggaggccagcctgtggcctcttctttcttcccttggatttttactatggttgtggtggtaaatcacttcagttcatatcactccagtaataatacttagattagagtaatgctacacatgttacaaataatatcaccctagttagtctatgtgaaaatgaaatgaagattcaatcacaacgtaccacatcaatttttatctgatatacttgtacatgagattttttttcttttacaagtatcatttttttttaccaataccatgttgtgacatatatttataatcagataatttaaatttagcttcaatttttatttattatgatataagataagaaaagatatttgctccggtcaataaaagtagtactccctccgtttcaaaatatttgacacagttgattttttagcacatgtttgaccgttcgtcttattaaaaaaatatgtggtcaaacacgtactgaaaagtcaacggtgtcaaacattttgaaacggagggagtatttgatgttaggacgttgtcgattagagttgaagggagtatattagaaaatgtatccacttatttattgtaagtcataaattttaatcatttggtgataaggacttttcaaacactttagtctcaaaatattacatctaagaatcatcctagtagcaacattttgagacaacatagtatctagaacttttgtaaaatttggttagtgataattagtaaatgcataccattattccatatcaatccctgccaactagtgttctcttagaggaagtttaatagtatagccaactactagctccaaatcaactatagccaacgtaatagtcaattcatacaatagttgtttactatactattaatacttggtcccacatctcatacacacatgacgtcttggagtccgtgctgtagctgactataaatctgtagcccgctgcttttctttctctttcttaagcctgctattgtacctgctctgaaccggtaaaaacctcgcagtaggctgatcctatgtttctggcccagaaattctgggtgtggccacacggttgggcagggagctgtggctggagcagtgcatccgggaggtggtggaacgttctggaatcaacgggacggggtagtagctagggagcacacgcagtaagctcgcggaggcgttgagaagaatgtgacacctgctcgcccgcgtccgcaaagcgcacggaccgtatcgccgacaggtggggccgcctctaccggcagggccttggaccaccgttgcgtggggcgggtcgctggaatcctgcggttgatgaatggccacgacgacggggcgacgtggtactatgcaagcggacgaaccagatcgcgtggcttggatgaaggtacccatcggttggcaataagccgtactataaaatcagcgcgccgactgatttatggtctgtcaccatggtgagcttctctgtatgtccataatctttcctgtttattcagaattagttttatgccaatgaaatttgtaacaaaaaaattcacacattgtgatcccttaattagtgatttcaatccttccctcgtcacttacagtcttaatgaacacctaaaataggtaatattgtatagtggcttaaaaatttataactccaactgtgggatctgtctgataactaaaaaaatattgtcctagactccatgatgtaaaatttgctaggttaaattagaccagattttgtttttagaattgcatgtaacattttattttttaaaattattcttaccttaatttttcctatgaatttactttttgccatcttctcgagagtgctcaaatgccactctcccaaaatttcattcccaaatgccacccggacctacacgtcggcctcacacatcacctggtcccatgttacttttgtttgaatgagaaaagaggctgacatgtgggcccggataacattttagcaaaaagtaaattctccctctaatatttagtctgcattaattttgcttgtaaaatttccttgatggctaacattgatctcttttttttccttgttattttcctcctcttacatgcagcagcaggtgttgcccggccagtagggcacccaaggcccagcacgcgcgcctgacgacattcgtccgctcgtcgcgcgtcctttccttccagccggtagcgcacgtcctcgcacatgggccaatcggcccaacctcactgggagcaggcccaactcggacgcgcgtacgcgagaaatcgggaaggcacgagtagaaagaaaataatcagagcagaatcagagatcgcacgggggacacgtggctaattttcaggggagctaatcctcccagggagccacgtggccgaatcatatgcctgatttttatccctaaaatcggtttagataagattagcgaaaagataatttaaaatcagaacttttatatatgtgtccaactgtccataacaacttaaaagtaaatactaaaacgaaactacgttaaaaatactttaaaatctggcaacggcttattatttatagagaaatgatgaggcccgaaaacagtgtcggaaattcctgctaatcgagcatcatttttataaaaagtacctctctcactgtttcaatctaaaaagttcttttacaattgtatacacatacataaagtattaaatataggttaaataaataactaattgcatatattgcgactaatttgcgagacgaattttgtaagcctaattgctcaatgatttaacaatgtggtgctacaataaacatttgctaatgacgaattagttaggcttaataaattcatctcgcggtttactgatggattctgtaattagttttttattagtgcctgaacaccctatgcgacaccctatataatacccgatgtgacacgccgaaactttacgatccttgttgacaccctctaaatgcatcatgtgagtacttcgcttctgatgaaggggtgcaagatgagcaggagaatgattttagtgtagtatctacaacctttgttgttcatccctattcctaggttcatttgtttctttagaggatcattctatttgcaaaagaattgatgatattacataatgaaagtttcttgtaattcttttcatttgcgtatttctatgggtaagatcatgtattatggggcaaccatcacatgaatataaaacaaaggatggtatttcatgaaaaaaaaggtaggatgacgtgatcacggctactatgtataaaaccattgctcacatcatatatcatcaaggaaggtgtcgtttagcgcaacacaggggagtaacgcacgattaggagtcacacattgataagaaaaagcaaatgctgaaaaataaattataataaaaaaaagcaaattagatattaggctttttttttaccaaactttgaaagtggactagggctaacataagatttttgcaatttggcaaagttctacaatctgagcccctccacgcaggcacaccgttgatcttctcctctaagcggttactccctccggttctatattaattgatgttttggataaggttgaggtcaaacttttataacttagactattaataactttaaaaatatttagtttaaaggaactagaacaacatatatagatttgtcttttaaagtactataataaaaataaacatgcatttatttattatatatattataacagaaaaaaaagatcaaagatgtatcttgtagaccgtgtcattgtctaaaacgtcaattaaaatgaaaccggagggagtacacgcaatctggtcactgccaaggcaccactactgtcctcgaaggtatccataccagcccagggacgcatatcataggattatggtccaaactgcattgcatagtgcaatctgcgcttcttcttgttgtttccctcattatctagagcgccgagattagggccagtgttgccaacttgggagcggcatcttctattaattgttgtttctcttatcatccgcgatacccatgaggagaattagaaaattattaacggagtttaggttaactgacgattcacattaagcttgatcaacagcactccacaaaaatgcaaaggccatatgttagaggacaagtcacgtcatggcaataatcaggacaccataggaagagattagctctcaatgtgagccaccggtccaacttaaagacttttatagtacaaaacctgaaaacattgtctacggagtagtgcattgcaatgggaaaactaatgttatgataataatatatgttatgataataatctatctattaacttagtaaagtaatagaaaaatgagcattcttatggtttagaaattattatcatattaattggagtaaaataaaaaaataaggagaattcattgtagacaaggactctttcattttctttttttctaaaaaaaacaaatacgttatatatgtgtagtgtccaatcggacagctgcataaaacaaatcttttgcaaggaaaaaaaacctaagctggatagattaatctctctatacaaattaatacaaagtattgctattttttaatttttgttgaataaaatttagaaaaagaaatgaaatttggaattaagaaaagaaatattgaaatatgagtagttcatatagaaataaaatttataaaataacaaaaattataaaataaattatatttgatgaggattctagaatattctcccaaagaggttagagtgcatataggaatacaatttagaaaaagacttcaaattcaaataaaaaaataatattgaaatgagagtttagagtttgtatagaaatacaattagaagtaatgtaaataaatcgatatcatgaaaaacgtatagccaaatttcttattggttcaatttagctagaattaaattaataagcagtcataaacgattaaaataatactaatgctatttctgaaaatacaaaaatacttaaaatcactgagagagaaaaaatgattttagccttgcccaaatatatgtccctcttctgtgctacgtatgtgcggtccatgaggcggcccaatggcgacttggcctaggaatgacgcccgacccaacacggcagaagccagggtcgtccgatctgatgaacggtcccgattgatcctgacctaaatgaatatccaacagcttaaaccctaaccttaaaatcatttcccccatacccttgctctctctctcgaaaagcaacggcgacggctgtgatgattccagcgggcggcaacggtagcgcccttccccaccgagcagatccggctacgacggcggcgttagcgtcctcccgcggcttcccacaagcggatcaggaggcgatgggggcaccctccccattttcccacgggcagatctggcggcgacggtggcttcccgtgggtggatccggcggtgacgaagattgagataagattgtgcggtttttattattttttctagttttttttctctttctttggattgtctgattggatttcgatctgacttatggacaaaaaattgatgttacggacaaaaaattgatgtgacaaactgaaagttacaatttttttaagtaaccacacgtgcaatttagtttcaaaatactctaaaaatcattagggagtacctatgcatctttcgaaagatttttatgatcgtatcacacagatttttaatatttggattaaaatctgatagacacagtaaaaggtaaaaagcaactaagaaacaccataatggacactaaattatcctatcttcaagaaaaagtccaaatccaatacaaatttcgaaacttacatgtgaagattcaaaaattacacagtaacaaagttacaatgtaagtttcataaattacactgcaacttacaagaaaatgcactgtaaatttgagtgagaaaatcgagtgagagataagaaaaaaatcttttgagtgagatatagcaaaatcgaaatcacaatgatttaagctaggaaaaagtacaccgaaggtccctcaacttaacatcgggataaaaaacatcctcgaaccgcaaaaccagataccacggatcccttaaatatacaaaccggtcacaataggtccctcagtggttttgatctcggttttgtcctacgtggctgctgagtcagcgtgggacccacgtgggccccacatgtcatcgtgccacatcagcctactctctattttcccctcttctcatctctctcactctctcttctcagggcggcgggggaaggagcggaggccactggcgagggtggcgtagactagccgacgttagggggaggaggccagtggggcgcggtcccgcgccaccgcccgccacgtgctccgtgaggtgggccgcgacgacgtcgtcgtcgtcgacggccgcgccgtctctgcccagttcgccatggctggcgtagacccgggcactgcgacggtgcaggaaggcgagtgtatgtgaggaggccggtggggcgaggcgggaccggcgtcaacggggcgaagcggcgggtgtgccggagacccagtaggaccagattcgggcgctcaagcgcttcaatgtcggcgaggactagcccgtcttcgacggcctctacagcttctgccagacctacgccggcggctccatcgacggtgccatcaaagctcaaccacggccacgacatcgccatcaacaccctcgagctcgcctgcgcggcgacaccctccccttctccaacggcgctgcccccgccgacgccgacgtcctcctctttctcccacctcctgggcctctctgaccctaagacggtggggcaggggagagggcgagaaccgcggcgacggcctcccgcgcccaccctcacccgccgccacccagctcctctcctggtaaccatgccgcccgcgccaagctccatgtcgccggctgcgcactactctgcccccgatggccgcaccctgctcctcccccgacggtcgcgctcagctcctcccccggcgacggtggcggcgtgggaggacggcagtgagaggccgtgcggcaccggcaatcggtgtccaacggtctcgccgagggcttctgcctcatcgccctcctcgagttcctctactaggaggcccccgacgccatgcgcagcctcacctccgcctacgccgccctcgccgatggcctcggctgcttcttcgccggtggcctacgccgcccttgctggtggcctccgctccttccccctccgtcctgagaagatagagtgagagagatgagaagaggggaaaagagagagtatgctgacgtggcacgatgacatgtggggcccacgtgggtcccacgctgactcagcagctacgtaggacaaaaccgggatcaaaaccgccaagagacctattctgaccggttttgtatagttaagggaccctcggtatctggttttacggttcgaggacgttcttgtatcccgatttcaagttgagggaccttcggtgtacgttttcctttaagctacgatgggaggccggaggcccagttaattaagcacaacttggcatgggccagggcccgtttagcccaacacagaacatggataaatacaccacccattcgccaaagagcaaggtaggcaaggcacgcgagccctagccgccagccgactcgaccagcgcccggaggcggagcacccgccgccgccgccctcgccatcgtcggcttcacccctcatcggcaacctagtgcaggtgagctccatctccacccctcctcatctcctctcctccccacaccatctttcctagtctccctctgttgcttcctcggatctgcttcgctctcgtgctctacgcctcacacgacgcgctcttcctcgtcgccaccaactttgttgctgcgcgcgcgtacgtcggtgcgctgtgcgcgttctacttagtttgccttgtgatgctgctcttagtcgggttagtgcttcgtgctgtgctcgctggtttggcgcttcagatctgtgtgctgtttgctctcggagacgctagatccatagtcgtcgacttgcaaatgctgcgagctaatatgattcttgttggatttcttcgctcctagcgtgagaaatccgaagaattgggagaacacggtctttttttttgtcccaataaattggttggattgttctagtatatattttttattatttttttctcccaaattgttggaatggcttctccctctttcccaactggttggattccaaattgttggaatggcttctccctctttcccaactggttggattgaggtgaagcgtgcttactgtattttttccacctggatttggtactatctttactctctgaactagttgggaacggatattccaatctcctgtctcttcgtgtgacttctttctgcttccacgtggggttctggaatcttcaattcactgtagtataagttcatatcttatttattctcatagactatgatttggtcgacttcgctcatatattgccgtgtagtagagggtttttacaattattcacgttcttggattgctgagatatcatggttagttgtgctgtttgaactggttatggccctcccgctgtgaattgccaaggtgtctgaatgttggtgattttgtggatagttcacgtgttggacaaagaatgcattataggagtgacaaatatgactggtttttgcaaaaccggtatatattgtggttatgttccttggagttacaaataacttgcagtaatgtttgaactgtgggatggttatgacatacatcttatattgggtcgtgtgtgaactgtttgttcatctggatgatgcataattcacacgagttggatgaaaggttctacctgaaatggaagaatatgtttggtttctgtaatttcgttgatttgttggttacatctctttgttgtatattttatctttttaggtgatgtagctatatctgtttccttttatatgacaagacgttgtgtgaaagagggttccagatttatttagattttacgttgtcattgtggtcttgtggtaattgatattcattgtttgttcagattattttaattgagtat

SEQ ID NO: 69119 - DNA, 11874 bp, Oryza sativa
  unsure (1)..(11874): unsure at all n locations
ataacttacattatgaaacggaggaagtagtaattaactacctttgtacttattttgaatattctacttgttcgttctaactatttgtcagtagagcattctaacgttttacagcttggcaaatttttgcatgtcattatcgtatccagttttccacctaactgaaatccatgtcctgaaattgctttttcataggttgttttctgaagatggctgacgatttgggccctcccactgtgctccagaagatacatgggcagtccatgatgttcagcaagatctcaccttattctttgatgaagaatcccgcactctacaatgccaacacttcttacagtgtgcctctgaagtcatacaatgggatggatgggaacaatgggttctcatctgtcacatctgtatccccagtctttgcttctgccccaaaggagaaaggtctttctgggtttatgattgacttcatgatgggtggagtttcagctgctgtctccaagactgctgctgctcccattgagcgaatcaagcttctcattcaaaaccaggatgaaatgatcaagagtggtaggctctctcacccatacaaaggtattgcggactgctttggccgcacaattaaggatgaaggtgtgattgcactgtggagagggaacactgctaatgtcatccgttactttcctacccaggtactgcatcctactgtctgttttttatttattctccccttggatgttgacttatattgtacatttgcttaggccttgaactttgccttcaaagaccatttcaagcgcatgttcaactttaagaaggacaaggatggttactggaagtggtttgctggaaacctggcttctggaggagctgctggtgcttgctctctcttctttgtgtattctctggattatgctcgtactcgtctggctaatgatgccaaggctgcaaagaagggtggtgggaggcaattcaatggacttgttgatgtttaccgcaagacccttgcgtctgatggtattgctggtctgtaccgtggattcaacatctcctgtgttggtatcattgtctatcgtgggctgtactttggaatgtatgattctctcaagccagtcgttcttgttggcaaccttcaggttagtgaagtgaatgcaatctttgttcatcttctggcaattttttatttattccataaggttgctccactaaaatacctcgcgctcaaatattttgcctttctcattgcttcatttgttttggtttagttgaatctactcaatgtctctatactcctgctggttgttatatttacttctgataatatgtgatatatgttattttcaggataacttccttgccagcttcttacttggttggggcattaccattggtgctggccctgcttcatacccaatcgacactgttcgtcgtcggatgatgatgacatctggtgaggctgtcaagtacaacagctccttggatgcgttcaagcagattgttgcgaaggagggtgcgaagtcactcttcaagggcgctggtgctaacattctgcgtgctgttgctggtgctggtgtgcttgctggatatgacaagctgcaggtggtcgtctttggtaagaagtacggttctggtggtggctaagactagatgatgatgataagcagtggggaactatggacatattaggtgctttcggatgctgttgcgtttaaataaatttaacgtatggacaccgtttacatgttattaggcgtcaggtgaggtttctgagtgtgtaaatcggtggcagatgcttatgccttttttgttgggggatcgagcaagacgagttttcctagttgaaaacatgccaaattattgtctgtgaaagcgtttcttgagattgttattgatgtggttcctagtcgattatatagattatcactccattgtagcatcttcgggattttgtcttatctaaccacatatgcaaaaaaaaaagaaaaaaaacccttgttatcttattatgtgagaggtaggacttagaagctgttcaggatattttttgtggtttgcaagctgactttctgaggacataacattccttgagaaaatttaatttgtgtagataacacaagcacgcaaacatccgcggggctgcgctgacatgccggagtagtaataaatgaaacagaaataaaactcctcaaggacttgtttggttaatccttgtgaggaagggattggaaagccttgtttagttaatccctatgaggtagggattggagcaaatttattccacatctattgtggtgtgaaattattaaatgaaagagaaataaaactcctctaggccttgtttggttaatccctgtgaggaaaggattggaaggccttgtttggttaatccctatgagggagggattggaggaaatttattccacatctattgtggtgtgaaattattctcccttaatcccctcccatcttcttcaatccactctaaaacgaacaaggctctctaaaccgaaccaggctttaagaattcatcctcgtgttgacatggcggagtagtaaatcaaactccttaattcgtctttgcgaagatgggaattttggggatctgtactccttaagaatgtcagagtgaatttgttttgtactcagtaatgtaggaattttaagcctcctttgacctttgggaagaggtcttgtacgatttgaataataatatgggaaaatttcttgttgagcgaacaaagtagaatttcttgttgagagcgaacaaaggagtgagactaagagaattctacaaaattcttttagaatgacaaaaacatgggtttttagaaacatgattcctacattttttatacaatttttcatacatagttttttgaaactaaaccgacaggagaactgtcaattatatttcaattaagcaggagtaaaaacacagacagggttacagaaaagaaaaaaaacaaccacttggcgagtaaactcgccaagtacctcaaccgtggccggtacaaatcacacagcacacggagcaccacacaacttctagccaaactaccacggcgaaatccaaagacaaacatcgacgctgagatgctgaagaagtggcacacgactttgacatcacaaggcgcatgtcatcgttgccgagcttgccgcccagcgaccaagcagcttcgacttcacggcgatcgcaacatcatacaaactttttctgtgtaaaactttttctgtgtatcgattttctagtttacgcatgtattcctattaaaatcatatccttcacgcgtttcaaatcaaagtagccctaagaatagtactccttgtgaaggaaattttacaaaatttgttgaactcttgcaagcaaatcactttgtagtttgtacgatccgattccaaccccaaaggcagattggtcagcatcaaatatggcaggctgataatggtaatggcacctacatcaccaacaaagaactgcgaactgcattgacggccacatcaatgggagaacatttctacgcgcatgatccgtcacaatcttacaacaaggcggccgaaaattccataattactactcccttccctctgttccaaaataccaaaatataagtatttttagctataaatttgaataactatatatctagatttatagccaaaagttattatattttaaaacggggataatatagtagtaatgaataatgatggctagtaagtttttgcactccttcactctgacaggctcttttttctctctcataaatatagtagagctaggcttcatttcgttaagaataagcataaaatcccatttccaaaggagggttcacattcatttcattaagaggaaacataaaaacccatttccaaacgagggttcacaacccttacgcgtactcctaccccaaaataaaacaacaaaacatcataagatgacggaggtagtgctcgtaagatgcatcacataaagatgacacacaaccaatttgataagcactaatccacaaaacatcatctttgccacacaaagagtggcagaacattgaagccaaaaacctgtccatgactacagcaaaatgttgcccacaattgctagtagtaagcaagaatagaatacaacaccaagcaggcataaaacagacaaaagtcccagcaacgggcattaacaccgactgtagcagcacatgcagctgtagtaaatatttttcaggtgatcgcagggaggaccggaggaatagtctggtaggtcaacttattctggaccaagatgtctggaatttatacagttgggcatcaatttggaatcttggttcacagggatggtttataccatcttgccacaaccagaacactgaatttgcatgctatccatcatgtacagaaaaactaagcaatcctagtgtttggattgaactgttattaagaaattcgccatctgcttaagcggctgtttgggaaacagggacttatcacatcggatgtttggacattaatttagagtattaaacatagactaattacaaaacccattccataactttggactaattcgcgagacgaatcttttgagcctaattacgccatgatttgacaatgtgatgctacagtaaacttttcataattatggattaatggcttaaaaaattcgtctagtgaattagctctcatttatgaaattagtttttttattagtctatgtttaatactctaaattagcgtttaaacatccgatgtgacagggactaaaaagtgaaaacatcaaatcatgaacaaattgtggcagacaacattaatactgaagggaaccatcactccaaagaaccatctattggtaatcatcaagtgaggtatatgtagcagtacagtattttttttttatctaaatgctaaagggaaccatcactccaaagaactcgccatcaaggagtgattagtgttcttagctgaatgatcaacaagtaaaatcccaatgcatgcgacagaatgcccattggactattccctactaagtactaattaattagacttgagatttctgacctgaatgaaagaattatgtcatatagagaattctccacaaatgccatccaaaatatccatcatcgtcatctgaatcatctgatcatcagtgcaatttcgatagattatgctacagcatggttgcttgatacacctacgtgcttttcttcgtcatgctctgcttccgttctctgaagagctccttccagaggttccaaatccacaggttgctgaccgtgatggcggtgccgacgacgacgatccaagaaatgcgcacccaccacgggatgacgtcgacggcctggccggacaggtagaagaggctcatcttgaggaagaagagcgggccggcgacgcccctgacgacggtgtagatgaagtagaagggcggcgacagcgccctgtacaccctcgccgcggcgggcttctcggcgcgccagatcccggcgagcgtccagacgttctggaggaggctggtgacctcggcgaggacgaggaggacgaggagcgcgtaggcgccgtggcggacgaggtaacggcaggtgacgaacacgaagagcgtggcgacgtggtgggcgatgaagagggtgtccccggggaggaaggcgaggtagtggagcaggtccatggtgaagtaggcgacgctgtagtcgaggacgtggtcctggaggcgggtgttgggcgcggcgaaccccctcgcctccggcggcagcgcgaggatggcgcccgccgcggcgagcgcggcgggcgtgccgtgcgcgagggagatgaggcagctggcgccgtcgaggcggagcggccacgcccaccgccggagcagggcgagttggccgacgcagtagatggcggcgtacatggccaggaaccccgggtacagccaccgctcctcggcggccaaagaatccagcacccccaccaccgccatggccggaccaagattcgcgccgacggagcgagggatcccgccgctcctggccggtctgcctccgattcgggcccaaccccccgcgtgcgcgcgaggcggaggcgaggggattcgatcgacgccggtagggtttcggcggcggcggcggcggcggcggcggcggcggcggagggatggatggctgtggagcagtgtgaagggatggacggccgcgtggatggtggggaacgaaaagggggagattttaaagcgattggttttggtttgtttttttttcttttcttttttcgatatttgtttacgtgggttttggtttggtttttccaaattaaattcaaattaattttgggttgagtgattaggtagaggattatagagggtttgcgtgttaaattggggttttggaaggaaggtcagtcttccgggtgttgtttgaattgaagattatattatggttgagacttgggtgccatgaaatttcttctcggttaactatcattacaatattttgctgagttggcacgagttttcatatcaaagttatatttttagcagttttatgaactgaaaataaaaaaaaatgtttggactttgtaatgagaggcacaatgccgacatggaaaaacaagtaaaattttgtcagtgaatcactcgaaacgaacgaacaaggtatataaatttatactcatcgatcagagtatcttatagtatatatactctttccgtgttttaacatatgtgccgttgattttatgagatatgtttaaccatttgttttattaaaaaaatatcatttattttattgtgactttatttattatcaaatgttctttaagtaagacttttcaatgtatacaagaaatttgaaataagataaatgatccaacatttattaaaagttaataatattatatattaaaaaacgaagatagtattgtaaatggctccttttgttttatactaatatggctgaatagctaaataaactatacttgtctaaaaagcgttaaataaactatatccccttcatcctcaaatataattattactaactatgtattttgataaaggtatgtctaaatgtgtagctaaaattgactatattttgagatagagacagtaaaaattattcgagagtagtataaacaaatgaattaaatattcgagggtaatattatttgggatggagtataaaataaaaaataaatctaacatagttttatcaaaaaatcatatataaaagttttccgtaaatcactctgtttataaacttgggaagcatggacatatatcaaatcatttcattaaacataatttctaaatatttagtcatttttcctccttacattaaagaaaggcatatacatccacgacacaagcttaacaaatgtatggatggatcatggaatatttggttacggagtaattaggtccggaagagcacacgctctatttcgaaacggctacttagatcacgtttcatgaaatgctaaatgcttgtttcatgcaaaagattttagttatatagaagttccattaaaaataaataaatctttttttaaaatataatacttaatactcgattaattatgcataaatggttgtctcattcagtgtgcccttaaaatttcaagctaaatagagctccaaatgaagccttaaaacacgagatttttttttctttacagcttgaaagtttgtcctcgcaaaaaggaaatagaaacattcagaataccgtctaaaggagaatcgcatactccatattgggttgattgggttggttccttaaacacggaagcaagctttgggctgtgtttaaatcaaaagtttggatcgaaacttccaattttttccatcacatcaacatgtcatacgcacacaatttttcagtcacatcatctttaatttcaaccaaaatctaaactttaggctaatctaaacataaccttggtcacgtagtatgcgtaaatgtgtcgatatctttttctggatcatgtgacagatcatggtattggcgaatattccacgcaatttggtatcatgataccttgtagtagtagatcgcgtgggggcgtgtgtgttgctaaagaatgtgattcttgtggcacactgctagctctacttgcgatttctatacactaacactaggctgctcctgtctttttcagccttcagaagcgaataaaattatcatcgctaaagtatataaaggtgataataaatgtatatatgttgtcataagagcaagtttaatagtatagccaactactggctccaattcatctatagctaatctaatagctcattcatacaatagttacatactacactattaatacctggtcccacctgtcatacacactgtgtcttggagtccgtgctacagctgtctataaatctgtagcccgctgctttcctctctcctcatttatcttcttaaaatatgtttgcagctggtttatagcctgttattgtacttgctttaatgctctaatgatgggcgatggcggcacggaatgtaagacggattaggacaagtttaacgaaattcgacggagactaatccgtggctaattgtttattgcacagacatgatttttcctcnnnnnnnnnnnnnnnnnnnnnnnnnnctccaaactacacgtttgttccaatcttgtttacgaaactgcacctgtttgttgcaaagtttagttttctaaaacaatctgcaacaagtgtacttttgtgtttatataagggaagtgaaaagtgtacttttatgaaaccttagtacctgctcgctcttcacgatattcccgtacaggtgccgttaaatttacttgcataacgatattcccgtacaggtgccgttaaattcatttgcgtaatactagcaggcaaagtgttaattacaaactagcaatacaatactccctccatactgtaggacgccgttgactttttaacgttgataaaaaatcaacggcgtcatacattaaaatacacagggagcagtagttttcttagaccgatcactaggtgaaggtttcttcatctgaattgattataagtagggaggataatacaaggttcattgatttacaatggagcataaaggggagatgaaatttcttcacagggtgtaactacaatcctgcaatcgtatttcagatgctcagcttagagccgcatagcatcatctacacattttgttataaacctagcgagggaccgcaggtatgattccacaacctccaaaagcaaagaaggtagaaaaactggaagtgcttgaacggcagttggctgggaggctgcaagctggtttgatctctcatggaggagatgttcagttgcaacggtagttgattcagttaatgagaatacttacataatttgaagctatgatctacgaagaaggaatttgattcagtaatttgaagcgtagtagcaattggcagcagagttgaaaaaacatccagtcatcctatagaggttgactgctcctcaatgtcctccctcttattgtcatcgatgacggaaagctaacaagatgaacaaatatgctgaatctgcttcctgacgtgcatgctcggaaggtgtgaaatatgcctactattagtatcaactatcttcaaccacaacggactgaggtgcatgcttagaaatcatctcttattgtttggattgggtacccatgcgttgcaacggaaaaaaaatcaatttaagatcacatgttttaatcactcacgatcccatgtgactaaaatttgagccaatgccataaaagcgatcatctcttactgtttggattgggtgccaatgcgttgcaacgggaaaaaaaaatcaatttaagatcacatgttttaatcactcactatcccatgtgactaaaatttgagccaatgccatgaaagcgaagtaataagtagataatttgcttaataaaaaaaataccccctccgtattttaatgtacgacgctgttgactttttgactaacgtttgactcttcgtcttattaaaaaaattatgtaattatcatttattttattgacttgatttatcatcaaatgttctttaagcatgacataaatatttttatatttgcacaaaaattttaaataaaacgaatgatcaaatgttggtcaaaaatcaacgacggagggagtacttgaaaaaggaagtttaagcatgaaatatatgtatcttggtttatagctgaacaatattactaatgttttattttgaagtacacataccgttaccaatactattttttttttgcgaggaacgttaacaatagtatgaatacatgatcaccgagttcctaaatttttttgaagtacacataacgtaacgttagatcccactccgaacagtcaatgattatatgtatcaaatatacaacgtaacaatcatccggccatcataaaagctcatggtatattaaaaaaataaaaatcatctcaagagactgtatgctacatattaaatctaatgatagaagcttaatttggacaaaaaatcaacaaggcttaaagaacattaaaaaatcatgcttaaagaacatttgataataaataaagatccaaaaaatcaacaaggcttaaaaatttaaaaatacaaccagctactaatttgtacaatttaatattccaagatgacatcttatatgtccaactaatagaaaaaaccatgactacagacatcatgataacagcttacatcttataggtcaacatacaggaatgatggaatttattgacaatgaaatgccattaggaacatgttagttggacagtaacactggatatttcagcaacataaggacagctacacagactgaaatagattctacatgtgtgtacatatatgaccatataatattcatatttggtgaaatcactctgcaaatctaatcatgcacacatagtgtattaatcttatttttctcaactaatactaatcgaattagttataacaataattgaaaaaaaaagaatgtgataaatgcatgccggatctatcatgtttaactgcatgtgataaaccattgtgtacggtaaatgaaatatgaaataagtttgactgatattccactaggtaatgatttcaacagttaatataaaaattgcaaagataattagttagtacacaatattctttgtgcacactagatatacctcgtctatgctatgaggacatccttgtacacaatattctttgtgcacgttgtagtatgtttggaccgtttgtttttcttcctctctttgtcctgcatgagagaatcttgatgtttgttcctgaagttgctctagacaacgtgacgtagagctgaccatgagagaacaccggctccgggaggtagacgcctgcatttggaattgtttgtccttatgccttattgatcgtcaattcgaaacatagtctaattggaaacaactttctcttaaagtgaaacgggaacatttcatcatctaaaaggcatagaggtatccgaggaaggaaaactcccttaccagcatgctgccctaccacaatctccacgttaatagcatttcttccgaacccatgaaccactagtggccttgtcccgtttcaaagtccgttggctgggtcaatgttcctcaatagcatgatgggtagtttaacttcagctttagcacatgcggaggtagcccgtttggagttagagagttcaagaattcgggcaggtaatagctatgagggtcatcctctgctcggtaaaaaactatgatatgtcatcatctctcctcgaaatcgctcgatcattttcatgtttattcgatccatgaactcattctgagtggacattatggccctagatgtgatgtagtttgggtccgtaaggttatcatttaggttggggaacacggtatcagcccatcgaggtccgagtcattccctttgcatgtcacacaaatatccgaaggc

SEQ ID NO: 69120 - DNA, 2927 bp, Oryza sativa
tccgtgcaggacaaagagaaggagaaaaaaaatggtcagctctacatcgcgttgtctagagcaaccgtctaaaacaaacatcaagattctcaccgtgcaggacaaagaggaaaaaaaacaaacggtctaaacagactgcaacatgcacaaagaatattatgtacaaggaggtcctcacaacatagacgaggtatatctaatgtgcacaaagaatattgtgtactaactaattatctttgcaatttttatattaactattgaacacatttgatatttcagttgaaatcattacctactggaatatcagtcaaacttatttcatatttcatttgccgtacacaatggtttatcacatgcagttaaacatgatagatctggctatcacactcctttttttttcaattattgttataactaattcgatcagtattaattgagaaaataagattaatatactatttgcctcacttgcatgatcagatttgcagagtgatttcaccaaatatgaatatattgatatgttcatatatgtacacatatgtagaatttatttcagtttgtgtagcttcccttatgttgctaaaatatccagcgtaattgtccaactaacatgttcctgatggtatttcattgtcaataaattaaatccttcctgtatgttgaccaataagatgtaagattgttatcatcatgtctgtagtttttttgttagttggacatataagtcatctcggcatattaaattgtccaaagtagtagctggttgtatttttaaatttgtaagccatgttgatttttttccaaattaatagcaagttgcttctttgatttgtaacccaggttagttctttatttagaaagagttaacatctattacaatagtatgttgacgaatatgctaagagaatacagttttcattctgcaggttttactccttttgataacttaaagcatgtggtgaaggcaaacacgtgaattcgtggcagaaatttttgtatggaaatttaacattgatcagaacaatttgtatgcaaattatgcatcacaaattggcatatatttgatacatatcttcaatgtaccgtattttatcatttaaattaagcttctatcattggatttaaaatgtagcatacagtctatcgagatgattttcattttttttaatatatcgtgagtttttatgatggctagatgattgttacgtcgtatatttgatacaaataatcattgactggtcggattcgaattcacctaacgttatgtgtacttcaaaaaacaattaggaacttgttgttcatgtattcgtactattgtccagctataaaagaagatacatatatttcatgcttaaactttcttttcaagtatttttttattaagcaaattatctacttattacttcccttttatggcattggctcaaattttagtcacatgggatcgtgagtgattaaaacatgtgatcttaaattgatatatatttttttcaagttgcaacgcacgggcacccaactagttcacatcattttatcaattttaggtcatgttctccaagcaattacacaatattttagtgcttctatcccgttagaatggctgactcaattaaaggaacaacaaagaaatgtgtcattagaattttttagaaacaaaaaggtctgcattgttcacatcagtatttttgtttaaaaaaaaaaaaggtctgcatttgtaaactaatgatttttcaaccttcatcttgcatctaaaaatattgatcagccataaaaaaaagacattcgtgaaccagggaatagtgtgaacacatatattatagcaatcaagagttgagaagttaagattctcacctagagatagtagcatgtgagttcacaagatctgaataactggagctgcaatccttaaagcatcaatctgtgaacagaaaaaagcaaaagaagatttcgtgaggtgaaagcatgtgggtttgcaacagttgaaactcgaataaaaagaacaattctcaccggacactatgcacctgggtcagcttcctgtcagccagcttgtaaactctgaaactcgaatcagaagaaatttattgtttgcatatacttgtggtcatcgcaacgcgagatggaggggattatctgaaataccagatgtaggggattaccaaatggttccaaacttaactttgctttttttacatacaggtgatttttacatataggtgattatctgaaataccagttgtcatgggcgttgggccggctaaggcccatcggcagcccatgacaccagttgtgcagacaaatgagtgataacaatctgaatctctccagtagagaacataaagcgaatcaaggttgttcttgttcatgatttttgattatattcaaaaccgtatgatcaacttagtaggaaagaaaatcagcagattttatacgtgttgtgcctatttacaacctgaaacttatactaatgtatgtgatggcatgagctccctaacatggctagtatgtatatatctgctgttattatgaagagaaaacatggcagcatatgcagtcagcagaacttaccaagaagtgtattatactggagaggtagatggcatgatgctgaacttgaacagccttaagagagattgaattgaggaaaattaagagatgatcgaagtgtagcctgaaaaggaaaagcagagtgagaaaggttatccaatttctctgcagatattcattaaaaatatattgcagcgatcctttttaatatatcagactacccaacatacataatcttgattttagctgctataattaaaatcattgaataaacatgagaaattatggttaatagtgaacagtggggatttagtcaacacagtggatttctaaactcgaaagccattatgaatctctatgaatgaatgaaccataccctg

SEQ ID NO: 69121 - DNA, 2012 bp, Oryza sativa
  unsure (1)..(2012): unsure at all n locations
catttaattcatacatagtaaaacatcaagtacactaagtgaacacttttttcggtggaacaaaaacaaattganttctcttaataggaggtttccaaaatatgtggtttttttgttgcactggaatatttcgttcactgcaatattagatctatatatagtaaaacattgtgagtacactaagtgaaacatttttggtggaacaaaaaataaaccaaatttccttaatagagagtttctaaaatatgtgggttttttgttgcaaaagagtattttaattcactgcaacattagatttataaatagtaaaacattgtaagtacattaggtgaaacatatatttggtgaaaacaaaaggagggagaagtaggtgggcccacgtggggggaggggcgcacggggagtgcctgatccggctctcccgcgccggtcgcgcgacgtagagattttcgaaagaaaggcgatccagacgttggatttcgcaatcgatccaacggttcatactccgcgggtctgcctggcgaaggatttttaatactactagagattatgccaagaccacctatacttgtttgtatatatataaagaaaaaagacgccctgaacatcaagtgcagcccatcaaaaagaaagagttgtacgcatgcctaaaccacctatacttatttgcttggttttctttataaatttgtcatactatcaagagaggtgataatcttggcaaacatataagagcagctctagcctgcacctaaaatcgatttcaacgtaaaaagaaccgaactatgcacactgtgggaagcgaactgcatgtgtcagatgaaaaagcaactccaaaacaaaagtcgaacactgatgataaaaaattgcttgttgctataggtgggattaagattttttttatgggtcccacccaaaatcgattttaacgttgtaggggtcgaatcgaatgtttatttgacttttgtggactagacttttgtgttcgcaagtgcaggatgggaacacatccctcctgcacgtaaaacggagcgtccttttaacatatgattaattaagtattggctatttgtttttcaaaaatggattaatttgattttttaagcaactttcgtatagaaaatttttacaaaaaaacgtaccgtctagtagtttgaaaagcgtgcggacaaaaaacgagggagaggggttgggaacaggcgttgcaaatacagccttaccgaaccaacactacaaatgccctaagcaaacacacgccacattagtacacgagcgcgttttttttatttgtagctttgattttgttttctgtgtacgagaatctatacgataggacatcaagcacacatgagacaaagattatactggttcaggtcccttgcgaggaagccctaatccagtttatatgggattatggagaaaaccatatagattataatagagaacaatggaaccctgagattgccgacgagatccctatcaagaacggctcgacgagatccaccggtgagttggcttcgcgttctcttgattgtttctgctatggtgtgtgtcttgcgctaagattcgatgccatgtgcccctccagggtcctgtatttatatcgtaggttatcttgacctccagtagaactcggagatacctttctacgtatgggatcacaaatcccctatttcttccgaatatgactcttgtcgacgtttgatgtcgcgattccggtatttgtatggtatggggatcgtcggtgctaggatatatgcgagactgaggtaaaagagatatgtacaaggatttttatacaggttcgggcccctgaattgccaggtaatagccctacatcccgttggccgaagccggtcgttgctcttattcatcataatcacaccagtacaatatttggggtagcctatctaattgttgtcgacatggtggtctgaagttctgactcgtagtcgacaacagggctagtcttcctcttcgaatccgtgcccggcgagatcagagatagagct

SEQ ID NO: 69122 - DNA, 2814 bp, Oryza sativa
ctgtcttgatctattgttccgtgtatgttgattgtggtgggtgtgtccctctcctcctaggaggccttgtatttatacccataggtgtctccttgtccaagtagaactagggaaaccaatatggatacaatccgagtagtccttgtcgtttccatgtagaactctggttgtcttttcttatccggaactccctccatatccgaggtcagtttccgtataagatatggtatgtggtgggtcctaccaagatttagtcaactactattaggtatgtggtatccgtaaccctgacaacactaacatcttttattcggggagacggtttccttgcggatcggctgttttccttagtttggaggtaacattcccgtatacttgaggatataccgtatttgtatatcttacgaccccaaggataggagatatgccttattcgtaaccctgatagtggaggccggtcgaaccggggttttagaactggtcgctttgggttggtccaacagattagaaaacctttttggataaggtgaatagaccgggccctaggccggtcggtccgggcatgcccatggcgctataaccccctcaacaccttcctcctcggcaaggagacactcttggcaatatttttatatttcacttgatctattgtatttactctcatactacttgagcacttctccattcactgttggtttttgagggagagtaagccaagataagtgtattgcaatttcatttctacccctactttgatgtctaatattgattttacccttattttttagggttttcgtttttaccctcaatttttcgaagtgaatgcttgttttgcccctactttggatggtgaagttaacggtgttaagtgattgagaaaatgacatttataccctctcatgtatgtacattaattatgtttttgtccctattttatacacgtagctttgaaactttatttttgggagtatatttaaaattagatgacgcacattgactaatataacaatttggacaaattctgaatttgatggaattttgacaaaatttcagcattttgatagaacttaaacaaaattttgacaacattttgtaaaatgtaattatatgttccctttagatattagtcaatgtgcttcatttaattttaaatatactcacaaaaataaagttctaaagctacatgcataaagatggggacaaaaacacaattaatgaacatacatgagagggtataaatgccattttgtcaattacttaacatcattaacttcaccatctaaagtaggggcaaaacaagcgttcagttaaaaaagtgagggtaaaaaaaatcctaaaaagtaggggtaaaatcaatattagacattaaaataggggcagaaacaaaattgtcccttgtttgaactattgtggcacttaatcacattcgagcatggttgccacctgttacttttgaaggttgctgcatcctatatggttggaacgagttgtccagtgacctctacgagaagattgtgaaggaggcttgatattagttgtctgtgatgccccagtaataattaggaaaaagaaaaaagagaggaagaaaaaaaaagcaagcagcaaatataatggacgcatagagcaaagctagctagcgtgcagcactagtctggttggcctttgggccttgaccggcccacgcgaggagtagcggtgctatcaacgtatcaggctagcagcaacaggcagccagcaaagcgcaacaagctagctggtcccacatctctagtgaagcttgagatataatactagcttacttatatattaacatcaaaattgaaacttttttaaagcgaggataaaagcacatagtgttacattgtaagtgtgttaacagtgaaatttggtaagcccctaaaagaattatcacatcaccaatagtcagattcctgctatatttggttaagaaaattaatctatcaaagaaagcttatccagaagtgacagagttcaagaaggatgcggcatgacaagttatctattaattagaaataatttattagttttcttttcatctttaggaaagtgtatttaatgtcctataaggacttatatgttttccttttatctttaggaaagtttctttattgtcctacaagtactagtatgtccccataggtataaatatgtacacatggggtcattgtaagagatctccacgatcaatacaattcgggccatcgtcaccttttaccttttctattttattttatcgtccgacgggatttggcacctaacgcggggctgcatcgcttttcgatctccggcgaaggggtaggtcaaatgttccgccggcctagacaattatatcgtctacgttggcgtcgttcaaggctgcatcaatacattcgacctcttggattgctcaggtttggatgatatatttgtctgcctttttatcatatgtcttagttaatctattcttagtatatcaatttagctctatcggttgtctctcgctttagggtttctgccggtatcggctaaattgttttactagattagattagataaggcatctaccaccttaaaaattaattagtcaagggcttgattgtctagatattatgtttcttttcatacttagtgctgcatcagttaagtttgatctactaaaccgtgtttagaaccataatctctagcctgcttcttgactgctaataagggtttcatcggggtttcagccaatgaggtatctagatgttgcatcggcttacaagcattacatacaagttggatttagctaattgcaacaaaggtttcactgtttat

SEQ ID NO: 69123 - DNA, 2324 bp, Oryza sativa
  unsure (1)..(2324): unsure at all n locations
atcatatcatttctagccgactggtttctactggattatattgtttaattatattgattatcggccgattgtctttatatcattatatacattggacgtatagccgattactcgaaaccctatcgctatcggctggtatcggtatcggctagaactactccatcggcttgtcaaccgatcagctgttttatctattgtttatatatcttgtcggttgcaggatcaaactgactggcacgctcgcatatcatcaagatttggacctgcactggagctaagcagatctcccaggtcagtgtgtatttttagcatcaatagtatggtccaacaaattgagttgcgcctaaatccgcctttagaccctaggcatcacaaccaccttcagctgaaggaataaccgtcctagtgatcgagccttatatgaacaacttcaggtttggcttccaccttacccattccttaactaggggatttggaggtttgacggtttgatcggtgaggttgggctcttgtgtaaaccatttggaaaccggctcccaccttaccgtgagttcttcctgctgtgtagttgaacatccaaaaccctcggtacgcattcactctgtttcgtatattcaatctattcatgttttacgtactgtctagttttagtttacatgtatagattgtatgatacgattatgctagtttacatgttcaatcttatgatttatttatagaataaattaaatcaatatgtatatttttaacaagggtcaccctgactcttcgttggtatttgattagtgttgttccattaatcatgatgtgtactttgccggattccaaaagctgtttaatccatgtgatccaaactgaattaaacccctgtgcgatagtatggtgtagagacattcccagtttaaccatatgcacaattttagggtaaataaacatttgcagtgtatctactgcattacttctatgtgtttattctttctttattcacttttcagggtgctcagattgttggaatggttgcagaagcactgaatgttccagcaactgccaaactatttgattaaggccaatgatgtactgggtatcccccaaccttttattctatcaatgtgatttcacctgtttcagagtacttgttctgccatgttaccaagtttctgtgctctactccaaagttgaaaaaaatagtgatcatgctaatgtttttaaatcaatggaccaaaatttgttggatctttgaatcaatggaccaaaagaaaagcttgattcaattaggtttgttgatgaatctaggggttgtttagattgatgacattttaaaccataccaaattttctaaagttaccaaagatgtgcatacatttagttttgtaccaaatattgctaaatacataaggaatcctgcaaaaacttggcaatattgataacttaccaacattctagcattgccaaaatttgataatgtttattttggctataatctgaacagcccctagttaaacacctctatattttcatcttgcaatttctgctagaagtctagcccacaatttttttgagaattcccagctatgattttatcaacaattgtttgagtgccaagtatgacatatttcagatatggttccggttattgtcagttaaaaaagttgaattcttatggtagaacaatactttttttagccatctatgtatgggacttcctccgtttcataatgtaaaattttctagcattgcccacatacatatagatgttaatgaatctaaacacatacatatgtctagattcattaatatctaaatgaacatgggcaatgctaaaaagtcttacattgcgaaatggaggaagtaccagccttgcagctgtagaagcactgcgtgcacgtgattgagaccaaaatgtaattgactctgtagatgtcgcatgcagtctcagcttatgagaatacactgcacttgcatttgctggtgttttcaggtaattcctttgtcatgttcataaaatcatgcatattttgttttgaaacaataagcacgtgggttccttgcctatcatgggggtgaacatatatacaatggtttgatttgatcgatcttttgttaatacctgtaagatggaattcctaattgaagcatcatactttttcattctgctatgtgccaagtttgtatacttaatcatagttctaaacatgcagggatggtttgaagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69124 - DNA, 1572 bp, Oryza sativa
ttgaccataaattgaatgcgttaatttattgagcatacaaaaccaagccaagaaaccgttcaactggttgtcccgtcttattgacaaaccgcgagcaaagaaccagttggttcttgatttcttttttttagcaactttttctaaaaaactctttaaattaaccatgggaccctttttttctcttcatgtttcaaacctacaaacaacaatatcaaagagcaattgagcaaactagaaaagcagcacaggttcggtggttcctaaatcctaatctagtaatctagatagtcattcataaactatgaagctaaaataatcaatacacttcagttcaccgactcggcgactcaccgttgcagttgctcgaatgctcggttgctgtgatgttgctcgaggatgggaggccgaaggccgcgaggcgcgcaggcggccgccgggcgcggggcgctaccgcgccggccaggcgcgaggtgcggagccgcggaggcggcgaggtgcggaggcggcgagcggcgagccgagcagccggcgagccggctgtggcctgtgggcggccggcgaggcaacgccgcggccgcgaccgccgaccgggcgtctgggcgtccggcgacggcgaggcgcgcgccggcgcgcgcaggcggctagcgggctgggcagcgcgactggcgacggtgaggtgcgcgggcaggcggccgggctggcgcggcgacggcgcagtcggcgcgtgcgtcgactggcggcggcttgcgacgcgtgggcgtggcggctgggatgggaaggggagggaggtgaggagatgagatagggttagagaggaagtgtgcttttttcttctattgggccaatgggcctgaaatggtgggtggtgggagggttcagtttgggcttcttttcagttttgaatgggtataagtatttttcctttttttcctatatatacatatggaatatatacttcatatatgtatttttgttcaaaaatcttgggtattcatttgaatacctattaattgaattgggcccgcccctgagattattgtgcaatcctcaaactccacatgcgtgatcgatgcatgatcaccaacgaacaaaatggaagtcaattagcaagaagaaaatctgtcagcgtcagtgcttacactctcaggaagacggtatccatggtcgattggaaccagggagaggccatggccttgttcgtctctgcaggtgaggatgttgccggcgtgcctgccggcgttggccagcctgatgtccaacacgcagatcccatctcgccgagcgctggcctcagcatcgtcgactccactccggggacagtggcaccaccgccggaggggggtggcgaccgcctcttcatcgagccgagatccacggccatagacccgccggacgaactccccccgcagcctcagcctcagccccatcgcggcaccgactacccagcctcatccgctcccttgtctccatcatcgccgtcgccgtcgaccgggaggatgagctccctggcccagaacccgtatcagcttcaggccaccgccggcgacaccacaccgtgggccatgccccgcc

SEQ ID NO: 69125 - DNA, 1472 bp, Oryza sativa
atgaaatgggttttataattaatgtatgtttaatactccaaattagtgtccaaatatccgatgtgacaggtacttggaataagtcctggaaaccaaacagccccctaattatcacccgtgggtgaacgggggcgagccgaccgcacccttcatctcccaccaatcgctattattgcctgtgagtgaggcacgctgtgcgggccccagtggtgcgggtcatcaaagaggccagggacgaggcccgggttcatctcttctagtaggatggggccgggtggactcgcagggggagcagggtggacccgcacctgtctcgcccccttgccatacctagttcttgcagctcatcgattgtgcgttttgatttgagctcagctgatgctgatggcagctaaggatcgattagacgtgtcatagtgactgctttgacactgcaggatcagcaaccagtggcgaatccatgatttacatcaagatggggctaaagcaaactagatatatcagcacgatcagcatttctctatgaaacccaaatacactacgataaacaaagagataatccatgaaatgctattgacaaacatctaagtcccagaaataccatcgacaagtgtgagttctaagacatgccatcgtacaaatgtttttgtcccaaaaatgccatcgccgttaggattccgtcatatagaatttaacggcgcgaaatggacggaaccctaacggcgatggcatttttgtgacaaaaaagtttgcacgatggcatttcttggaactcacacttatcgatggcatttccgggacttagacgcttgtcaatagcatttcatggattatctcataaacacaagacgttgtcttcttcatcgtaatttgcactgtattaacatctatccaaaaaatttatgaataaaatgatatggtatactccttccgttccataaaaactaacgtaatactggatgtgacacattctagtacagtactacaaatttgaacattcattgtactagaatatgtcacatctagcccgagcactacttaaaaaaggcaaatagatgtcgccactataggtgccggcacacaaaacaccgacacctttatgtccaaatatgtgccggtttttaaataaaaccgacaactaaaacctatgtcagagaaatgtgccggttctagacccaaaaccggcacctttaatcttctccctcccccactagccgttggcgggccccatacataggtgccggttctcaacccaaaaccggcacctttgtttcaatagtgcttttatgaacgacggtggccctacacaagggtaccggttcttggtatgacaagacaaaggtgtcggttctcgaccaaaaaccggcacctttaatattctccctcccacactagctgctatgtcacatcctgattttcgttttaggatttataaattatttaataaattattattagaatttatattaaat

SEQ ID NO: 69126 - DNA, 40277 bp, Oryza sativa
  unsure (1)..(40277): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagatttgtagttttgtcataaagccactactgaatatgtttttcctataattcaaaagagcttaaatacgtagttttgtagtaaatttggcctccagtttgcagtgctgtggtacacaagttttaatttgtagttcttttgttagttttgccaaagtatacgtatattttataaagaaaattttaatcattttttagtcaactgttttaataaaggaaaaggtccaaattacctctgaacttaaggcgatagtccgaattattccatgaatgacataaccagacattttacaccctgaacgtctcaaactggacgaataacccctaagcactatttgtgcggttttaacatgagctgacacacgtggcgacaacgttgtaatccggtcaccataaaaatagaataaatccataggtccacctgccatccctttttgtccctcctcgccccctctcaagtcaatccctctcttacccccctccctaggatctctccattgcaagctcgccaaagaagaagttgtttgccaaggagagaacggtgaggttgggagcaagataaggtttgtcaagatgggactgccattgcctccccctcttgtcggttggtgtgaccaagatccaccggtctcactaccttctctcaactagctcctctcacactgatttccgtcgaactccgcatgcaatagccgcctggcatgtgtgccaaagaggatgatgtactcatggtgaaggtggagttgaggaggtcatgttccgcctcctatgcctagggacgctgctgccatcgctacagttaccccaaatgatgccaaggtgtggaaacaagtggaggtcggagctttgcaggatgttgtcttcctctgccatctcatggaggccgtcactgtcttcctctctattatccttcaccaagtaatggagaacgttagccgccaaatcatgctcatgttgaggggagagagagagagagtgtgtgtgtgtgtctttgtttgatagatggaaggggaaggaggatgtggaagaatggagaagaggggagtataagatgtagcattgataggtcgagcccacttatttctattatttttttggctgactggactatcatgtgtatgctaggtagaatcaaaaccgcttcaaattgagttattagggtaattatttatccggtttagaaagttcaaagtatagaatgtctggttttataatttaaagaggtaattcagaccgttgcaataaattcatatggtgattcaaacttcttcctcaaataaagagtaccttttacttaaaagttttcacatcccttttgagttgtcgtatttgggctaaatttgcaatcgcacttatgtatcttatatattctgatcttctaatatattcggcaaatcttttgccgctttcacttaaaaaaaagttttcacaagccatggtcagttactagaatggattggcaaaatgtgaaattcaaatcacgtgtagttttaatagtgagccttatgtcactcatgtcaacatttcctcacgttgtaacttcattccttttgtcatggatgttacactcgtcactcatcctcagcaaggctccgtgaaccctcacctttacaacttggtccacacaacctacaaccctaccctgcttgtcatcatgcaagttagactatgaatgttcagccgacagtaaggaatttagttgaaatgcaaaataattcggagtgtgctgtgcacaagttaaattaatattctttttaagacaacaactacattacatttgctatatttcttacgaactggttctaccatattttcttgtaaaaaaccctctaaatgtccattttcaatataccatgggagcctcctcacttttttacggtaaaaaaagtatggcagtaaaagttgtaaaagtaccactgggtgaatgagggtgtcttttggacatgagaatgtattaatctgatatttattataccattcaatgattttctaggttgataatacttattgttttgaaccaggtcgatatcaaactttaatatatttcattatgaataattcctaaaatatttgtcttagaattaaggagatcatatgcatagattaatcttaaaaagtatttttaataaaatcatatatttatttatatttatattataataaaaaatagtaattaaagtttttttaagactgtatccttatccaaaacgataaatatggggtagaaaaatatagagataaaaaaactcatgtgcccttaaatgcttaaaagcaacaaaataaataggagcagacaaaaatgtgacaaatttgcacttagttgtaggtggggatgtagacaatgatgatgtagattgatccgcatgtataacaatccttaggaccggttcgttctgtaaattgatagtagtgatattttcggtgcacgcaaaacgaaaaagctcatgattaattaagtattaattattataaaattataaaatatatttatttgatttttttaaacaacttttacctaaaaagttttttttaaaaaaaaaacacaacatttaacaatttaaagagcgtgctaacggaaaacgaaagttgaagtttgaagttgataaaaagaactgggccttggctgtgtttctctcaacctctactcccttgtttttcgtgtgcacttctcaaattgctaaacattgtgtttttctaaaaaaaaaatctaggaaagctcttttcaataatcatattaatccattttcaaacaaatactctctccgtcctctaatataagggatatttactatttgggatatttactattttcgtgtaacgtttgaccactcgtcttattcaaaaaaatttatacaaatataaaaaactaaaagttgtgcttaaagtactttggataataaagtaagtcacaaatagaataaataataatttctaaattttttaaataagacgaatggtgaaacaatgaaagcaaaatatcaaaatcctttgtatttggggacgaagggagtagctaataaatcgttttgttttgcatatgtgggagattagttcttaattcatagagctgaacacagccttagtcttgccaacaaggaagggagagataaggaggaggtaagagagacatcgatgttaaggtttaacgtcagcttaaaatcgattctgcccagccagaccacaatctcagagacgagctgcggcactacgttatcggcatgtgacagtaccgatatcccgtccatatgcacgttcttgatgccgatctacacgacatactactagtatactacaccagaatcgatcgtgtgtgtttgtttgactgtgtatccggtgtccctcgtataaaaaagaagaaaaaattacaagcgggtgtttgttccaaagttttttttcaaacttccaattttccatcacatcaaacctttcatatacacataactttttatcacatcgtatcaattacaaccaaactttcaaacttcagtgcaaactaaacacagcatagtccctctctcccaaacacagaaagaatcgattgactgatctatggactccgagtgtggaaacgccacggaccgactggcaccggcagcgaccacgaatccacgatagccgaggcgcaggttttcacaggggaatgaatgaataaagtggacacaggcaaagcaaagcaggccccgcccaccccgacagcgacgccccgtgaataatcccgttcgtcgcgttctccgttcgttcgccgtggagcacgtacgtacggcatatgccgacccaccccgctcgctccggtgtcacgtacgtacgccgctgccctgcccgcgcgctgcgctgccgctgcgtcgtcggtgtcctctccaggagagatctcgtacgccatctcgcgtcgcgcgcgagtctcgctcgctcgctctcgctcttgcggctgcggctgtggccggccgcgcatatgggctccgggagagggagatcacccgacgacggctgttgcgctggccaccaccccgcgtgccgccctgtacatgtacgggcttcgctttgcatggtggaccaggctttcacgggtggggttgattgatgtggtaatgacctggcaagggcactcgctgtataagcaccaactatgagataccacatggtggcacctaagatgaagagcttctaagacattttcttcacagtgcaagcaccaactagtgttgtctcaccaaatccccctccctcacggcctcaccccaccacccccacaaatgtcatgcccggcgctggctctcccctcctccctccaccggcgtcctctcctcctagcccaaccgccggcaactctcctctcctccttctaccgttggcgttcgcggagatccctgaggcgcgcttcaatggctgcgtgacggagtggccggcgagctcccggtggcgcagatggaggctaggtgtgttcggcgagctcccggcaacaagcctcaatggcggcgtggatggcgacgagctcggggcagatctggcggcatcgacgcctcctcaccggtgcgggcaagaagctcatagcggagttgacagcgtcggcagcgatggtgtgggcggtgcgcggtttctcccccaaatccatcgcgagattggccggcgtcccccttctccctccaccggtgctggctctcccactcacgaccggcgcgtagaggaagaagacgacgacgagctctgccggcgtcaaggagctcccccgatggagcatcggcggggtcgtcgcgacgtggagcggcgacggcctcctcaggcttccccgacggcggcgacccaacgagggttgcatgcgccgatggttgaggcgagcccgacgagggctatggcgccggcggtcgagacgagcatggagtgagggttgcggcggcgccgagctcctcagctgcggtccatatgggccttctcctctggtcggatttggccgctcccttcccattctcctcctccggttggattgcacgacgcgggggcacggcgcgacgaaggcacgccctccacagcgcatgggcgacgcgctttccccgcccgtgcggactcgcggaggcgaagaaacgcgcttccctccatggggacaagtcgctctggtgggacacgactcgcaccgacacgcgggcgtttttccgacgtggcgcagtgaaggaacgcgccacgtccccacaccgtgaacggcttaataagcaaaactattcctatcgaaaacgtccttgagcttaggctgagttcttttcattcacccttttcattatgacgcttcctaaactgctaaattaaatagcattttttttcaaataaaagtttctaaaacaaattaaataaatcaatattttaaacttataatggtaatacactaatggcgttcccctttttttttagtcatgaaaagctacaaccaaactgttgattccatctgcctctaatttcttcaaaagcataatatttagagtaaatttctcaaaacaatgtgtagttttatcaaactatcacaaaactaaagatttagcgataaatttattacagaacaacagatttaaggctaagtatcacgaaactatatatatataatattgaagttatcataaaactacatattctatagtttaaatctctagcactaccgttatgttagagtgtagttttgtgattaaattgacagtaaatctatatttttgtgatatatttactacttaatttttatttttttgacacttcatcttaaatttgtaattctatgagaaattttgtataaaatatacctttaatctatagttttgtgaaaatatttatagttatataaaatttactccagtgtttatagacacaagaatttgaaacatgatagagcatgccaccggtgcttgtgctttccaggacttccatgccgcaagaaaatttcctctgttacgtacggagatcaggctaagcaatgagtgaaggaaaacttaaggtttgaatatgcagccctaaagcaggaactagtacaaaatgcatcgatggccgctggtggggggctatcgacgggatcccctaataatttgcctgacgagaaggggacacgccgaggccaacaaaggctgacaagctacaccaacgcccggagggcatgtactctccaatcctagctaccactggacctactgctggctcgatcatggcgatcacgcatggccacctcgatccacctgctctccccactgttgcctttgctcactttctcgtccgacgtgcacgtaccccaaaatcagagtttgatctggaaaaacaatccatcgtttgctcccatctggccatctcgtctcctttgcatagacaggcagtttttccgtggagcatattagggcagggataataaagtgacggaaataattagtagtataagagtacagtaacctccatcctaaaatgttgcaacctaaaatgggatgtgatctatccatcgagggggtggtacttcggacagcgggaagtggagacccctctccgagagtgaagatctgaccagggggttagtcggctagaggtgctgggtaactgtgatcgtgatgggcccggccaccctgcgaggagagggaggcaggaatttatacaggttcaagccatccagaggtgtaatatcctactcttgtgttggtgtttgttgtcttctatagaccagctaagtacaaaggaggtctttctagactacaaagtctaaaagaatccaaccattcatccgtatttggtccccttccttttatactccaagagggctcacattattacaaatctactcttagtcttgtctcatcagccatcttgtcgttgccggctgattccttaatgcaatcttcaagaaactcttcaaatcttactattcatattaccccgggctccgtgtgagacagttgggcctctgccagtgtgctcaccacgtggagcgtggtgggcccgatgaggcccgacctgcccaagacagcgccacggttgcttctctgtctgtttggctaaatcaggtgacgcggggcatgtgcaacgcgtgtcctaggcaccaccgtccaaaatgactcaacgttgccgtcttgtctacgtcctttcaactccagactggccggggatcccccataaacctgtttcatttatggcagggcgtgctgcctcacagctggctgtggaacacgctcaacttcctagcagtttttgagatcgcgtcctcccgcatttaaagaattttgattattcttgaatgaacttcttgaaagtgtcattgatggaagaatatctcaagattatgcgtgttgtacgttttgacgcccttctaggcagagggaggcgagccagacaaggaccaaggcaagcccagggctcggagcaaggccgggcctaaggcaaacctcagtttacgccttcatgtttggtaagtatcatcacttctacttctcgagtaatgcgtgacttgtgcggactaaggctagctcggggcctaggactaggccgggctcaaggcagaccttagctcgttttcttaagatataggttttacaagtttctatgcccctcttgccaaggaccatagaacctataagggctagggtgagcctggggcccggaatagggatgcataccttaggctatattcttaaggtatatttggggtatgcttgggatccaagttaagccccaagatacttttatactcagagttttagctcatatacacagtattccttctcagccaaagagaatcatatatatgaaatcttaggtgggctcgagaccctacagaatgggcccctagctacgtcaccttaaggttacctttttattttctaaagatatcttgatcatgttatttatttgataatgctccttttgccggataatgggtaccccggttaccatttcactgacattatcctaggataatgaatcttgcaacatttttggatggaggtagtagactataaggcagctgtaagtatctgtggaggagataagatcagcaaatacaatataagagtataagctaactacgagcacatatgaaagagagagggaagaagagaaaagaaaagcggggtacatattattaatggtgtagtatatatttatatataactattgtatgaatagactattcgattggctgtaaatgatgtgtcaaattttaaagctaattaatagtttgctatactattaaactcaaaaaaaaagtgttgagggggtgtaaagtgagtaacgttacaacgcgaaaaaaaaagagccccaattattttatattttagtctatgtctatgtgtatttaaagatcactcttttgatattcaaaaagtttcactcttactcttatgctgatctggctataacaaacttgttttcttctgctccagaaagcgttcgatggtaaccattgctaacacaaagagctagctcatgacaataatataaacgtgtgttctgggcaacagcgattttatttatccgtttaataaaaagaaaacactatatcatgacatattttttttctcagccttcacttaaaagaatctttgctactattgaaaggaaaaaaagaaacaacactagaggtgttaattcatctaaaacaggcacttacaagttacaaccccttcccacccctcataacacgaccgacacatttgatcctattgataagggtgttaggtcccgatcttccgataggtactgataaacagtcgatttggacggagtcgagacacaactcgatccggcttctgaacaaacacgctactgagccccgcaatcacagcaccacgtctcctctggttatcaatcgtgccgaaacccaattgacctcgccgagaaggctaatccctacatgcgaatcgaagaacacaagcaagaacaagatagattgcatccaaattgcatatgaatgattaagcactcgaatttagggttccacaaaccgatctaccggcgaaactgttcttgacagaataatctaagcaaaacccgactctaaacgatgacggctactgaataaaaatgattagggacgtcctagggttgccttagggcgcacacccccttggcctaagtccacgacacaattataaggcccaaaacacaaatcagattcggactggatgaggtacgcggcttgttttgcagattcccggtagctcagtaggaattttgatgtgggaccaaaaccatatgaaagtagactccataagctttccaacaaatactcatgggcgccgaaattccttctagatcagcggctaggtccgtttgaagttggtgctgtcaggaggtctgaatctgaatccaaaacgtgtggaactttatctctcgtcttctatggaccaaaagtgacgtggtgagatgaaagaagacttggagaaagtcttggtttggtccctaatcaacttcttcaatcattcatgcattctttatgctcggtctcttttctttcacccaagcaagtacctctacaaacgaaaacacacaaaactcattgtgtagcaacgtttgttcaaatatataacaagtaaatctaatatagaacatatgcacctttagttgactaatacataaggtagtcatggttatatccgagctagttgtatcctcatcaccatataagtatatgtttattaaaaagtaggtaccaaatattgctgccggttttttgaataaactaacattttaagtattatagatgtcggttttttaaaaaaacaacacctcgaaggagccaagccgacctagcctttcacgagatttttcacgcgcaccgatgatagagggacatgtcctctccacctctcccttatcctcttatctttccacctctccacctctccatctctctctctctctccaggactccttggtggcggcagcctcccttgctctcctttgcggcaacgtgacggtggcaagcagagcggcgcctcgaagggggggatgcgcctccatcgcctccccacgaccttgcctaccctcagcagcagaacgagcgtcggcggcctcccttcctttcgtgtgtggttgcagcagcctccccttcctctccagtgagcagcggtggcggtagaagttctccactgtgattggtgtattctttgatttggttttttaataaacttgttgatgaatatttggtcctataatgttaacttatcatgaatatttctcattctatgaacttgttgattctcttatatgaatttgtctatttttttcttagatttttggatttaattttggtgcttttgaggcatcggctcaaattgagccgagccgagccggctttttttttttcaaacagcttatcaatgccggttgggaaatctaacacttataggggttcccaactggcaccaataaacgttttctgttgtagtgcttcttacagagccccacggctaatttatcttttttttcttggcattcttgtagggtctcaaattgtgttccgtttcggggtatcaaattccaaggtacggttctgaatgtgaggttcgacatgctctcagagcactctgaggtagcaatcagccccctagctagtcgacgttttaccggcggtggcaccaccgatggctactagcactcatagcgcagtggaggtggatgcagagatcggaagaaacgggtggagagatgaaagaaagcaacagtacagtacaaacagcgccattctgttctgtcgaggatacggtgctggtggctcaacgctgtcgtcttcttcctctcgtcgtttcgttcgtttcttcctcctcccctctctctgatctctctctctctcccgtgactctctgcctcgcgcgctgcctccgccgctgcatcacgcatgtggcaacaaaccgacgtcactgtgtgtcctgcatgctgtgccggtatgggacggaggagtcgaggagaggattcatttggttatatagcatggtgtcgccagttgggtcagtgtggagaggggaaagtacaaccagggtcgccgaagaagacacttcggtatcaaggctgtagctagaccactgtgggaaagtcttaggatatctaccactgctaccgtgccatccagtctagtctactgccaaaaagaaattgtttttgactattttgcatagtatcccccaacaaaatcagcatgcatatccttattaaaatttattaaaaagaagggtgaggctcgaaattgggcctttctcacatgcatgttgttctggcagagcccggcataaaattatgtgacgcatagtaaggtcattcacattacactaagttgtcattcagccttcatcggtcagctcggagattcccctccaataagggcatcaagttaggtagcaagggtgggacctatgtaacgccccgattaacctacaaaaccaagtagtaattattttagttcacacaatgtaaaggtagtaagctgggccccacatttaagagaatgggtggttgaagaagagagggaatgagagatgagagagtcttaatatttgtttattccttattgcctggtagtagcactactaccggatgatactactacccattttactagctactcccacaatggtgaaccaggtaataggacttcttactatccactttttttttttttttgcacattgtggatgccctaatagggagccaaaataagctacaggttcatgatcagatttgcagctttgggcccacaatcttttgtcccgcgcccctccgggaagggagagagaggatcggagaaaggccggcgacggtaatggcgacacagcggctgggcagatgttggcgacggggacgtagcgacgcagaaggggaggggagaagcgccgctgctgtcgttggggaaggaggagaggtcgccggtagtgaggaagataggaggagggagagggagaggagctttctcttcgcgtgccgtgtctcctctaccagcaagcttgatccacagcttggtggcgccatcgtccgtggtttccggccccgacgaggtggagcccccctcggcacctcttgggccacgcgccaccgcctcgctcatcaccgccgccggtcgcgagcacgacctcaattgctcctctcgttgagctgcttcgatccgccacctcaagcgccacctcgccccgtccaccccattctgtcgtggtggccaaaggaggaagtgggaaggcgtggcagccagaggaggagggggaggcacggcagaggagaagagaaggggacgaagagggaagcgacggagaggcaaaggagcacgaggtcaaggccgatatcaattcaaagccagcgagctcgatccgcagctagctcggtcgccgcttgggccgcccgatgttgtcaccgcttggaccgcctcgccagctgccaccactcagccccaatgccttgttttctccggcctcggtttcctctaccggtggggaaagaaaaagaggagaggggagatgaaaagtgaaatattggtattggtggaacccactacaagtaacttgcatcgtggagtatgtagtttaatacgttcttgatttaggcggcgtacgaagaacggtaaatatcaaggaagcactgctattgccctaatgactttaagaccacaaacttctcttcacttgcacagaaggcgcgcacacatcaatatgcagttaaaatatgtattacgcgtttcggtgattccaaaaggaaggaatataataactaactgccctttgttcaagaggctgtgttggttggccagccaccagattagaatgcacaaacgtgtgatctccgaacggaattgtttcacttttggtcttctcttacagcgacatattaatgaagtatacatacatcagctcaagtacgattttccatacagaagaacctaaaacatggttcaaggtgcagaaggtccatcaggcagttttgtcttccttttcctaccaagaatggacgctttctgcagcctcacaccgccagcgcgccacttcttgaaagcggtcatcgagtccctagcagattcgaacacttcgcgacagaaaaaaaaagggttacttgaagtgataatagttgggagcttggaatggtaatggaagaaatgcaggatgatgagtaaaatcagagttgggagaagtatttaccttgagcttcttcttttgtaaggcgcggaacaaacttgggcactgtcatcatggaagagctgtgtgacttgcttagtatctccttgtacctactagtgaatgcatagcgcaagaacagtccaatgctcctgtcgttcaccctgtttacacaaccatgcaaacgaataaatcattatacacctctgcatgtgcaaagtacaccaatttagtaagatatcagcatccaaacatctaataatcccacagatcactagataaataacttcatcatcagattcttaactcttcttgacagactgcaagaaaatagtgacaacagcagtggactccctctctagaagtgcatctccaaattcattgtggacttcgttctctgtcctcattgcacctttattatgaaaataccgtaaccattaggaaaagctgaatcccgagaggatgactaacggtgagcatgaacaaatcatgtataagtggtagactggtagctccaaatgttaatccagttgctcacacccaacactaaagcgagagaccaaatgagtagttccatgactgttctattggccagtaaaactgaaggcaaaacacactggagcatctgacaaggcaatccttcaaatgttctgcagaacaaccaaatacacttgctacccttttttttttaaaaaaaaaaagtctaatattgcccaaatatacaaatgatttttgcaccaaacaagtccatctatatgtgacagttcggccattttggaacttcccatactgaattttatttttctttgtaaggcaaataaggagaaataaacatgctcaagatctacaataagtggggtggcaaattcataaaaagacatgttgaaggggtcataaaaagacattctataggtggggtggcaaattcgcaaccgccacagtgccatcaccaccattaccttcttttaattattatatctataatataatatgttcttatgctcataaagtttagaggatatccttagcacaactacagttctcatgtactctgttctgtgtaagttgaactggtgtcttggtggcacagagatcatttgtcaggactgctgaaatttataatgaatgtttggctgacaaatagaggaaacagcaagggactttgttcgagtatctgaacatattgtcagcaaaagaatgatcaatcacattccgaaaaattaagagcttcttttaatattcatagaatgaaattgagaaaaaaaataaaagaaacaaaagcatgccttaataaaattgtcaatcacaaagggaagttgattgtgaagcaccaagttagggtatgctaacatcacaatgccgtggttgcaggccatggccaacgatgagcagtgaagcagcaacaacagcattaagagcagcattagatcatctagtagttgattattgagttgtattcaaatatctatctaatatctttgagttgcatgcagtgctccattaggtactttgcaagggatcctcaggccataatctcctgcattccaaaggcaagaatagatcaattatctacatgtctctctgcactccctgttcctctaataggcctagtcgaagccctcatctatcacagctactctactactattcaagtcagcaacacaatttttttttagaaagcagatcactgagtgatccggcttttaatagaaagccaaacattacatagtttgatacaaaatataaagcaaaaggtaaacttttctgggggaacctttttgccactgaaaaccctaaacttgccaagcaaacaggcaagtcacaagtcattttcagcatttgtagagccttcaaaatacagctttgaaagctaatttttattgtaatatatatttgttaaacctaacaagactaatattctgaaagtacttctcaggacaaatctactgattattttcatgtatcacatacaaatcctaaactcaaacctatcacagttggtttacggagataactaaaatctgcaaaatattcaaactaaatcttaccaatatccataatgcttttttaaaaaggcaatggtggtagtggtggcgaatctaccactccacctctacatcagctttacaaattgcccttcgacagtacttccacatattgttagcttttcttgttcgaccttctaaatacaaatttagcacaaaagattatttatttatttattatatatacatatagtgaatctattctacaccccccctcccatgggccaaacccacctcccccaccctccctatggcccaaaacccccctcccacctcggtcaaagcgtcctcccgccggtcaaacccgcccaccactttgctgctctcgtcttgcaggaatcgtgcagtaacaggacggtcatcgtgcagtaacaagatcacattatcgcagtaacaacgtcaaaaagtagccatgatggatcttgtttcgttaagcgtttttttatgaacttcatggtgcaaacggattggaaatacaagatatgatgtgagagatattgctctctaaagattgagatttacctcttttttagtccttgtctcactggaacagcgtagtaacacgatggccaatatgtagtaacaccactgcttttcgcagtaacaacgttaaaaaatagttatgatggttctagtttggttaagcactttttttttacgaacgccatgatgcaaatgggttagaaaaataagacatgacgtgtacgttagtactctctaaatattgagatttaaaatactctagatctaaaaaaattactactatagggccactgttactatgcatgttctctgttactgcaaatttcgtcatattgttactgccaaaagtgcagtaacaacctatacatttttgcagcttctgggataatgttactgccgaatcatagtaacaaggtatgattgttataggtacataactgatttgttcacaaatcatcatacgatgatttggttagaactgcttgtcatgaaccatgagatcatgggttcaagtcttgaattcaccaatttatttttaatttttctaaaaaagagaggagggagagaaaaaaaaaaggagggggaatcggagggagaagcgatgggagggagaggggcacgacgggagggagagggggcgcgggagggagagggggcactgggggagaggagtgcgggaaggaagggggcgcgggagggagagaggagcgatgggaggggaggaggtggggacggatgggaggtgggagggggtgtagaatagttattctaagggaggggtgtataatagagcttatatatatatatatatatatatatatgctaattttacaaatagaactgtggaaatgtatcaagtgtttgctttaacaaaatacgaagggtgtgttaataaaacagacacattcatttatatcgaacatgtatgatacaatattatctgtagcaaacacagcaatttatatgattcatgatcatctgtacataatggtttgttaacatactgaagctgaagattaggttaaacaacctgaaatcactagatggaaaataacaattgtgcaaaacaagaacagcaagactagataccaagaagtggcaaggcatggccgaccaacctcttctcttaccactgcctccacattttttgtttatacttctcactagagtttcaattgaaggtggtttctttaatttcggatgatctaccaatatcaaatccaacttggaatcagagatatattttattattaacacacagtagctatgttttgagcaacgtcatgttcatcaagcagcactttcacaaccgctgcctgacatcagcaaggctgcagccataatatggagaggagcaactcactattgcttatgattgttttctgtgaaaccaagcaatttgtttggataaaagagaggggagcaaaaagatagataggttgattaaaaggagagacattactgaaataaagtgagtgttggtgtattttcgatcttatttgaagtgataattaccaatgtggtatttccaagatgttatggcatggaagttggtgtccataatggcaaaacaacctccaaaaccacccttgctctattgtttgaagtctggagataatcagataaacatatctattttttttgttggagttaagtagaaattttgcaaagttcaagggtttaaaatgaacttgtcttatgaaagtatgaaagaatctatcttcaatggactcaaaagcatttataatattgaaacaaacatgcacaaagaaaaatgtatgttgtacgccgaaagaattacttagtcattgtaaaagaaaagtattatagcgtatgttaataaggtcatttgtggacaaaattttgtaaagcaatgaagtggctattctatcaaatatcacatagaaacattttaatatgaactaataattcagtaagatttttaacacaaaggtaaataatatctctgctttcttttaccggtggtcaaactttagaattgttgacagcacagattctagggcatcaagtaaaaagcggatgcaggtagtaagccagaactatatcctaaaagtgcatgagattgaaatcgtttcagaacttacaaagggactatcttgcatcctagctcatagaagtaagggcaacgaatcctcaaatcaacacaggctgcatcagcttggatctccttccgggttctgtagcaatgttgttatgatcttaggacaacttttctaggaaatattgaaactaccaggcatttgcaattactgaagaagacctctacagtaagttgacaagaagtactttcatgtaaatctgttgaaacatgaattctagctaagattctctgtatacaacaatgaaaaacaagttatgatgaaacctacttctgggtgaagcaaggaggtacatttattgaaactgcttgttccagagacagcagcccatgtgcaagccaaaatggaaggtccaccttagcacccttttcaacctggagataaagaagatacaatgtttaactggagcaaatctctcacttttgtttccaaccaaagcaagaaatgatgtgaaggtgtttacaagacaaactaaaaaagcatccaccaccagattgtgtttactagaaaatgtgtcatacaagccaacaagagtacacctagcattccaaagcagttttaataaataaaatccaatggtcatataacactcatctcagataaactcaattaactactgcatagattccaaaccaacttccttctagaacaatagggatggaggaagaaaggtcagtaggtgccctaggaagttacaccatagcactaaaccataggtgcaaaagtcacttacactgtttctttcagcgccaggatctagtagtccaacaccatttgcactcacttgaaaaactaccgaaataggctgcagtaagagtagaaacacatttagatcatatttgtgcaagcacaccagaagacgataaaacaatcataaaattacctcctcctccatcaggatatcatcgatgtcgtaataaccaggcattgcaccaagcaaacagaatactattgcttattcttgatttctgtcaccctttggcataagcagctacactgtataaataggttgcacattgatgaaaagcagcagtaaatgcacgaatccaggaccaaaaaaaaggggaatgggctcaaagtagctaatgacatttggttgatttgttccctcatcaattgggtgagtattactagaattgcttgtaaaacaaataaccaattttgttttcttccccaattgcaaatctatcaaaactctgaaacatagggctcaatttctcataaatccaataaaatctcattgaaattcaacaatacaacaaaagaatgcatgcagcagagagcagaccagctctgcggagaagcgcgcctcctgccacgccctccccccaacctcctgcctcaccaccgaccgcctgcttccacgcgccagatccgcacaggcgcagcgcgtcgccgcccgttgccagccgcctcctgctcgccccagcggccagtgccctcgccccgctcaactgcgactgcacgagccgccccgactacgcgggcagcgccccgccgccagaactcgcaacaaccaacctcgtgcaatgcagtcgtgcttagagaggatcaaagaggaggggagggggggaggcgatttccgttctccgcgtggatttccgtcggggtgcggtgtcggtgtccaagatcggagttgtttccgccgcggcggcggtggggaattttggcttcgcgggtttctttcggctttcccgctcaaacaaaaacgagtagagtagagccgagccagctccggttggctcgtgccaacataacgagctaggctcgtttagctacgtaagggcaagataatcagtatttagatataggccccgttctaactttcattaaaatgaaagattcatatctttcctcgtttttcgttggcacgtttttcaaactgctaaacaatatattttatacgaaaactttatatatatagaagttgctttaaaatattagataaatccatttctcaagtttgtaataactaaaacttaattaattacatgttaatggtttccttgttttacgtacccgcttttaatcttcatttacagaagaagcgaatggagccgtaggataatttttcgatttgtagtattatagtattataagatactaccataggatgatcgagatactataatattttagaaattacgtatttttatataaaatataataatacattatataaattaaagcatataataatgattttgataaatttaattggtttttattgtaaacttgagcatatttattcatattattatcaatccaccttattttaaataataatttataggatcgtagacaccatagaatcaggatagcacctaagatttcatacgatcatgtgaaagtaaacaataggatcgagacactatgaaagatagggtactagacgggatcggtatcgttacaatttgacaggatcataatatcgtaagaaactagaatatggatcatgatatgacaaccttgcatgagggtgaggccgaaggggagaagtgaatcaagcgatgtgcaccagcaaatcagaagcaaacagataatcaagtgaagcaaataaggcgaagtgaatgaagcaaatcagcttcactaggtcgtgaagatgttaaggcaggcgtagggcttggtgggcattggctgcacgatgtggccctagttgatgagagcgttcgcgatctgcttgggctctcgcagtcacgcactcgcgctggttgatgcgcagaaataagttcactttgtgaccctcaaaagtgattgaaatctaatttgtgatcctaaaccacaaaaccggatatctcgacccccaaacttctaaaaccagtgcaatttgactccctcagcggttttggaggacggtttcactgatgtggctcctacatggcgatattgaccgagtctttgttccatgtggcgttgacgtggcacttacgtggcatgagaattaaaaaatatgtgtgggacccgtttgtcattcacacacaaaaatttgtggggcgcactaactcatctctctttcttcttcctcccctcttccatttggcgagggccggagcggcagcggcggcggcgaacaaggacgacactggctcctccgtgttggccggcgagcgaggctagtgcgtgggccgctgccttcaacctccgcctccgtcgtgggccatcgacgatgccaaggacaacccccgccggtcgacttcctccacgacgctgaccccatctcgccgagtgctggcctcgccatcgtcgactcctccactcccgggactgcctggccccatccctgcacacgatgctccccacgtcgaacgcggcgaggcccgtgtccacgcctttcttgagcagcatggtggtgacgcgcaggacgcgctcgcacttggctggcatctcccagccatggaacctcagaatggcgatgtcctcctcggcgtccagtgaccttatgtactccaccgtctcctcgctgaatggctcccgacactgcggctagtagaaccactcgaatatgcaatcctcaaactgcacatgcgtgatcgatgcatgatcaccaacgaacaaaatggaagtcaattagctagaagaaaatctgtcagcgtcagtgcttacactctcaggaagacagtatccatggtcgattggaaccagggagaggccatggccttgtttgtctctgcaggtgaggatgttgccggcgtacctgccggcgttggccaacctgatgtccaacacgcagatcccatctcgccgagcgctggcctcagcatcgtcgactccactccggggaccgtggcaccaccgccagaggggggtggcgaccgcctcttcatcgagccgagatccacggccatagacccgccggacgagctccccccgcagcctcagcctcagccccatcgcggcaccgactacccagcctcatccgctcccttgtctacatcatcgccgtcgccgtcgaccgggaggatgagctccctgctccagaacccgtatcagctccagcccaccgccgccgccaccacaccgcggcccatgccccgccgcctgccgaaggggaagaagggagagaacgagagagaagggagagagggaggaggaagaagggaggactgacatatgggccccacatgttagtgggcccacatttctttttgtgtgaatgacaaacaggtcccacgcatattttttaattctaatgccacataagtgccacgtcaatgccacgtggaacgaagactcggtcaatatcgcaacgtaggcgccacgtcagtgaaaccgctctacaaaaccgccgagggagtaaatttgtattggttttaagagtttgggggtcgagatatccggttttgtggtttagggtcacggattagatttcgatcactcctgagggttacaaagtgaacttattcctgatgcgcacgtatttgtctctttgaggctatgacatgggccgagggatgttgcggctgctatggccatggttttgaatcttttgatggactgcgcacccgcaggcttccaattgtactccttgtagggctctaccttgtttggctcgtgggcagctcgtaagtggagactgcgacatcttccacggcagtgggtgcctgccgcccccgccgacgatggcgatgcgccgaactacacgaaccggagttgcgacgagatcgggcccaggtttttcaacttgggtattcgaaattgtaagagagagagaaaattttcaaacccaaggtctaatagttgtataatatgtaaaggtataaacatgttttcataaagttataaatgaatagaattgaccataaattgaatgcgttaatttattgagcatacaaaaccaagaccaagaaaccgttcaactggttgtcccgtcttattgacaaaccgcgagcaaagaaccagttggttattgatttcttttttttagcaactttttctaaaaaaactctttaaattaaccatgggaccctttttttctcttcatgtttcaaacctacaaacaacaatatcaaagagcaattgagcaaactagcaaagcagcacaggttcggtggttcctaaatcctaatctagtaatctagatagtcattcataaactatgaagctaaaataatcaatacacttcagttcaccgactcggcgactcaccgttgcagttgctcgaatgctcggttgctgtgatgttgctcgaggatgggaggccgaaggccgcgaggcgcgcaggcggccgtcgggcgcggggcactgccgcgccggccaggcgcgaggtgcggaggcggcgagcggcgagccgagcagccagcgagccggctgtggcctgtgggcggccggcgaggcgacgccgcggccgcgaccgccgaccgggcattcgggcgtccggcgacggcgaggcgcgcgccggcgcgcgcaggcggctagcgggctgggcagcgcgaccggtgacggtgaggcgcgcgggcaggcgttcgtcgtggagttgcgatgagatccagagcgatgttcctgcacgtcgtcagcggccggtccaaggcattcgtcggcgactctctggccaggaactatatacagttactcatgtgcctatgtcgtcatctccacggcgaactggttcaagaagccgtccttgttccacgcactactagaaaaagcatttttctcgacgtgagggtcttattttcgcatgcggacatgacccttagagcgaaatgaccacctacaaaaatataaatcggagtgaaatttgctgtccgcctgcgaaaatagacttgaatataaatagacttgcgagctaggttttttctaagactcacacctctcctcccctccacacctctccacacctcaccggcctctcccctcccctcacctctcctcctctccccggccgccggctggaggcggcggcgggcgatggctgcggtgaggagggtcgaggcggcatggctcccggccccttcctcctagatctggccggaggggggcggggggagggcagacatggcgacggcggcgaggagggttgaggcggtggcggcagcggcgaggagggtcgaggcggcgcggctcccagccacggcggtgaggggggttgaggccgcgatagcggctcctggcccctccctcccacatttggccgaaggggagcggggcgcggccgtgcagcgtcggcgcggactacggtgcggcgtggccgtgcggcggcggcggacgacggcagggtggcggccgtgattttaggaatgattttatttgttttctttgctagaattgattcggtgattttggatgaactggtgatttctctattgaatgtggattcactggattggatagggaatgggtgggaaatggattggaaacgggaagcgaccgccggaaacggcggtggctgcccatttttttttagcgcttgaagctattttcgcaggtggacctgttgcacgcctatgaaaatcaactattttcgtaggcgttgaggtgcatgcggatggtttggcccctgcgaaaaatgtgattgggtcgcctggagaaacactttttttagtagtgacgaatccgggcgcctcgtcggcagccacttctgccacatcccggccgtcgctgatctcatgctctggtactcactgcgcgccgcattccacaccgcacaatgaacgctcaccgccggcgagttttgtggcatggtggtggtgcggacgctgtcgccgtcgtcgcacttcgagggtggggaatggaacaagggcggcgaccgccaacggaccccgcctgtacgcagcgggcgaggcgccaatggccggtggaggcgcgcaaggtcagccgcagcggtggcgttgggggcgggctgtgacggtgaggatgtcgacatgagagaggaggacggaaatagtaatgggagtggcatggttttaattttagaaattttcagtgacacctaaccgaaaataccatatttagaaatgcttgatgttttagattttttgtttgtgctttatttgtatgacatcatcaaattttcatagttatcttctatctatattggttttttataatttaataaataccataagattgttttatgcgctaaaaaggttgcactacgcttatgtaataataacatatatatcttgctttcaaattaatcttagaacaactatgacttgtagttggattgccagatttttttttcccgtgatcaacaaaattccccgtagcaacgcacggacaccctactacttttagaaattttcagtgacacctaaccgataacgtgaattgcaacggtatttttctaatatgccatatttgtattggcataaatcaaattaacccttaaacaatactctccatttctcaccatgcttctgtgggaatgttcatctcaagcaacttcgcaatcattcagtacaggaggcactctgcccaaggaaaggaaaaactagatgtttctccaacaacattcgcatctactccaatctaaacagctatgctggtataaaaccagccacgatagcacactgagaaccaaacgtggaagaaataccatagaagatccagacatcatgacaatatcgaggcatgatatttgataacggagttcagctgaggcctacatctccagggcactgattacaggtgctcctccctgttccagcatattacagcctatcggagttacaacaacacacagccgggcgccgccggcagccgctccctcttgctatgctaagccgccatgcggttacaacaggcatgctgtcagggttacggataaggcataccttctatcctatgacttatgaaatataccgatgaggtataccttcacgcgcacggatcgtttctgtatacgccgttaggaatctatctcaaattatgaaaaatatttctacgagttaagaaattaccggagtcctactcggagggggtagaatctctgctatatcgtgccaatttacatatctccaagacttacttggggtcaaggtaatccacagtataaaagggacccctaaggggaggtgaagggcatcgaatctcattgctaacacacccaccaaagtttccgaagctggagtgcacggagcccagtcgccgggagatctcatcgaatccttcgactacgatctcatcggtaccgtctgtttcgactactccctttgtaatctgttctcatcatcatcaatctcatataaactggactagggatattacctgatagggagcctgaaccagtataatccttttcttttgcctgtttgatgtcgtactacgtagaccctcgttccaacgtacctcaatactcaactcatccgatccgcgagtatccctcgtcgacagtggcgtgccaggtagagggacttggtgctcaaggatctaccagtatgacttcaacacttcccgacagtagtgccatcaccagcgtcgatcaaggagcttctacctcgacaccgctggtgtggactcaagtcaggtccattgactttccagtctataccgttacgccaatctcggctggcccaattatcatcgggaacgagatagatacggcaatgattgagagaaacgacaccccgccgataattcctcccactcaggtggagaacggaacatcgacggccccaacacccgggaggaatcctcaggcggctgaaatttaccccccatgtgaaagatcaaagccgacaaggatgaccaccctaagactgagatcttggtgttctatgcataagacaaccaagcatactcttgaggactatccggtgatacttcacgtgcaagctgaactctacgcgtattgggaacgagggattcaacgtacttcaccaacgggagccacttactgtccgatccacatatctagatctcatgatctcatgtaaacgtggtcgataatactgagacaagtgtgtctgtagcagcgagaacgcccgctcaccagtttcggaatctagacgcgatattgatggaaagtccttttgatccagcaacaaacccagacgccatccagtgggcagagcgactgcgggagaccgtgacgaacctcaatgtcgcatttgccgaagcagcaggaacgaagagcgacctaccgaggacgtggatggagaagacctcatcagaagacatacctccggcgaccgctcacctcgagaagaacgagatcctacaccgccacgccgtgaagatggcaatcttcgcgaacatctgaactgacgtcggcgaagcaggagggattgtaacaacaacgaccgtcgtcgccattgttggtatttcttaacgacattactagaaatataattcccagcaatggcgcagaaatactcctggtatattatggttacagagtttatccgcaagtgcacggatataccattgtagcatttcactcgagagtattccaagggtatcgtatttattttatcacgtggaaagatcatgtagagagaacttaactaataatttatatattacttgtgataatcatattctaagcaggggttaagataatctaagggtagagtgacatacaagcattagctacttattctcataatatattatctaagctaagtggaaagaaaagagaaagataatctattcctatacttctaatatacatagtatatatacattctagttaaccgatatactagctaataccctctattcgatgatctcctgatacttcgagaagccacccttgactgccgagttccttacaacagcccgtcatgaccatacaaccggggctaaatacagacgaataccctccctagggaattaacttaggattataaacaggtgcggaggaatacccgtactgagctatcaccatcaacggcccacctctcatccgcagcatataatcccaaataatgatatcccgtaatctagacaccacgtttaaactaccagatactactctaatatcatcgtcatgacatagagtaattgcataagcaaacattatacccgcaccaaagcatctccgagataagctagccatatattcagtataacatgaatataatgtaaaataggcattcatatactcggaaaatatttcaataccataaatgtatatagaagagtattctaataaaagtacaaagcttacaaaagagaagagaaaagctactagagccatacccaaactcttccgaagacttccgtactcctgatttctactctattcctattccactagctagatactactaaactaaacttgagagaaatgagagagctcttgcttgaggtttgtgagtgaagtgagaaggtgaggggtttatatagcctcccaatgacggttgtgacggttggaatggtcggaaataccctccaactgttattggagctaatacacaccgtccagaagaaacccttcatccagcggcgatgagggaggttcggccgaacctgggaccggcccaaccagcccatggtttggatggcggcctcctctgttattcttctctgcagacttgtgaattttggcccaattgatcatgtcatttctgagttcttggcccattcatacataagtctgattctcgacatcgtccgactgatttatcgtttgagttgacgtcgattctcctccactttatgggtattctctgcaaaaggttagtaaacctaatactagtgaaatattgttattctaacatagttatgcattgcaagcatcactagttatcctctattttggtaatattgacggtcgaaactgatcgataacgaccgtcaacaaaacccctaagcttgaacctttgctcatcccgagtgaaggacgaaaggaaacaaagacttggttattgatcaggagttgctactaggctgcatatctcaaagatacatgtgtaaggtatatgtactctctctcggattaaataatctttggcacgatggcttatccttacccctgattcccacgagacactacttctccttgccttgggcggttgaaagacagaacaataattagagcactaatcacccaatatttattcaactcttattccggaagttttcaaatgattttgaaaaagaaagccaagttcctcatatgattcacagtctctccaagtgtatcaattttggattcctcaccattttgcccttttttgatttctactctaaggtttgatatgtggagctcggtagggatcaaacatagaacacttgcattcacatttattactaagtcaaaaacttagactaaagcagatgactaaacaaactcaagttcaagatcgtgcaatgtgtgtgtggtatatgatgaaagtggtacatgagaaaaaataaagaaattgcttctccttattgcttactttcttctcccaaaaatccttcttttattgattaggagagggcatggctacatttttttaacatcatgctcaagcttgtgagagcataacttgattattattatttttcataaccatgcctttccctctttctctttttttcttttttttttggaaaaaacttttctttttacgagaagaaagcacatgaaagcatggagaatttattttggtggcaatatggaaatggaatggaatattgcttaactcccagtgtaggagtttagcaagtgcataaatacgggtgtatgattttgatcatagagcatgagaagtatctacacaagtctcaagagtttgacaaagtccaatggaatggcaagcaaccaaaatgtatatggtttaatcatgatggcacatttttggctttggtaggaatttttatcaaatgagaaactctcaattttatcattttgaaaagcagaacatccggaattcaagccaaactagtatcaggatcatagcaactcttatttaccatctcatatcttacaacaacttagactcagatcagcaagtgcagctcatttacctcaggttttcagataattgttggctacttatatttaaccttttgagagagcgcttactatgaacccatatataagagatataaaccagagcaactattcatcatttcaacaaagagaactatcttgtcttacctagcatgactcaaacctatcctatctttttggtatttttctattttgcaaatttttatgttattttcaagttttataagatgcaattggaaagaaatatgcaattggaaagggaaatatgcaatgtgatacaagttacctcagtgggagagagatgtctccccccccaagcttagctttcgctcagggtccttggtaaggattgaacccctggaagcggaagtacgcttgaaggtcatcgtgctgttgctgcattatgttgttgaagtttgcgaactgagcatcagcaaattgttgccattattgtgtttatttcacaggagcaattttgatctttctaaccatggcaaacatcataatcaattcatcccccctaatgggtctaagatcacctctagaaaacaaagtcatagcaatccatttatgcatgagcctaagtgtagcattatggatatcattcgtcctaggtttcttgcaaattagagcaccagaaatatcttcccaaaacctatttttctcgaacccagaaattcctttctgaagatcgattttacaggaatcgtgaaaaccaagatgtgtgcttaagcctttccatgtaagtgtatactccttatggaaaaagcgaaaggaaattacatcttctatttctttcaaagtgcacagaaattgcaaagtaagcaaacgagaaccaggctcatctaccacaacaaatctctgccaaccaacaactttccaaatagcacgaaattcaacatctatacctatctttttcagcagctccggagagtattctcgtgtgtgagcatactcccggtcgctcggcatgtagtaggcttgtctttcccgatcaccaacaaggccgaggtcggtgccattcatgagtcatcgcggagcttcggcgtcttccatcgagatatcagctgatgaacgagtactagactcgtcatgatgacttgatgaagagccggaccccttgaacagatgagacaatcgcctcctcattctgcacaatggagcaagaacagactaactcgatgggggttagaatagcaagagtttcacctgccggttagtttcaccaaagcaacttgtatatatgcaattagtgtttgaatttgagggaaactatcaaagcttcaatgaacttgagagcaaattttgaagaggaaatgaaaatgtgttgaaatggggttgaatttcctctctcggtcggctggcttttatagggtacccacaacggtcataaatgccatgtggaccccattagcagttcccctgcaaaagttggcacgtaatcgtggcttggcgggttcgcccgaaccacccctagtgggctcaaccagccccactttcgaccgttggattccaacggtcaatgtgatcgtggaacagtaaattttcgttgaaaactttattttggctttctctgaaaaattcatctgaagaatttcctcaaaattcaaaaatcataaatacaattttgaaattcaaacatgtgttgatgcaagaattaaattgttgaaaataaatatgcggatacataccaatgtacctgttgacaaaggtcacgtcatttaaagtccgacgtgcaagattgtaccttcttctgattcagttcgtggattttccatccgtctccggaggtgatggagcaggcgtctttggcttttccttccacaccttccttgtcttaggtgcggaagacgtcttcctctgagtcggctgctcttgcttcttggccggtatggttggttttaccggcgtcctccaataacggttcatgggcatcgttgtttccttatccaggaaattttgcatgaacttcaccaggctatccgtcttgggtggctccacttcgaccacttgaattttctgtgggttcgccccgtactttattctgaccatggagcattgttccgtcctcggttgaaactcaaacttttcctccttcccgttgatatggaaacggatactccctgttcccacgtcaatgttggctcccgcggtgctaaggaacgggcgccctaggatgagtggcgtctcctttgctgtgcccatatccaacaccatgaaatcaaccaggatgaagaaatcccgtatcttaactggcacatcttcgctatccctgccgggtaacggactgatgagtcagccagttgtaggcgcatcggtgtcgatgccaacaccgtgaagttgagcttgtcaaagacgtcctttggtatgatgctgacactggctccaagatcgtgcaagacctggtcgaactgttgtgccccgatcgagcaggtgattgtaggacacctcggatccttcttcttctccgggagcttgtggagtatgacgttgctgcattgctctgtcagcttaaccacctccgttgttaggagcggtctcttgttgttgagtatgtccttgagataacgggcatatgttggcacttccatagcgtccaacagcagcacattgatgtggattttctgaattacttcaacaaaacgagcgaattgttcgtcaactgacggtttcctactccgttgaggaaacggtagcaatcgtgtgtcacagtactcctgcagcatggtcttctctggctgaacttccttgtcagccgagtcactagatggcgcttcttttgcaatcccgttagttcctgcagggttaggatacggcggatcacgagtggacttacctcccctcgtcgtgatcgccttgacattctcaacggaggagtcaggttgccccggaatcctcccagtttcatttgtagggactaaggatgctaactgagctagctaggtttctatcattttattgaagctcagctagttttggaaagcagaagcgaagccatctaacttaacatttatgttctctaggatcttgtcattggccgcaagctttttgcttagtgcatcagtggttttagcttccacaaagaatagatccatcaaggagggctggttagaaaagttaccgttgttgttacctccttgataatatgggcgtggttgttttcaccccagatctccttgtggacagtaccgttgttgttgttgcccatgtatatcgcctcctcacgggtttccgagcagtcattcctagagtgacccgtgttgctgcagacctcacacgtaacgtgtgagtccaaagccttgatggtgccttgtagccgtttgtcgtggtcgtccaatcgtttcattaggaggtccagcttggcagcaagcagttccgtctccttgacggtgtgcatgcctcgctgacgggtctggagtcgttcctcgctccaacccatattgaagaccatcttctctattaaatcaatggctcctcgaaccgttttagagaagaatgctcctctagctgccgcatccaggcgatcgcgggacatcggggtgagtccattgtaaaagttctgcaggatcagccagtcgtccatcccatgatgaggacaggtggccacatactcctgcagtcgtccatcccaggtgttggcagcagcacggttgccatagaaccactacttcgctctcccgagaagggagaaaggaaacagccttagcctaacggcgtctggactgacgcccttgatggtgtacgtgctacagatctccaagaactgctgcagatgagcattggcatcctcgttaggcttgccatagaatgggctagcctgcgccatcgtgatgaggttggacttcaagttgaaatccatgtctcccatgttgatttgcggcccaatggccatattgttagcagagagagcagcgaactcgcgaagggtcttgtcagccatagtcttgaaggttggttgcgctggtacggctggtttctttgtcggtagagttttctgtggagcaacgactcgcggcctgacgctctggaagaaagcttctggattttctttgaagttctccggcaagttgaaaccagtcatgcactacccagttttcacaacaaaagtaaaaacaatcaaggttagcctgcaaaggaaaatgattatacagaggtaaatataaaatattagttcaggtaatctctattatgaatcttccccggcaacggtgccagaaatgcttgttggtatttcttaacgacattactagaaatataattcccagcaatggcgcagaaatactcctggtatattatggctacagagtttatccgcaagcgcacagatataccattgtagcatttcacccgagagtattccaagggtatcgtatttattttatcccgtgggaagatcatgtagagagaacttgactaataatttatatgctacttgtgataattatattattaagcaggggttaagataatctaagggtagagtgacacacaagcattagccactcattctcataatatattatctaagctaagtggaaagaaaagagaaagataatctattcctatacttctaatatatatagtatacatatattctagttaaccgatatactagataataccctctatccgatgccctcctggtactttgagaagccacccctgactgacgacttccttacgacagcccatcatgaccatacaaccataccctccctagagaattaacttaggattctatataggcctggaggaatatccatactgagctgtcatcatcagcggcccacctctcaaccgcagcatataaccccaaataatgatatcccgtaatctagacaccacgtctaaactaccagatactactctaatatcatcgtcatgacatagagtaattgcataagcaaacattatacccgcaccaaagcatctcccagttaagctagccgtatattcagtataacatgaatataatgtaaagtaggcattcatatactcggaaagtatttcaataccataaatgtatacagaagagtagtctgataaaagtacaaagcttacaaaagagaagagaaaagccactagagccatacccaaactcttccgaagacttccggctcctgatttctactctattcctattccaccagctagatactactgaactaaacttgagagaaatgagagagctcttgcttgaggtttgtgagtgaagtgagaaggtgaggggtttatatagcctcccaatgacggttgtgacggttggaatggtcggaactaccctccaaccatcatttggagctaatccacactgtccagaagaaaccctgcatccagcagcgatgagggaggttcggctgaacctggggctggcccaaccatcccatggtttggctggcggcctcctctattattcttctctgcaaacttgtgaattttggcccaattgatcgtgtcatttctgagttcttggcccattcatacataagtctgattcttgacatcgtccgactgatttatcgtttgagttgatatcgattctcctctactttatggttattctctgcaaaaggttagtaaacctaatactagtggaatattgttattcttacatagttatgcattgcaagcattactagttctactctattttggtaatattgacggtcgaaactgatcgataacgaccatcaacagccatcactccccttctcgtcgtgaggacggtactatgcaccgacaacaccatcattgctctccctcgcggtgagaaagagacgacggccgagggaatacccccaatgaagatcgagacagtcgcctcataatgaccgacacaacaacgacaaaaaccgagatcatgagaataatcaccgaagacaggacagggacggttataaccgacagatccttccatctgtgacggcccataacaagactggaatttgcgggccgtcagaaggaagtaatctcaatcgggctgaagtttcgcccgattgagatatggtcgcacaaccatggtatatcggcataaaactaaagcccgtcacggatgacacttatctgtgatgggctatagttgaggcccaattgagataagggttccatatctcaatcgggccctaaaagaaacccgtcacagatgagggtcatctgtgacgggctccaactagaggcccgattgagataagtttagtgcccgttacagatgacactcttttttgacgggcttttatgaaggcccgatagagattacttgtatgcccgtcacggttgattgttgtagggccattacagatatttgttgcaagtataaataccccctcaccacctagtgtaactgtatgccactgttcactattttggtgggaggctgtagggggcgattttttgtcatttttccaaggaaaacagaaattaaattcccaaaagtgatcaaaatggatcaatcaagtgagtaatattaatcattaattgagcaatttcatcacatcttacttttgcaatactgatcttataatatgtgcctctaattcgtttttttttattttgtagcaattgatcgaagttggatgtatgcaaaaaatttgaaacgtcattctacggagtacagaaagggcataataaattttatgaacgccgcggaggaggatcggataagaagaaacagtgattacaggtgttgtccatgtgcagattgcaagagaatatgtttgatagcggagaggacgtacacggtcatctgatacaacgaggattcatggagggctatacatgttgggtgaagcatggagagcaagaatgaggaagtggagcagcagcagacagaagtggtgcgcataatcaggaagatgaagatgagcatgacatgtttataccttctccattgggggtgaaatggttgatgtggatcacgatctgctgcaagacatgttacgtgacgttgaggacccagcccagaatgagagagatggaatgaagttcagcaggttggtcagtgattccgagacgcctctgtacgctagatgcaaagcaaaacacactaagttgtcagttaccttggacctaatgaagctgaaggcaagtagtggatggacagacaagagtttcacagatcttttaggaattttgaaggctatgcttccagttgagaacacattgcccgagacgacatacgaagcaaagcaggttctgtgtccactggggttagagatccgtagaattcacgcttgtcccaacgactgcatattgtaccacaagcaatatgcggacttggatgcttgtcctgtctgcaaggcttctcgatacaagcgaaagaaaagtgctgacgaaggaaataagtcaaagaggggtggtccggcaaaggttgtgtggtatctacctatcattgatcgtttcaagagaatctttgccaacccgaacgaagcgaagttagtacgttggcacgccacggagagaaggaatgacggtatgcttagacacccagcggattcgattgaatggaggaatatcgatcgaaaacacaaagactttgctgccgaccctagaaacatgaggatatgtctatgtacggatggcatgaatcctttcggtgacatgagtagtactcacagcacttggccagttcttattgcgaactataacctcccgccatggttatgctttaaacagaaatatattatgttgtgcttgttaatccaaggtccgaggcaacccggcaatgatatcgatgtattcctggagcctgttatcgacgatctagagattctttggaaagaaggtgtggaaacttgggatgcatatggtcaggagaacttcaagctaagagttctattgttctgcaccattaatgactaccctgcactcggtaatctttccggacaaactataaaaggaaagaaggcatgctccgattgcaaggaacatacacgaagccggtggctgaagaaatcacgaaagatggtatacatgggtcaccggaggtggctcccgctacgtcacgcatttagaagaaagaagaaaatttttaacggtaagagagaacttcagcctgctcccaaagatttgtccggtgatgaggtccccaatatggtcaaggacaaaagcaatgagtttggaagaaaagaaaacgtagcaagacaaaggagaatggtatgtgaaaaaaaaatccatattttggcggctaccttactggaaaaatcttgatgtccgtcattgcattgatctcatgcatttagaaaagaatgtgtgtgagagtttggttagcctgatgttgaatattcccgggaagacaaaggatgggttgaacgcgccccttgatctataggacatgaatattcgcagtgaactccagcccatacgagatgcagagacaggtaaagtgtacctccctccagcctgccacacactgtggaaggatgagaagatcgcaatgttatcatgcttgaaggatattaaagttccattgggctattcagcgaggataagtaagtatgttaaattggacgatctaaaacttgttggaatgaagtctcacgattgccacgtgctaatcacacaaatcttgccagttgctatcagaggcattctaccaccgaaagtgcgtcacacgatccaacgtctgtgcgccttcttcaatgcaattggatagaaggttatagatccagaagatcaagatgggctgcagattgatattgtgaataccctctgtcacctggatattttttcccactgtctttcattgatataatggttcatctccctgttcatctggtgaagcaaacaaaactatgtggcccagcttttctaagggaaatgtggctgtttgaaaggtacatgggagttctgaagtcatacgttcgtaacagagctaaacccgaggagagcatcattgaaggttacacgaccgaggaggctattgagttctgtgtcaatacatgtccgatgccgatcctatcggagttcctgtgtttcgtcacgagggaaggttgtcaggtgttggcacaatcggaaggaaaagaattaggcccgatgaagcgtcgtacgcgcaggttcattacgctgtgctccaacatatggcagaagttggcccatactttgaggagcacttagcgaaaatccgagatgagaacttggggcgatctgatgcatggattaacaaagaacataattctcggttcaacgaatggttcatgaatcgtgtgacaatgtccacggatgtcccaaatgagacattacagttgttgggaatgggaccgtcttggaccgtagacacatggcaaggatacgatataaatggatacacattttacaccgtcaaacaagatgacaaaagcacagtgcaaaacagcggcatccgtataaatgcattccaggatcaagttgggtcaaacacatactacggccgcattgaggagatctgggagctaaactacgtcaagttcaaggttcctttgttccgctgccgttgggtgaatctacgcactggtgtcaaagccgacaaggaaggtttcactttagtagatctatctaaggtgggatacgccgatgaaccgtttgtacttgcgaaacaggtcgagcagatattctacataaaagacccttcaaacaagaagatgcacatcgtgagggatggaaagcgccgaattgtaggagttgacaacgtcgtcgatgaagaagaatacaaccataatcttcatgtaagacctcacattgaccttgacgatgatccccaagagcctgtggcatatgctcgttcacatcatacggaaggcataaccttgtgaccgatggatttgtacttatctattgtaatgaatgaagtattttgttttattgcaaagacttgatatgtgtagtcattaatatggctaattttgttttattacaaatgaccaaaataaaaggtgtagatcctgattagaggatcaactttgttgttgaccatattacaatttgaaaccatttagtatttacaaatgctgttaattagatttgtcatattgtcaaaatcaatttcaagctgttggaaaaaaattatatagaaaaatgacgaaaataaaactagtagatcttgaaaggctctacaactttgttgttgaccatatttccatttgaaatcatttactatccgaaaatgtattatagctaataaaatgaattattacacatcagctatatattttgcactcacaacaaataaaagatggaaaatgagtcatcggtgatgggccttagtttacagccgatagagattaatctatttcaatcgggctttgcggtagggcccgtcacagatgactcatcggtgacgggtgactcatctgtgacgggccctaaaataatgcccgatagatatagattaatctctatcgggcttgaactaaggcccctcccagatgactatttttccatttt

SEQ ID NO: 69127 - DNA, 5388 bp, Oryza sativa
attttgatcatttgtctatataactttgtttccaacagcttgaaattgattttgataatatgacaaatctaaacagcatttgtaaatattaaatgatttcaaatggaaaagccataaacagctaacttgtacagattatcaagatctacaacttttattttggtcacttcttcatccgacaaagtgatagtaccaatgtttacaaaattgacatatctgtgttgatatctataaaccagatgagagaaatgtgatttttgtgaatagtataactatcactttgtcggatgaagaagtgactaaaataaaagttgtagatcttgatgagaggatcaactttgttgttgaccatatttccatttgaaatcatgtagtatttacaaatgctgtttagatttgtcatattgtcaaaatcaatttcaagctattagaaacaaagttatatagacaaatgaccaaaataaaagttgtagatcctgatgagaggatcaactttgtttttgaccatatttccatttgaaatcatttagtatttacaaatgctatttagatttattatattgtcaaaatcaatttcaagctgttggaaacaaagttatatagacaaatgaccaaaataaaagttgtagatcttgataacctctacaattttgttgttgaccatatttcgatttgaaatcatttactatccaaaaatgtattatgactaacaaaatgaattattatacaccagctatatttttgtactcacaaatataaagacttgaatggaaaaatggaaaaatagtcatcggtgacgggccttagttaaagcccgatagagattaatctatctctatcgggcattatcttagggcccgtcacagatgagtcatccgtgacgggcctgaatgtcatctcaatcgggcattagtatggagcccgtcaccgatgagtcatctgtgacgggccctaccgtaaagcccgattgagatgactcatcactctactataactagggtttctcagatcggatcgaaaatttttctaagtcccgctacactttcctgcctacttagaaccctagcgccgccgtcgtcctccctcgccaagcctgccgccgtcgccaccgagcccgccgccaccgccgtcgtcctccctcgccgaacctgccgccgttgccaccgacgccgaggccaaggccgccgcctccctcgctgagcccgcgtccgccaccaccgagcctcctcggccctccattcggaccaccgccgcctcctcaccgacgacccccaccgagcccgccgccgccactaccgagcctctacaccgaccagaccggtgttggccttcctcatcgtcgccgcccgcgtcctcaccgacgcacgtcgccgacccccaccgagcccgacgccacccgaccggcgtctccaccgaccggcgccgccctccaccgagcccaccgccgccgccgcgaactcctcctttgccgagcccgccgccgccgccaccgagaccgctgcctccaccgagcccgacgccgcctccaccgaccggcgacgccgtccaccgagcccggctccgccgccaccgagccccaccggccatcctcaggtgagtactccatcgcgccgtcctctgctaactgtgaatgacatgtcattgaaatgtggatgtggatgatatgtgattgaactgtgagtgagacatgtcgatgttgggatgaaatgtggtgcatttatgaattttgtgatagatgattgtagtgattgatgaaatgtatttcatttaactttatttatatgcaatgtggttcatgttgggatgaaatgtggtttatttatgttgggatgaaatgtggtttttttatgttgggataaaatgtggtttatttatgtttgggatgaaatgtggtgcattaatgaaattattgtgaaatgtggttaattttattactgtgagatgtgcaatttcgtttatttatacgtggtgcattaatgaatttagtaaatagatgaaatgtggttcgttttattactgtgagatgcgcaattttgtttatttatatgtttcatttatttttataagtgacattcaattcattgtaatagattgtagcactcaattgtgtatttttgttattttgaaaaaaagtagacgatgtctcagcaaggcgaaccaatgtcgacgacaactagtgggtcctcaagggcacgtactcctaggacaggaaacaaaatccctaaggaacggttccgcataatagcggtggatgccgtagggttgtcgacatctccaaggaaaatatggagccgatttaggtctatctgcggggtcatagggaggcaaaaattcagtattctgcaagatgacatcaagctcgtgccggccgcagagaaggacattgcttggctaacgtttaaggagagcttcgattatcctgcggagcatgatgaccgtcttatgcgggctgctttcaaggttatgggcaatgcttggaagaacttcaagactaagctagtcggcgagttcgtctacaacccgacgaatccagatccaagagagaaattttcttggatcatggaacaggtctgggtggaattccatgcgaagaagtcgacccccgagtccagagctagaagcgaggcatatcacttgctccagaccaggaaccagcatccacaccggcttggcaccgccggatatgccggtaaggaaaaggaatggccgcgtgaggatgaagaagcggaggaatcgaacacgccactcgtgtttggtgatatcccacaccctcgggctaggaactgggccagggccaggtaccagaagaatgatgatggcacaatcttcatgccaaatgcagaagatcaacgagtgtacgaagctatagtaagtatctagtcaaactagatgtttgcattgtttcccatcgtgcagtttatttaaccccactaaattgtaatgcagaaggagttggttgccgagcaacaaccctcgcaagaggcctgctctcaaagacgcgaggacgacctcctcacgaaagtgttgggcaacaaggaacaccgtggacggacacgaggcgttgggtcttctgttccctggaagtatggatttccatactacgcgtggcagtacaagaagcggacttccaacaaggcggagaaagatgcatggcttgaagccaatatccgggcgtcgataagagctgagctgacatctgaattcgacgaaaagctcgagtcaatgaggaccaagattaggcaagagatccgagaagagcaacagaacccccaggccaccgctgctgcggcgcacgaagagttaggaagtcccacccaaaaacgcagcagttgcgcatcaactgagttggcggaaaatccaacatcggtcgacagcaccgtcgaccacataatggtaaaagtgaacttactcaatacatgaagacttaacgaatccatattatatgtaatattctaaaaaaattgattaatctatcgcaggaaccaacgagctgcaccctcatagttagggtgatgccgaccttcacggttctagcagccgagggacttgcgtacaagccgaccccaaagacaagagtgcatggagcgcaactcagggccgactgtgcaaaagttcaagtcgactcggtgaagcccaaatacgagctgttccctctgaagtatccaccgaacgacgaggtcctctcactaggaaatgcccgtggtaccttcatccaatggcccaaggacctcattgagatcagggttacagcgaggccaaacactgcaccaggcggtcgtctaccaaagagacccacccctgctccttcagcccctcctgctcaagatcgtcatgcacaatcttacgatgtgcagttgcagtacgacacggattttggggaggaccgaacggaggccgacagcaaggcaattcatgaacccccaccgatgaagaagagcaggaaggcacactcttcccctcagagaattactctcgataaacccgaagcaaagaggagaggaaggggaggaaaggtgcaggcctcgcttctagctccaaggaagctagatctgggcaagggccaggaagagactaagggcaaagaggtcaagaagaaatatgtcgctccacaggagttccgactaggcatgccattggttggagatgacgtgcttgccgcaatgggcaccgcttgcaaggaccttcacttatactacatggagaaatctaacgccaggaagccgaataaagccaccgatatccttggagagcacgatggaaagccattccttggtccaacaaattatatcatggtcaacttcaaggatcttttcgacctctacaggctccgagcggtggacacaagcctcttaagtgctactccttgtaagtattgtcgcccaactcaatctggtaataacaatcggtttaactttcttacaagatcgtttatcctgtgtgtaggttaagttggcaatggtgtcagaagcatgcaccggaaattgccttccttgatccacaagtggtcattgtcacaaatctccagaatgaccgtcaaggaatggtcaactacatctatgacaccttatggtcccgccgagacaaggagtacattatgtgcacctataatcaatagtcatgacacattccttgagtacttaattaactttcactatattaatgccgcagtgcccattggatccttctggtcataacacctaagtggagtacatgtcactacctgaactccagaattgataagaacgcatatgatttgaccccaattcaactagcgatagatgaagcgtgggcccaatacgtgcaaagaggaggcctcaggaagataggacatgacaccctcatccacaaaaaagacttcccggtgaagcaacaaataggtgaccagtgcggattccatgtgtgccacaacatgcgccttctgtatagagaaaaggtgaagaccttggctgagtttgaggtcggtggtctcaattatgatagactaactacattttagtacttatatatgatcaatcaactaatctggaattatgacaatgtagggcacaataaccaagtctctgcctaccagctttgggaggttcacgaggagatagccagcttcatcctccatgaaatagttaaccccaaaggaatgtttaggcttaaactaaaatgatgaacaatgttgaacttctatgtttaggcaatgatgaacacttattatgcaattgtgatgatgtaactgtgatgcttatatttatgtatatatttcatatgtttatgttaaaacttgctaaataaatatttgatctaattaactcggttttgcaggtgaaatatgataaatatttgaatggatgtgaaatatgtgaatggatgtgaaatatgagatggccgggggtgcag

SEQ ID NO: 69128 - DNA, 3705 bp, Oryza sativa
tcagtagtcatctgtgacgggctctattttaggcccgattgaggtcatcagtcatctgtgacgggctatagtttaggctcgattgagatgagtatcatctgtgacgggctctagtttaggcccgataaaggttagtagtcatctgtgacgggcgctagttgtggcccgatagagataggtcatctgtgacgggctatagtttgactggtcgtctgggtcaaagctatcggtgacgggctttacttagggtccgattaagatatattcattcgtgacggccgtttgcctgattgagataactcttcacatcagtgacttctagcctgtgacggacgctgtgcccgattgagatggggcttaccgcccgattgagatgagggtatcctttctagtgtctctgtagaaatatatatatggatctagttatttgagatatgtcagatctatgtgtgtggatgagatatgtcagatctatgtgtgtagatgatgctatatgggagtgcaatctgtgggagtgttcaaaaattattttgctttggtcgatttcattaacaaatgtcaaaggtttctcaaagtttttagaattttggatcaaactgtaacaagttttagaaataagcctaaggatgatgatgtttggttggatgtatcattttcgacatggtgcatcgaggaatgattcaaatacacagaaatgaacacggctgcgatagagctctagatttaagttactagggatcaaattttagctttcctaaatcaagttcatgcatttttagttttaggacagcaagattgaaagatattcctatgactgttatggttattgagtttgatattagagatggttcgaggtctctaaattcttgcatgattgaagctaacctatcatactaccccccttaaaatttaaaagttttagcaagcaggattgtggtatggaagatgaacaagctaggtggtttcaggtctgtcctaggtgtcaatctgctgaaaatagaagttaatgaccaacctagaaggcttgtaaattcaaataaaatttatattcaggttgcttacaaagttttctatgttctgggaaggaattgtgatttttggacaagtactttattttattcaaaaagaagaagacagatgatgcagttctggaacaggttattatctatggttgttgaatttttatctcttaatctacaggtgtaaaaatcccacgaaaaatcatgaaactttcctgacaagaatacaagttactgaccaaaggttttcattttatcatttatggtttaggagatataaaattgttaagtatgcaacctacagatttcagaacctgactatgcagactatatgaatttttacaccttgatgcagaggttcaaaaattctaccaaaattcatgatgcttcatatggtagtacactaactactgctaaaagatggcatgcttatcacttatggtttgggctacaaaatttcgtgaaagttgctggctataaatttcagaacacgtgcaactaatgcatttgaatttctatagcatgttttaagtttgataaattaaccattccatcataacatgaaaccaacaagattcagaggctataagatttttgggtggtccatctaagcattcaatctagtggtcataacacaacaattccatcctaccccaaatctacccattcaaggtcataacgaaattttgaaatgctgggatagaagagcataaaaaacccatcaaatttcaccatggtacagaagtaacatgtttatgtgatacaacctaacatgtctatcaaattttaatttatttaatcaacttcaaaacctacactctatatgccattccaaaacccgagatttttgcaaaaccgttctaatacataggagaattttgcaaatagattttaaaacttttcaaaacactttggtactgatctattgcgattaataagcgttttcaaactcatttttacagaaatataagctttcaaaaggtttcggtcctatggaacaagataaggagttttagaaatcaaaacatgagacatagggaaataatatccagagagggataagatataaggttaaatatgattttcgcaaataatttgtagctgagagcaaagccctcaaaataatttttttaagaatcaattctaaacgaccaacttaaaggggctcctatagtcggtatttgctctgataccatgctgtcgtaggctctccggaccttctattataattgggagataaagtgaataattcaagtcatcgagcaatcataatgaaacatccgacgcctcgagagaggaatattggagacattgctgggcctttagcctgccagtcaacttcagcctgagatgtgcccgtcaaaccactcgaaggcggcgaccatatgtgttacacattcaggagacttgacaaaaatggctaaagagctacaacatctcaaatattcctaactcatactcatgtgaatctagttcccaggaagtgcactagattcacactttcatcttaagtatgaatatacatagcaagatacatctaaagcaaataaaactcagattacaactaataaatagatacataggccgaccggccaaatataactatatcagagaacagcggaagcttgactacccaatcctcaagcacaccgactaggggtttaccccattaagttcacatcctagaagaagcagtcgaaacccgcatcactcaaattaaactaagcctattcctgcaaaacataaattagacaaaacatggcagagcactatcaaacctacatacatgaaagctctatgtcaaaggaaaggctatttgtagtctcaattttcagcataaagcaaattttagttcacaaaccatttgcaacgtaatttaagcaaaacattttagcaaattgtgaagcatattaatcatggcatgatatcaacataaatagatagacatcattcccttacaacacaacgggaagtaaggcaatcatatcacatatatcaatcttatcatcaactcaaatcatttagtttcagaaaaagtacgaattaccgccccccccaaactatcgcggccgtccaaattacccccctgaaccacaaaaccggacattcttcacccctaactatgcaaaccggacgaattactcccctcgacctaatccacggtggttttggtctacgtggcgtacgcgtggaagtccagtcagcaatttatttattgaaaaatactgggacccacctgtcatactcctattgcacttttccccctctctctctcctctctctcactcttcctctctctcttctctcactctctcacgcgcacgcgcacaacagcaggcggggggtggcgagcggcggcggggtgtggtggcagcggcgaggcgaggcggcggtggaggaggtgaggcggcggcggaggagacgaggcgaggttgtcccatgggttttttctggttgtctcatgctctcacgattggtcagtgtgtgtcgtgttcgatcgatctacatgtacagatgatcgatcaatcttcgaatcgatcgccgtgtttttgttgtgtttggtgatgagatgatggttaagtggtatggttagtgtgcgctaatggcggtggtttggtttgggggtggttgtgtgtgtgtggttgcagggtggagagcttcatagagcaacaggagggctgcagga

SEQ ID NO: 69129 - DNA, 14711 bp, Oryza sativa
cgctccccgccccccgcttgcctgtgtgcgcgtgagacagagagtgagagaagagagagaggaaaagtgagagagagaagggagagaggaaaagtgcaataggagtatgacaggtggggcccacctattttttaataaataaattgctgactggactgccacgcgtacgccatgtagaccaaaaccaccactgattgggtcgaggggggtaattcgtccggtttgcatagttgggggtgaagaatgtccggttttgtggttcaggggggtaattcggacgaccgcaatagttcgggggggtaattcgtactttttcctttagtttcaaaagcatttagaaatcacaaaattatacccatagcacatcatcatgtcgctcatgaccatgagcacggctaatcgattagtttttagaactctgtagagtttgtacagctttacccacaagatatgaacaacactctagtttgttttgtgctcgcgatgcaccaccacactctatacgttgagtgcggtctagaggtcataacgaagcctttacactacttagaatctagccttgcaccagcacgatacgtgttcctccatcttaggtatacttggaaatatgtctagaaccgttaagtggcgggcccacgccttaaacttaatgccgtggtggcggacacgacgggaacccaccacgtggcacaataccgttgtattggacagacttagacgcccatgccgtgaggtggatcagtacacccctcacggaacacacacacacacatagggaatgtatcatcctatgatcatcacaaacacacactcatgggtagttcctctaagttatcgacaaaattctcagaattatcgactaactcatacacaccggcctaccagaatgcaaggctagtcctaaatagattaatcagcttaggccatcccatactagcacatgtggatgtacggtaaacataatgggtgatatgttcggtccttaatcgactcgggcgaatactccccctatcagtatgcaactaccaccatatgcataccacatgccgctcaagtctaaaaatcacatttcatctcattttatttcacaaatatccagcgaacacatcgctgcccatatcacataaaaaggttttccaaatagtataataagtgattccatagccatgtttttatttattactaagcaaggctaagcattagcattttataaaagcttaacttagctatatgagcacaataaaagtactctaattattcctaaggttcaaaacagcaagggagtgattttcaaaagggttcatgcaaattttttttttttttggtcatatctacaatccagtttcgatagttcgaattacgcatgcaacttttacaatcaaaacatttagcccgaaaacatgggattcaatgtgttcaaaggaagggcaacacttgccttggttgatataagaccttcttgagatcagctataagaccaatcacctcaccggtaacgaattcaccgtctaaaagaaataacggtaacgataaatgccaaaacatgtaaaaatctaaaatgctctaaaatgcatgagtttactagtgtggttaggtactggtctaagatgaatttagatgaaagaatttatattttatcactttgcattagagagttataaattttcaagatgtaatactagcactagattaattaagctctaatagttcttaggtgcattttaggtctatgatttatgaattgttggcttgctgcagtgaaggggatgttctcaggtgttcaacaaaattggtttcacatttttgtagagttgggatgattttactatgaattttacaagctaagtgatttattatagtagttgttaactatttcaaattttagacaagttttgggtactgaaagtgtcatattttattttataaaaactaaggtcatggttcttataacctaacaaactttgagatctcttcctttagactggtattaaattttatatgaattctagaagtttctataccatcttttaattttaattcattattcaaatttgagtgatgtttttggatatggtttcttctacagatttatctacagaacaaatgtatatgcttttatcaaactaacaaattttagttcatctcatttggagttaaaataaatcacttatgggttttatagtttctagattacactatactagttattttaccaattaaatagttggtgattattttaatacagaaagtatcaagttttagttcatgtaaattaagaacatggttttgtgagaatactggagcttggttcactccaaattaagttaagatgaattttatatgaattttctaagttggagattgctctatgttcattatttcttatgtgaattattagagctatttattctactgcaagtgccaagttttatgtttccatattaaggttcataactggtgattctacagaaatttatttcatccagattggagctaaaatgaattttatatgcaatttacaatttaacctatttttctgttgattagatattcactaaggcattttccttatatttttccagattttaaacacatagggcccactggtcagtgagagatattttgcagaaagattcctagaggttctagtaataggtcccgaggtccctagcacgttttaattgaatcttcattaagagttcttgagttttaatctatttacatgcatgttcttgggtccacatgtcattgtaaggttatttgaagttacaaccttaccagatctaaacattcagtaatgaaagtccttagtgcctaatccaactggacccacatgtcagctagcctgagaggaggaggacagagcagcggcgacagcagcggcttcacagcgtagccggcggtgaacggtggcagatttcacgatgcgaccagaatagaaaatgcagagtggaacatggcgaagctaatggtggtggtttcgctggctgcggtggtcggtgtcagcgatggtggcagcgcgagcggcggtgagcttcggcatgcatgtgcatgtcgagctcggtgtgaatgagtgtatgcatgtgcctctacggggttgctggaagcttactgtgggttggacatgcgccggtaacgcttgaatggcgacgacggcgtgaaggatgctccggcgacggcaagaaacggcatggcaacggcgtcgacccccttccagactccggactgccaagaagagaagtggaacggctcaacgacaatctaaggatgctacacgaacgaggaactgcgccgaagctcacccgagagcgaggaacggacgacgttggccggcggccggacttgaggaagaaagagaggatctccttgttggctgctcttcagcgcgattcccttcgcaggccttatcctagaaccttggcgacgctcatggcgcagcggctaggtcggagatgcaccggatcatcgggaacggcgaagcgaccgacggcggcgctctggacaccgaggacgccgacgagctcgacggaatgtgtttgatccatggaaaggatctatagatcacgttcttatgattagattgtggcgaagctcaccagagaagacatacagcggatcaaacaccttcgggaaggatgaacaagtgggtgttctcggaaattccgagggagttttctctaagttcttccttggaacatgatgaggaaagtgggatgagttatctggtgaagtggttaatcaaagaatggatgttgtgctggcaatggagagataggtggcatgatatggctttgacacgatttttggagagaggatcgagtttagggctgagattcagcttgtacttcagttaacctagtatgagtggctgtctagtggccccatatagatgtttcccagaagaaatgggaggtatggtgagttcttcggtgaaacttggactctaactctctttctcccccactctctctctctttgatgaagtatatatagattataaatgagtgatcacatgagtagatggctggtacatgggtgacaaatgggcccatgtagatatactctaggtttatatgtgtggtaaggtaggtgagaattgtatttttaactctcctctcaccttttgagaaatgaaatataaattaattgagaggtgtgaagatgatgggttgaccgtgtgttaacagtgaaaattggtaatcgacaaaggcgtcatcggcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggcatggcagtttatctattaattaggaatagtttgttagtttccttttatctttagaaaagtgtgtttagtgtccgataaggactttatgttttccttttatctttaggttagtttctttcttgtccgataaggacttgtatcaacccatgggtataaatatgtacacccggggtctatataatctatcttcacgatcaatacaattcggtgcattgccaccttttaccttttctactttattttatcatccggcgggacttggcacctgacgcggggctgcatcgatgttcgatctccggcgaaggggtaagtccaatgttccatcggcctaggcaattgtctcatctacgtcagcgtcgttcaagactgcatcagtacattcgacctcttggattgctctggtttggacatctaccaccctgaaaatcagtcaacggcttgattgcctaggtattgtcagccgatgggattatatgaccagcaggaagttgaatttgcttctctcggagtagtagatcaaagatcttgtcagctttagtcatatcaaagtcatacttctcctcttttccagaactttttacccattgacatggtatgacctttttactcctcatctattcggctgcagctatttcagaatcgtcctcatcatcatccgacccatacatgtacagacaaacatgattaaccttcttagagcttttcctaacttctgcagatctatgctcatgcaaggttaccttctatcacagcctgaatttccgttttaggatttataaattatttaataaattattaatataatttatattaaatgttcattaatttacaagtgaagttaaatgtgggaaataaaatttcctaaatataaagcatggatagatttaatttgtattaagttctccatgattaattatactctctgaaattttctaagatttttcggagctcaattcctaattttaataatacaaagaacatttcagtaattattcacatattaaattaatcattaaatgagctggtttcaattttaataaatactctgagtgttcaagtatgttcaagatttttcttggaattatttgagcattggaagtatttttaacaattgaaagatcatctcattggttaatttattttgaaaagtaataataatcctcttcctagtcttgggccgaattcagcccattccattctctcctctcagcccgcagagaagtctgtttgacttccctggcgctacagtactctatcttcaacctccagacagagaccgagccgtcccaagcctgtgcagccgtgccgcctcctcccaccaatccggccacctcgttgctcctttttccaaattagttgcggcaatggaatcctctcaatctcctcttccttttccccaagaaatccccaaaagtttctatggaaatcctttccaatttcgcggttcaatctttccttactccggcgagaaccctagactttcccgagatttcccgtcgatttgggctcggacccgagctcccgtgcctatataaatgaccccctagtcgtcctctacctatcccctcatgtctcatcttccgccgtcgtcggaatcgccctccccgcgagctccttctctctccgccgccgatagccgttccagccgccgtgcgccgtcgcctcggccgtcgccgatcagcgccaccacctcccgcggctccgcaaagtcgagctctatcccggccgctggttcttttgcgccaaatccaaccggagattggccgtcatcgtgaaccggagcgccgccgtcgccgccgtgcctccagccgcgccgttcgtcgtcgtccgtcgtcaccttcggtcgccgtcgtctccatttgattcgcagctgcgaggagaagcccgtccgccatctgtcatccgccgaagatcgccggaaagtcgtcgccggccatctccttcgccgttcatcgctgcgtaagtattggtaagcatcgctgttgcctcctctttctcccgttgccctccatttgcattattgtaccgtggttcgccggcaaccgccgctcctatgccattcaccggtgtactttatctctagggtcttaattcaatctaatccgttgtttgtctagcatcgtcgtcgtctccatgtgttgccgccggatcaccgtagtcatctctctctccgatcgctttggttcggtgagacttctatccgtgttccctcggtttagtttttaatctctcgtttttgtcatcgagtagccgccaccgtgccacgcttagctgctgccctagcgtcgccactgcgctagccacctagccgtcgctgtgccgctccctgctacagccatgctgctgctgctcgtgcatgccaagtcgctgccgtcccactaccatagccacagtctgccgtcgttgtgtgtcgtcgtcgctgtgccgtcatcctaaccctagccgcgtgcctccgccgagtcgccgccgcctagctgagccaagtcaccctagtaccgccatgtcgcagctgtgtgccgctttaacctagccgccgctttagccgttgctcggtagccaagttgtttagccgttggtgcatcccttaattcctaccggcctatcgtttgccgtaccggggctttaccgtgaatcgtgtctagctcaccggtttagtcgcaaccgttgttgagtcgttcgctcgttcgttcgaacgaggtgtcccccatgtttcgttcgttcgtccgtgtggagtcatcctttagtttagagccgttcagagcagccggttccgttcgccagtttcggttgatcatttgggtgatcccgtgtcacgtagaattgactcgttgagtcggtatctcgtgaggcccgcttgccagatcaatctaagccatccgatcttggtcaactctcgatcaagattaatctcagccgtccaaaatcaatataaatccgttctctcttttcagtggcatattatttctttttaatatatgtcatctaccaaatatgatctaatctttttccagaggttgttttaatctttatctcagttataaatcatttctaaattgtttaattaatttagaatagtattttctttaataggtttaattggaattaaatcttgtaaaatttgtaactaattcatatgaaattagaatgaggccgttcaagtctcataattcatctaaaatcatgatctacatgtttctttactttatatgtactatttatttggagtttcttagtctttttcttcgttttgcgtgttagcttgtcgtttccgtcgttgcgaaggttcgcgagtgcgtcggaagtattccagaagatttattgaagaccgaatattgcaaggcaagtcacacagatcccaaacataatttctttgagcatgttgatcctatatttaaattctctatttatttcaattgtgcatttattttcgaatgtcaccgggtggtgtgaacctattcctttgttatgaccactttgcattgcttactctattctttgataccttgggtgacaatttgactaattggacttatatattggttcagctagatattagatataattgcttagccatgcttacaaacattagcacatgattgggataactaatgttccgctatcacttaatgatggatatttaattgtagctcacgatggctaattgtgattggttaattaattaatgtgccaactaaaacttgataatggtgggttgtgagcacatggttttgatggtcgtgctcatgacaattaaggaccggttcatgagtttcggttgtgaaacattaaccatgccaaccacaagtcagcgtgggcaacggctttaccttttgtatagcatggttcattgcggggcaccaaactgaaaagtggcggagataagcccacgggggtcgctggggagtccatgccttgtctataagggggtgattatgatccaggaacggtgcactgtggtggattgtgttatgcgaggggtactgtcacagctcctttccgaggtaccgtggtggcattgagccgcatggtgacatgttgtggggctgtgtcttgtgggtacagtggtacacctctagctagagtaaaactattcgaatagccatgcccgtggttatgggcgggtctaacaatgtctttcgtgattagtctcacacttctcaccgtaataaatgatgctataattggtaataatttgattagctcctggtttggaatggcacattcctggtttggagatagatctgtacagccgggtatggttgttcaggatggttgggcctgtgcagcatgggtgtgctgttcagtgttgattaatattgatgattaattactctactgttttacaattctcaaatgtttgataaatgctgcttttgcaaatgagccatatattatgccattctttggtatccttgtgcacttgcatacttgctgtgtggcttgctgagtatgtcatatgttcaccttgcaataaacaatcaaacctcagttgaagacaagttgcgaaggagaagacgtttggcttataccccagtttagctgcctgtgggagtggagccggagcttcgctagaccgtaattccgctgctgttttctcttttcttttgtaagtatgtaacgttgatgaatctgtatattaaattgtcagtttgtgtacctcggctgattcctggacaaggatttaatgcacaaataagttcggaaattactagtgaatttctgggtgtgacaccttctgtatcagatgtgacaagctatcaaagtcttcagacgagaatttctccctaatcggagcaatcataccttgaaaggccagatcggctaactgggcatcagttaaactcaagctgaagtatttgttcctcatctccttgaatctctgaatatactcgtgcacaggttcatcatgccgctgcttaaacgctgtcaagtcagataatttcatctcatgaaccccactgtaaaaatagctgtggaattgcttctccaaatcggcccaactattgatcgatccatacggcaaagaggaaaaccaagtaaaagtcgattcagacaaagataatcggaataacctaaccttcagagtgtctacagccgatgcttcaccacactgagctaagaatcggctaatgtgctcataagttgacacaccatcttgtcccaaaaatttggagaagtccggaactttgaaccgattgggaagaggaactctctcaaaccactcagggtaaggctgccgatacaagcttctagtctcttttggtttaagcccaaactgttccctcattacgtcagcaatcacatcggcccacgaccgttgctgagctgccccttgttgctgcatgggctcgaactgaccgtattgagacgcaaactgaggttgagccaatccccctggctgatattgggcttgcggggaaggaggctgatattgataattcaagttacccccttggtaattatgaaggttcggctggatattacgtaccaagtgctcaggaacaacttgaggcattactgtgccatccggctgtacgtggtgaaccaagtgttcttggacaacttgatttaaaaattgttgtacgggctgaccaccaggcgttgcaaacccggccgatgcgcttattgaaccttggtgctggatcaactgaacgatttgctgtcttaacagcgtctgctgaatcggctgtagaggctgctgccttggtggtgtttgctgaactggttgcatgacctgttgctggattggttgtacaacctgctgagttgggggtgtctgctgaatcggctgctgctgtattggatcaacaacaggttgacgtggcagaaacgtggcagcaacctaatcttgggtcagccgattcgcaacctgcccactatgctgtggatgctctctcattaacaaccgagggttcaccggctggcctggcgccatcgctgatggagcaggtaggggagttgatgtcggcgtcgttggctgagttgttggtgcaacggagggaaccgcctgaatagatggctggacatcggtgatcaaagaccgataatttgggaagacaccttgcaaataaactgggcctgcagcctgatgctcagctattgaaccatcggctattgacttcatcatgtttgataaggtattgactaacaccctagattgattgatcaaagcatgatgcacagcgtagtcaacccggtcttggaaattactgaaaaaatcttatgccgcatcactattctgattaagatttcctccttgcaacccttgggcaccatcaccttgcattccatggactccttgagaattgtcgccttgatttcctagagagacgtcggtagcacctttgttactcggctgagccgagtcgtctagagcttgtttcccatctccatccttagaagaactggtcccaggatcatcagcaaccacttttattttgtacttctgaacaagtgtccccttgcgggtctgcatgaatgagttcaagaactgatcccatgcttgctgcaacattgcttcaaactctttcttctgctcaggtgtgaatttttctggatcgatcggcacgacgtttccttcattgacgtcagtcgatcctaatttcagcatcttttccttaacagagcctgggctagctggagatagtggtggtggttgtttctcggccatgaggaagaattgttcatgccaatctgtgttgacgaaaaaatcgaacacatcggcctgggagatctgcttagctcctgtgcaggtccaaatcttgatgagatgcgggcgtgccagtcagtttgatcctgcaactgacaagatatgtaaacaacagataaaatagccgatcggctgacaagccgatggagtagttccagccggtagccgataatagccgatgctgataccagccgatagcgatagggtttaagcaatcggctatacgtccaatgtagattctaacactttagtaaataatgatatatagacaatcggctactgataataaaatataacaataatatagtccagtataaaccaatcggctagtattgatataatagaataagcattgatccgaaggttaaagcacacatcggctggtggtccgatgtcatgaaatccacgagattagattaaacagtgaaacctttgttgtcatcggctaaatccaacttatatgtatatgcaatccttatgagccgatgcaacgtccagataactcaccggctgaaaccctgatgaaacccttattggcagtcaaaaagcatgctagagattacggttctaagcatgacttagtaggtcaaacttaactgatgcagcactaagtatgaaaagaaacacaatatctagacaatcaagccgttgactgattttcagggtagtagatgtctaagctaatctaatctagcaacgcgatttagccgataccggcagaaaccctaaaacgagaagcagccgataaagctaaattgatatgctaagactagattaacagagacatatgataaatgggtaggcaaatatatcatccaaaccagagcaatctaagaggtcgaatgtactgatgcagccttgaacgacgccgacgtagatgatacaattgcctagaccgacggaacattggacttatcccttcgctggagatcgaagacgatgcagccccgcgtcgagtgccaagttccgccggaatgtaaaaacaaaagtagaagtaaaaagggtggcgatgcgccgaattgtattgaccgtgaagatagattacatagaccccgggtgtacatatttatacccatgggttgatacaagtcattgtcggacaagaaagaaactttcctaaagataaaaggaaaagataaagtccttataggacactaaatacacttttctaaagataaaaggaaactaacaaactattcttaattaatagataacttgccatgccgtattctctttgaactcggtctcttctagataagtttcctttagtagatcaatttccttaaccgaatatagcaggaatccgactattggcgacttgataactcccatcggctgattccgagatgccgtagccaatagtgactctaagccgatgatgactttgggcttaccaaatttcactgtcaacaccgtggtgaggatgacacatgggtcccacaatggcttggccccatatgtaagagagatgtagaagaagaggcctagaacatgtagtttatttccctactcctctcttccttttaaattagaattttagggagacaaggttgctgcaaggtagacaatgatttgatggttcaatgtgccaagttccaagattaaattactttttgagttactatggtaatttagtaaagaggtctaaattactatgttgactgcagtctaaatattgtttaagcaacttgtggctctcatttcaggtggtttaatttcgaatttaattaagccattgcaccaggtggtagagtacactatagttaacattctgaccaaatggtttagctagataagttatggttaaattttggtgaaggtgcaaagtaggctaaatgatatgctgttttccaaatttctagatgagttgttcgaattatttgagaaacatttgatgtgatatttattaatttgaaactaaaattaatatagactcaagatgttgtgtagtatttatgagaatatagatgcaatttgttgttgcataatttatttttaggaattttctttagaaacgacatgcatatgaaacctattatgagacgcaccaagaacatccaaaaacaaacctaaaataataaaatgcacatacaaccaagtatatttatttccatttaggttttttcttatgattaaaacttatatttccatttgttttcatttagctcaaatattttgcttaggttgaaatgcaaaaccaaaagagttaaatttctatttcatggttaaaccaatttatttgaattgtgttttgttaactcgatatattataaaatctaattttggattagctctaatctaatcccaacaaatctttatgttttaattttatatacaggattcaaactctaagttcaactattatgctcttaaatgctttagctttcaaaaagttttaaattttcctcaaaaatttaatggtgaagctccgaccgttatacgcatcgaggcgtagggtgccaggagcagcacttcgaccttaggtttggttctgttgggctttacaaccaacggttcgacatcgggcccagtagaccgcgaacacccccatggaagacgtaaagttctagccgacggctttttagtggctaaagagtaatttgggataaaagaaagtatttgaaaatgcaagcataaggtcaaacaatatttgaataaattcaaataaaattataaaatagcaaattgggtatcaaaatgtagggtttgaatttagatgaatttaggtcctagtttcactagaatcggatctacggttcaggagatatgggcttctagagaataggatttgaattaaatatgaaaattgcgaaatagtactgtactggggcccacctgtcaggtgtcctctctctcctttttcttcttcttcttcttcttcctcctccgtttcttgtcttctccagcgcgagcaacacagagagggggagagacagggtgccggtgctccggtgaccgggaggcgacgacgtcggcggtggaacgtgttcccgagtgtcacgcatccggggagggtggtggccggcagggggagtgagagaggaggccggaacggcgatggcaaggacttagctccggccggtatgggaggtaacggtggtggctaatatcggaaggagaaaggaaggggaaggttagggaatgggtttgcctcgtcgaggcgaaggtattggcgcgagggcttggtcggcaatgctccaacgagggagatcagccgatggccggcatggggaggagagagagagaagaagagctcgaagctcagttgtgggggaaaagaaggggctttgccggctatttttaggcggcggatgtcggttcgcagaggaggaggggaagaagggcatggcgatggcggcgtggggaagaagaacaaggcgccggccctgtccaactattggtcgacgatgacggttttgctcgcggatgacgccagtgaagtgatgtcacgtcccagaagtaccctaaaatatatcctttaaattataaattatgtctagaataattaaatcctagtcaaatctatcaaaaattaaaatgtgtaaagttaaaagtcaaataaggctgggaggatttttttatatttcctacaagcctaaaatgtgtaaataaattttagtggaattttcagag

SEQ ID NO: 69130 - DNA, 11371 bp, Oryza sativa
gacctcgtccacccctccgtttcggtcgccgacggccggaacgctagctcggaggatgacgctactatcatgcacctggcacgcatggtggaggcgtacgacacgggccgcatcaacttccatcatatggtgcgccgtgggttggtcgaggacaacatgaagatcctggagctacgttaggagaatttgcagctgaaggacttggacgccgtggaggcgcagctgtgtcagctcaagattgctcagggggagatctgtcgccccaagcgccgccgcgtttgccgcagccagaagatcaccgcccgcaagagtacctctaggcctgagcttgttcgtcagttcttggcgtggacctgcttcgtggagactccttgcgtcgagcccgcgcccttggttccttaggaggagggagcctctggcgttggcagcacggaggatgtgttgttgctcaccttccgccctggcccgtcgcagaagtagacgagcagctagtaggcacgcgcgtgtgttctttttgtttgttttcttgcagagtcgtgtggggcatggttataccggtgtgtggtataattgtgtcggagcctgtctttattttatttgcataagcaacttcaaccttaatgaaccaatttaatagcagaaataaattcaagaattatggtagtcgtgggtggttagttttaatcgtcagctctttctgtttgctggttctgtgtggaatcttcagatggtgacaaccaggagaagcgctgctaccggtgagggcagtcaccccgaaggcagcaaccacaacaaccatggcagcccacctccacctccccctccgccaccaccaccgccacccgataccaaccccatcctcacccaaatcctcgctcagcaggccaacatgatggctgctttcctccaccacatccagactccgccgcaacacaatgctccaccaccaccaccaccacccccacagcactccaagcttgccgagttcctccacatccgcccgcctaccttctctagctccaataaccccgttgatgccttggactggttgcatgccgttgggaaaaagttggacaccgtccagtgcaatgatgaggaaaaagttatcttcgcaacccatcagctgcaagggcccgcatcactatggtgggaccacttccaggctatgcagccagaaggacagccaatcacctgggcccgcttcaccgccgctttccaaaggacccatgtgccagctggagtcatggcccttaagaagagggaatttcgggagttgaagcaaggcaaccgctctgttatggagtatttgcatgagttcaataacctggcctggtacgccctggaggatgttcgtgaagatgaagaaaagcaggagaagtttctagtaggaatggaccctgaactttctgtgcgtctggtctccggggattaccctgatttccagctcgtagtggacaagagcatccgcctggaggccaagcacaaggaactggagtcacacaaacgtcgcttggcgaatttccgtaatcaacagggggctaaccaaaggatccgctacaccaatccctatccagggggatcctcctcacaacaacagcagcaacaacctcgcccagtgccatgacctcaatttgtggtacgcgttccacagccgcagcaacagcagaatcagcaagggaaccgtgcaccccgtccccctgcaccggccgtgcagcctagtcatggacgcagggatgttcaaggtcagccgcgtttgtgcttcaactgtttagagcctgggcacttcgcggataaattcccaaagccgaggcgttaggaaggccaagcgcctccccgccccaacaatggtggaaaggatgccactcggggtcgtgtgaaccatgttactgcagaggatgtgcagacaactccagatgtcatcatcggtacgttcttcattcattccatccccgctaccattttgtttgactctggagcttcccactcgtttatatctgtgcaattcgtggggagaaatcagctggggttagaaaggcttaggaactcactgctcatcaccacccctggaggagctatgacagcaaagtattatagcccggccgtacctatagagatccagggaattccttttccctcggatctgatccttctagacaccaaggatttggatgtgatcctcgggatgaattggttgacccaattccaaggagtagtggattgtgcaaggcgtactgtcaccgtgtaccggaagcctgatcaaccggttgttttctttgcgcacccgactcccaccggcagctcagtacttcatcaactaggactgtcagaaatacccgttgtcagtgagtttggtgatgtatttccggaagagctacccggcatgccgcccaagcgggagattgagttcaggatagatcttgctccaggaaccactcccctgtacaagcgaccctaccgtatggcagcaaatgaattggctgaagtcaagaagcagttggaagagttgaaagagaagggatatatacagccgagcacttccccctggggtgctcccgtgatttttgtagaaaagaaagacaagacaaagaggatgtgcgttgactaccgagctctcaatgaagtctataaaaaacaagtaccctcttccccggatcgatgatctattcgatcagcttaaaggtgccactgtcttttccaagattgatcttcgttccggatatcaccagttgtgtatccgtgaagaagatatccctaagaccgcattcaccacgcggtacggactgtatgaattcacggtgatgtcgttcggtctgaccaacgctcctgccttcttcatgaatttaatgaacaaggtgttcatggaatacctggataagttcgttgtggtctttattgacgacatattggtgtactcacagtcagaggaagaccatcatcagcatctccgtctggtgttgggaaagctctgggaacatcagttgtatgccaagctcagcaagtgtgaattctggttgtccgaagtcaagttcttagggcatgtgatatctgttaaaggagttgctgtggatcctgaaacagtaacagccgtcaccgattggaagcaacccaagacggtcacccaggtccgcagtttcttgggtttggcagggtactatcggagattcatcgagaatttctccaaaattgccaggcccatgacgtagttgctgaagaaggaaaaaaaatttgtgtggagtccgcagtgtgagagagcatttcaaactctcaaagaaaagttggtttcctcgtcagtgttaatcttatcagatactcgcaaggatttcctggtgtactgtgacgcttcgtgccaaggtttggggtgtgtgttaatgcaagaaggtcatgtggtagcttatgcttcacgccagctacgaccccatgaaggcaactatcctacccatgatttggaggtggccgctatggtccatgctctgaaaatctggcggcattatctcattggaaatcgctgccaaatatacaccgattataagagtttgaaatacatcttcacccagtcggaactgaattttcggcaaagaagatggttagagctcatcaaagactatgatgtgggaatccactatcaccctggtaaggccaacgtggtcgctgacgcgctgagtcgaaaaggccattgcagtactctttgcgtccgtggcattccaccggaatttaatcaacagttggaagccctgaacctaagtgtcgttagccatggattcttggctgcactagaagcaaaacccaccttgcttgatcaaatacgcgaggctcagaagaatgatccggatatgcatgggatcctcaagaaaatgaagcagggtaaagccgctggcttcacggaagatgaacacggaaccttattgaacggaaatcgtgtatgcgttacggacgacaaggaacttaaaaagttgatacttcaggaagctcatgaaagtccttattccatccaccctggcagtacgaagatgtacttagacttgaaagagaaatattggtgggttagtatgaagcgggaaatcgccgagttcgtggccctttgtgatgtgtgtcagcgtgtcaaagcagagcaccaacgaccggccggactcctccaacctttacaggtaccagaatggaaatgggatgaaattgggatggatttcatcaccagacttccaaaaacccaaggcggatatgattctatatgggtagtcgtggatcgactaaccaaggtggctcggttcattcctgtgaagaccacctatggagggaacaaattagctgtgaagaccacctatggagggaacaaattagctgaactttacttcgctaggatcgtgagtctccatggcaatcctaagaaaattgtatccgataggggaagccaattcacctctcacttctggaagaagctccaagaagagctggccacccgattgaatttcagcactgcttatcacccgcagacagatggacagaccgagcgtctgaatcaggtcctggaagtcatgctccgtgcctgtgttctagattttgggaagacctgggataagagtctcccttatgccgagttctcctacaataacagctaccaaaccagcatacaactggcaccctatgaagcgttgtatggacgcaaatgccggactccactgttgtgggaccaagttggggaaagccaagtgttcgggattgatattctgagagatgttgaagctaaagtcagaaccatttaggataacctaaaggtggcacagtctcagcagaaaagttatgcagataaccgacgccgcgatctggaattcgcagtggacgattttgtgtatcttcgggtcacgccattatggggagtgcacagatttcagacaaaagggaagctcgcacctaggtatgtggggcctttctgcatcatcactcgacgcggagaagttgcttaccagttggagctgcccgcatccttgggcaatgtgcacgatgtgttccacgtgtcgcagctcaagaaatgtcttcgagtgctatccgagcaagccgattcagagcagattgaggttcgcgaagacttgacctacgtggagaagccggtgaagattctggacacaatggagcgtaggaccaggaattgggttatccgtttatgcaaggtccagtggagcaaccacgccgaggaagaagctacttgggagcgcgaagacgagctgaaggcagcccatcccaacctctttgcatgttcttccaaatctcggggtcgagattccgtttaagagggggtaggtttgtcacgtcccaaaacgaccctaaaatatatcctttaaattatgtctagaataattaaaatcctagtgaaagcctccaaaaattaaaatgtgcaaagttaaaagtcaaataaggcttggaggattttttttttatatttcctaaaagcctacaatgtgtaaataaattttagtggaatttttagagcacatataataattatcaagaaataaacaaagttgaaaaggttttataaaaagaaaaccctaaaaccctctcccctctctcttgggccgaattcggcccaactccatctccctctttctcctctccccgcgtcccactcggccttccctccctccccgcgtgcgcgccgctgacaggcgggcccgcccgccgccctcgttgacgggtggggcccacccgtcatccccctcctcccgccgctcccgccgctccctccgcccgcgtctagcgccgccgccgccgcaaatcccgctgcccccgaccgttcccgcgtgccattaagtggggggaaatgttccccgtgattccctctcccttttcccccattttcccctctctcccgcgttcaaacggccggatttgctcccgcaaatctcaccggcgccattgatgccgaccgggacccccgcgccggtttccttccccgccggccgccctctctcactcccaaccctatataaaccctccccgcacctccctcgtccgtttctgccactcgccgcactttctccccgccggaatcgagctcgcgccatcgctctctctctccggcgtcaccgccgagctcgggtccgccgccgtcgtcgccccggaccgcttcccacctcggcgtcgtctcctccggcttcgccgcactgccaccgacctcgtccacccctccgtttcggtccctgaccgccggaactccgccgaccccgtcgacccgagccgcaccaccgcctccctctgctccggccgcctcctccgtcgccgtcgtcgccctggggtgagccgtggaccgccgcctctttcccccttcccttcccctctctcggccgccgctccgccgcgcctatggccggcgccggcgaccataggggcgcgggcgccgcctaacgccagccgcaacgacgtggccgcctccgggcgcgccgtgtggccaccacgtggggctcggccgtcagccgcccgtgccctcgggtgcggctgacgcgtggggcccacggcgccggctggtgagccacgggtgcacccggtccaccgtcgaccgaggggctgccgcgtagggcccaccactcccgtggacccggtccgcacgccccctcttctcggctgacgcaataaaccctatttttaattaaaatttaaatgaagaaattcgtaaatattcacattaagagcatataaacttcaaatggtcatatcttggccgtttgaactcagaattggaccgttcaagtctgtaatttttccttaagaaatcaagaacatatttttgtgctttgtttctgcttgttatatcgagtttattagagtaaaagcctttttctttccgttggtcgtgtagatgcagcagctttggaagatcacatcatccttgaacaaagcctttttctatgtggaggttgaagccgacgtttgggaaagcgagcaaggcaagtcacatcatccttgaacatattgaatcccagtttataaaattattttggtttaaattactgcattatcgctttatttaaattcccgcgttatcactattttatttagccatgcctatttacctttgttatgaccttattaatattgctattgttattattaccttgttcaccctaggataaacaaaaccccaactagtgggtaccctattcatggttccactagtatgaatttagctagctgcttcgctgattaattagacaacattaggtcgttttataaccttagactttgggaatgctcatatcatttggacgttatggaatggtttgattatgtggaaatggacacacacctccctctctattcaaaaccctcaaaatggttttaggctaggctcgaggtgcatggttttgatagtagcacctcggccactataaggaccggtcttcaggcctctgttgcaaagtactactgtacttccacatgtctagtgggtaaggcgtagtttgtggctcagtctggtcatgggcaaaagtacacggatggagatggacaaagtcggggctcgatggatatctctagggcaaatgaaggccacacgagctgtcgcccggtagtcgagatgtcatggcacagggccggtgtcctactgctaggggctcaaccttggttacctgtctcgggaatcccggtcgtagccagggttgggtcggtactcttgtttatggctaggataggttgggaactatgtcacatctttcgtccgtatgccgtggtggtatgtgctacgtggttacacgtgagaaagatgtgtcttgtgggtaaagatgtacacctctgatcagagtataatctattcgaatagccgcgccctcggttatgggcaagcctaacaatgtacccaagttagtggtttacttcttaaaacttgcttaacaactaaaatatggaatggttggcctaggttggcttgggacgagctgggacccaggtcaggttgccagttcggtctgaatcatcgtaggccttgggttaaggcaggttcgtgcgggttcacggccttgattaataacactgtgtagctctaggatcgtctttacaaaatggccctaagcaactaaaagtcttgtaaatgttgtttactgcaaaccctaacccctttattataactcccttgtactcctttgcatttattctgcatttgtgggtgtgtcttactgagtacggtggttgtactcaatcttgctcaatttttccctaacccaaaagaggagttcctggaggatgaagactttggtgtctagctcgtgcctgccgtcaagtgcctgtggtcgttgccctagtcttccgctgttttccgtttatcttcgtgtgtgctgggccttcgtcgcccatgtaataaattaactatttacgcttccgcttgttaaactctgaattgtatcaacttttggtgtaccttgcctcctgggacaaggaataatacacgcacgtatggaatgatcgttgggttaattccggtcgtgacaagtgaggtggcggctaatgttggtggcgattccttggcggcgacggcaagacaacggcggcggtggcggcggcgcgcacgcgctgccatggcggacggcggcgcccacagaaggaagggaggagagaggaggcggctgagctgaggctgggccgacttgggctgcatgaatgagaggagtaaaaaggggaattcggcccaatcttaaaaggaagaaagtctaaggtttgaataaattggatttagagaagtatttgtgtttgaagggaatttagatagctaggcctcagaaaggatttgaattcggagagatttatgtgcggagatgaatttcaaagtaaagatgttctaatttgtttgagtgcaatattttggagtgggagtttgtttaatgcacttaaataggaaccataaataatatggctctgtatttctggaaatgtggtaggaaaaataaagagagggaataaataggattttatccccacaaatgggtggtatgggtttaaagaaatattttgtggctaataggagatttgcatgaggataaaatctattttcttagcacaagagcaattattcacaatatttgtaataatactgttcttgtgacgaagaggaaatcaagccacatgaattaaattggcggctagatcagaaggaggaatttggatatttagatcgaacatcaaagtataggtttaagatcaaaggataggttaacaattaattccaacggaatcggaattacgacggtttaggttcaagggcaatatgggaaggtttcttggaccataattcataaaagggtttttaattaaattgagaaaaaggaattttgcaaaagaaggtttaaggtgcagaatcaaatcaaagcaaataccttggtttaataaaatcaattttagaatacaaaccacgaaagattttaaataatagagagagattctacgcaagttaatatttggaagtctctctaaatatattttcctaggtttaaaaggttattaagaacataagaatcagcatgatgcaatattagaaaatagtgaattttcaggatgttacagacggtgggggtgaggaggaagaagctgagaaaaaagtctagtggtatttctgtccgagattgtactgtagcaaacaaacccaagatgaatgtgatattttatcgaagcccattgaactgatggtattccaatgaaaccatttttttatggcataatcctaattttctctaggtttagggtggtgggtatgggcaatgaaagccatttggattgccaggataggaaaagttactactccctccgttccaaaataagtgtagttttagcactgttcatgttcaacgtttgaccgttcgtcttatttgaaaaaatattatgattagtatttttgttgttattagatgataaaacatgaatagtaatttatgtgtgactaatttttttttaatatttttcataaatttttcaaataagacggatggtcaaagcgctaaacacggatatctatggctgcacttattttgggacggaggtagtagattttttcgttggagatttgactagagaaatggcatgcaattcgaatagagagcttgttggagtggtgttcttattatttgggatagagagtgggatggcaagacggttggaggtgttctaatgtttgttgcctgtataaaaccttgaacgtgggagacggaatgtcctcttgcaagttgcaattttgtatgctgtacaaatatatttggttaagatcttgtttggttaatcccgaccacaagagaatcaagaggaatttgtatgggatttattcaatacctatttggttaatccatttaatcactcctttagtattaacctaacaagcctaacgcctaaggcctaagaagaaatacaatgctagccaggtaaaatatcatgctaaatcagtttgcccaaaaatcatgttattgcaataaacaatattctaccatttttttttgaagcgatgggtctgttcatatgatgcgactacacaatcatttacaaatatattgaaaaaatggatggcattttgcctaagaaggaaaagaagcaactgtttctacgagaaaaactacatatagaacataaacaatttactagtatgagatttattgttccaaaatgcaaacatgaatggaaaaaagcctggaattacttaagtgtgtgtttagtttggggatgaagtttgatggattaggttcgtcctatttctattttttttgggattggatgattccatctacatctacgtgcttgacataaaggttataatgatcctacttttttaagggttggaaggatgtggtccatacatcaatgagagagaaaattagttggattggtccatctgtgtttggttcacggtcatgcatggataggatatggccatccatattttgttggatatagcgatctaattttttgtttggtttgtatggatatggcgatccgatttcttgtttggtcggagggatatagcatggatggaaaaagccaaaagttagtgggacccatttgtcatatatatttttttatcaaaatataatcattcgagatcttgttttaaagatttaattgtaacaaatataatggtgtaatcaaatcataaattagataaacagtttaggagaaaaaaaatcatttggagcttacttaacagaaaatcaaaccaacaacagccaatcagaataggacacatcacccagaccaaaactggatggattcatctagccaaatcggcctgatgcactcatccagcatattgagggaatattccctattctgggccgcctcatccaccctgccctccaatcaaacactacaaaaaaccggacggccatctcctatccagtctcatccacccaac

SEQ ID NO: 69131 - DNA, 4124 bp, Oryza sativa
agaccaatgtgttaggttagtactaaagtggaaccaatcccttattttgaaactttagattactaaagttgctgagagcatcactagcagtaccctactccgtctccgatcctattttttttcaggatttttgatgaaaaaactgcttcaactgttccctacgcttcctctcaaaaatcagtactccattctacttcactctcgctctccaaaagttgggaatcgttctcgctcccaatttccgtcacttgagtgagaatgccatccgagaaaaggggtaagcggaagggcgttgacactagatgatatgatcttgataagttgcgggtaaagggaggcatacctttttatttttatattttagggagttaaatataagccatctattggaaggaagtatatacctatacaagttatccccacctactaatctcctgcactgtggttgctccacgtcatcaagttgatcacacccattcgatcataagagacatcttgaccatactctcacaatggccaattacagtactactaggggcagtagaataaaaaccacttcaaacaaaacgccaggcaaaaaaaaaaaaacaccaattctcaagagtggattttaaactctagagggaacatgtatatcactcgaataattatgaaaaaatttcaaaacaattaagaaattgtattaacatgtagtataccactccaaaagcatgcaagttataatttaacttttataagtaaaacacatataaaagagtagcaaattaactacaactagttaacatatattcacattaaatttatttttttcgttgcaacatataaaaaattaaatttaactttacatgtttatgaagttataattattttcataactaagtgtcatacaaataacgagatgacgtctcgagttcttcctgcagccaggttttgaaatttcggttcgaaatttccgaaattttgccccccccccccccgaaatgctcacatctcgtccgaaattttcggttttttgcaatttttttgtgtatttggtcaaaattttatttaaaatcagcaaaatttcaaaaatttcgtaaaaaaaatccgaaatcggttctttcgcccacctgcagcagaaatcttgggctgtgtttagatacaaacaactttcagctttgaaaagaactaaacacagccttagtttggaaccctgcctgctgcaaaattataatatatgtttcgaaatttcaaacccagcctgttgtcgtcctgtactgtactcctgtgcattgtctggatgggcaactttttcatagcgaggcgagtcgtcgtgtgcgtgcgtgtgctggctcgtctcgtcttgttcggacatgacaagaacagaactgaccaaaaatggactggacgcatcagatgagggaggtccgagtatgcaggcggctgttatgcaaacagcctaacagcttaaacaaaatgctggaaacactgttgcttggcttggattttgctaaacatatgttatgattttgctacacacttcgtccttgttcattttgatttgttgtaatttgagaccgtaaggcgattaatcaggacgggaagaaaaaccactgaaccataaaagaccagactaaaaccagatcttgatgcaaccaggttcatcagatagattcatcattcatttataatttataaatttacccccattcttctacgggaaatttaactatttgccactcttgtgacatgtcaattaacgatttaccacaccttgtcaatgacatgtgggccctcatgtgtttatgacacgtgggcttagtggcaaatcgttaagcaccactcgtaagagtggtaaatagttaaaagccccttcttctacagacagaagaagcactttcttcttgagctctcatacagcaaccaaatctagacaaaatcaaagaatccccaaatcctccccccaagttcctaaagccccaagcgaacgccatcttctcagaacccggccaccgccgcgccgaggagggcggcggcaacgagcacggcgccgctcgccgcggtcctcccggcgttcccagtcgccggcgctggggcgggggcctggaagaggccggcggccagcggggactgcgcgggggccggcacgggcgcgaagaacccctggccgcggcggctgtgcttctccgacatgacgaggacgatgacgcgctcgcccttgtcgcagctccccggcgcggcgccgacgaagaagtggtacccggagctcgtcagcggcaccgtggcggcgccgccggtgggcttgtgggtggcgaccgggctccccgtgccgcagtggttgtagtcgtcccgcgtcacctccagcaccgcgtccgccgcgccgtcgaacttgaacactgcgccagcccaaccagagaaggagaagaaatcagaacaaatcaagaaacagaggaatccaagaaacactgaggaaggaatcgagctttgttgactcaccgaggttgtcgccgatgtggaagcgggtggcctcggcccacctgttgagcgcgtcgggctgcgccggcaccttccacccgccgccgttgttgccgccgaccacgaggtccctggcgttcgccacggccacggccgccggaaggccagcgcggcgcagagcacggtagccaacaccttcgccatcgaagtagggtgggaggactagcaaaagtagaacacgagagcacgagaggagggaaacaggggaacgaggaggaggagatgatgctgtggcggccatgggaggcggatataaatagggtggtggagtggaggtagccgttggggtattcgaacgttcgggaggggaggcagtagagtagcatcgggtgccgcgaagacgcgtggcgacagcattcactggcattgggatgggatgggatgggatgggatgggatgggaggagtggcaggctgttgctggcttgctgctgctgcttctcagcactgggaaaggatgcttctgttttggaccttaccgttgctgttttggccttttgaggaggcactgggctggatgggatggcactgttctggtgtagggctgtcacctatggcccgtggggctggggaggcttgggaccagtggagtggggtccacagggaagtgagtgagaattgtgtgaaccttggagttaatattcctcctggaagaagtgtttgtgttgtggcaataaaattatcattttttttaaaaaaaaagtcacatgaatcgagtggactgttgggttcagcctcgttatcaaaaccctcaccaaattagaccctgtttagatgggactaaaacttttgttcctatcacatcggatgtttggacactaattataaatattaaacgtagactattaataaaatacatccataatcttggactaattcgcgagacgaatctattaagcctaattaatccatgactagcctatgtgatgctacagtaaacattctctaattatggattaattaggctttaaaattttgtctcataaattagctttcatttatgtaattagttttgtaagtagtctatatttaatactttaaattagtgtttaaatagagagactaaagttaagtccctggatccaaacaccaccttaatctacgtcacgtcaacctatgtgatcctgaacaattaagacatgtttgatagagttctaactctaaaaattaagtctttctaaatcaagcttcacctcttgagtttattttgtgagagcactttagtccactctatttttttttattgttggagctaaaactttttgtttggacttccaactttagaagagatggagttggagctgaagatccaaacatgcccttgatttggtttgattttgcttgtagatgatcaaggcgtcgatgttggatgagatcatcgatcggctacgtcaagttcttgctagaggcggaaatttccctgttggggtcggagacccaccctaagggccgggatcgggggataagggggtgttcagttgggactaaaactttttagcccatgtcacatcggatgtttggacgctaatttagagtattaaacatagactaataaaaaaaactaatttcataaatgagagctaatccgcgagacgatttttttaagcctaa

SEQ ID NO: 69132 - DNA, 17743 bp, Oryza sativa
actccctgaaatttttctcagatttttcggagctcaattcctaattttaataatataaagaacatttcagtaattatccacatattaaattaatcattaaatggtcttattataatcttgttaagtactttgggtgtccaagtattttcaggatttttcttgaaattatttgagcattggaagtatttttaacaattcaaagatcatttcagtgattaatttaattggaaaagtaattaaaatccctttttccttttcaggctgaaactggaaaagttcacctttagtcctcggctcattctcccttcctttcggctggcctgatccctcctccaaagtccatttttggtccctccttcaatccggcctagtaaaggaagctcacagagaaagtctaccttacgtccctagtactgttcatcttcaacccctggctgccaaactgagaccgagttggctcggtttttctcctccgaatccggccttatctctcgtgcattcctaaaattagttgaggggaaatattcctcttatcctcctctatctcttccaccaaaaatccgactttatccctttgaattcgacgcgaatttggattcgttttcgagtttatctctccaccaaaccctaggttttcccggcgcgattctttgcgttccaagcctgatctctctctcccgtggctataaatagtgtcccctccctctcctctttcggccgccacctctccctctctccaccgtcgcttgtagcgccgtcgccgcgttcgtcttctctctccgccgccggcagccgctccagccgccgtttgccgccgcctcagccgacgccctcctgtgccaccacatctctcggctccgcaaggtcaagagcaagcccagcagctggttcccttgcgccgaagaccccgggaagcccgtcgtcgccatcaacccgaagtccattggattcgcagctgcgaagtgaagcccggccacccttccattgtcgccgaaggtcgccgaaacgccgtcgccaccgtggacagtacctcgtcgccttttggagcttgtcgccggccatctcccgtcgctgtttctcgttgccgccaccacaggtgagttcgctgtgtcctcctattccttcctgtgccctttgtttccgttggagcatcaccgttggtcgtcgccgctgttgtccagagtcgccggccgtcttccgtcgctgtccgtcatcacgtaagggttggtaagaatcgccgtcgcctcctctacctcccggtgccctctgtttgcattattgtgtcgtggttcgccggcaaccgccgctcttatgtcgttcaccggtgtagtttatccctagggtcttaatccaatataatctaatccgtggttggtctagcgttgtcatctccgtgtgttgctgctggaacgttgtcatcatcccttcgtctccgatcactttggttcggtgagacttctatccgttctctcttttcaatggcatattatttctttttactatatgtcatctaccaaatataatctaatctttttcaaaggttgttttaatcttttctctcagttataaatcatttgtaaatggtttaattaatttggaatagtattttctttaataggtttaattggaattcatctaaaattatctaaaatcatgatctacatgtttgtttacttttatgtactgtttatttggtttttattagtcttttttcccattttgcgtgttagcttgttgtttccgtcgttgcgaaaggttcgcgagtgcgtcggaagtggttctgaagactaattgaagaccgattattgcaaggcaagtcacacagatcctaaacacagttcctttgagcatgttgatcctatatttaaattctctatttatttcaactgtgtatttatttcaactgtgaacatattcctttgtaatggccaattcgcattgattactctattccttgttaccttgggtaataaattgattagcttgaaccttatatattggtttggttcagctaaaagctatatatatatatatatatatatatatatatatatatatatatatatatatatatatatatatatatatatataattgcttagccatgcctagaaacattagctcattaatgggatgaatcatactacattattatttatggttatatttaatggtagctcatgatggttaatcgtgttatgataattaattgataattaaaacttggcaaagggcggttgtgagcacatggttttgaaggtcgtgctcataacaattaaggaccggttcgcgagctactgttatgagacattaaccgtgccaaccacaagccagcgtgggcaacggctttaccttttgtatagcatgattcattgcggggcaccagactgagaagcggcgagaagtccgtgggggtcgctggggagtccatgcctctggttattgagggggtgattatgatccaggaatggtgcactgtgatgagttgttgtgcgaagggtactgtcacaattccgtttcgaggtaccgtggtggtactgagagcatggtgacatgttttggggctgtatcttgtgggtacaatggtacacctctggccagagtaaaactattcgaatagccgtgcccgcggtcatgggcgggttgagcaatgtttttcgtgattagtctcacacctctcacaataattattgatgctataattggtaataatttgtttagctcctggtttggagttagatctgtacaactggatatggttgttcagaatggttgggcctgagcagcatgggtgtgctgttcagtgttgattaaaattgattaattactctattgttttacattctcaatatttttgctaaatgctgcttttgcaaatgagcctatattatgccatcctttggtatccttgtgcacatatttactgtgcggcttgcggagtatgtcatatgctcaccttgcaataatcaatcaaccttagttgaagaaaaatgatccagaagaataagacgtttggcttataccccagttgagctgcctgtgtgagtggagctgaagccatcgctagaccgttaattccgctgttgttttcatttcttttataagtatgtaacgatattattatgatggatttgtatattaaattgtcagtttgtgtacctcggctgattcctggacgagagttttatgcacaaataagtttggaaattactagtgaatttccgggcgtgacacgctatgacaagacaaaggtgccggtttttggtctagaaccggcaccttttgttccaatagtgctttttatgctccacacaaagatgccggttgggaagacaaaggtaccggtttttggtctagaaccggtacatttgttccaatagtgcttttcatgcccaacacaaagatgccggttaggaagacaaaggtgccggttttgggtctaaaccgacacctttgttccgacaatagtacttatactccatcccatgccactcgagctgattgagcaagaagagagcggcacctctcgttcttgcccgatcagctagaggaggggaggaggttttgctctttttttttttgtgtttggttaaagattgaagcctaaaggtaaatattcattatgaatgcgaattatatgcaaatgtctagaatttacacttacaagcaaatgtctagaatttacacttacaattttttggacttacgaatttgacttgtgaatttctgagatgttgtagagctcaagcgatttagtcaagtctcctgggatgtgtaacacatctggtcatcgccttcgtgtggtttgacgggcacgtctcaggctgaagttgactggtgcgctgagtctcagcaatatctcatttgctctttactcgaggatatgaatgtgaattatatgcaaatgtctagaatttacacttacaattgtctggacttttgaattttagacttgtgaatttctcacctaaggatatatgtgcaaattaatgttcacaatttaggccgagttcgttaggactggttgggaacaagtatcctatgcacggaaaatagagcggtctattagcgcatgattacttaagtattaactatttttttcttcaaaaatagatcaatatgacttctttaagttacttccgtatagaaactttttacaaaaaaaatgtatcgtttaaccgtttgaaaaacgtgtgcatggaacacgagagataggagttgggaaaacttgctgccggacacagccttagacttaagaatttttggacttaaaaattttagacttacaatcttttgacttaggaattttaaactaggcacattttgagttagtttatatatgcaaatgtttaggatttaaagataagaattttttgacttacgaattttgacttaggctagtaggtttttatatgttatgaacttgtgatgaatggcttgtaggtttttatttgttgtgatgaatgtgaatgtgaatgaatgtgctgtatggatgtggggctctagggatgaatttgggtttatatggaattggggttgtgtggatgaatttactgcaattttttttgacccaataaataggtgccggctttaaactaaaaaccggcacctattttaacagccacgtggcaatttggcttagaatttgtgatgcatgtttgtctattattgtaaataactttcagtgattaatatatttgctaggaagttgtaagttatatatagtctttcagaaacactacatactgaaaagagaacgaacgtaatgattattgaaaaactgatttagctaaggaacactcctgttactgctcatgatagaagtacttgatcacatatgggtataacatgcaaagagccatagcatatacttattgggatggtagcatgtaaaagtgccaaccctttctacggtgactactgaagctagctagttataattagttatcaccaatcaatgcatcctgattgaggatagaaaaaattaaacatcgattaacttgcttgtagctactggccaagtgagtaagtgtattccattttccatgtaactctgtccacagcaacaatgagcatgcatgcgaaccgaacaaaatctgcattttcagtacaacacaaatgttaatgagaggaaaaactcgaaggaatgaattaattgtgttatgcacaaaaaaataggaagctgaaccttgaaattatagctgcaaaaaaaaatgccccctattacttatcgcatttgccctgttcaaaagtatcagttattccataagtacgagccttgaaataatggctttgtttcataatacctttttgtttaagtagttctaggaacagaaatcgaaacgggtgattagcatatgattaattaagtattaactataatatattttatttacgaaacatatcatttagaaattcgaaaagcgtgatcaaattaaatgataaagtcaccaagtccaaccgtagtatagagcacagagttagctagtatgaccagacattgagaggcaatagatatattgagcccagtgaataactccaacagaaatataaagtagccaagcaaatgatcctctaaatgtacaaatcataacaaatatgttagattagcataaagttctaaaaggctgcagcaaaatggggatttgaaaagagaaatgggactgacacaatccaagtgaggaggtttcattctctaacaaccatatacaatgagttgctttatgatggagagtatcagtcgaaccatgatctaattgatttaaaaataaaatggaaacacatttcatgataagaccaactgtagaatatactctcaaaatttagaattgaaagagctcccctaaaaaatagttagaaagagtttgtccctcttcatgtcattttaaaagaaaaatgtaattgtcattattttaagtcgaactaactttcttttaattatgattttagatttgtgtagcaaccacctgaaatgatggcgattgcactggttatgctaggatttctactattatctggatatgtcacgggattatccaattatctttagattcattgtgaaggcaaaaactacacaccagacaatatatacaagcgaaacatgcaatttttatcaatgacactgccacttaaggtctcatctatcctagatttgtttgcaatgatcatggccaatagcacaaaagaggagatataagcagttggatggtgtcgtgctgatattagtagtactacagacaatagttgtgttatgtatgcaatacggaacgtgcaaatagtttgagcttcaaagatggaagctaccatcttttacgacttgtgtgggcttagaatttcttgtcacactattcatttcaatatttctaaaaatatagacaagatagcaatactttgcgacccattttccttttagaacccataatataactatattgttctattacttatttttgccttgacaagtaaggcaactaacttgtctataaagtttgtcacatgaaggaaaaatctcatagcaaatggctacaactacaccatatatggccttgctgagtgctcatctgaggtcacaagttttgaatgccagatttgttttgaggatcttaaccaggccataagggaaaaggtggaagaacgtcaacaatttggtataatttttcatgacaatcgggctaaatgcttgtgcggattagagtatactcagtggggggccttggccctctacatcgcgtgggggcaaatgcccctatcatttttatgtatacattaacctattctaactaagttgtagactgtcgacccccactcattttgcttcctgcatttgcccctatccaaaaggaaaaaaaaaccccaataagtaggtacggaccctaaggccccgttagatctcaacatggagataaattttggattcacgcaaaatgagaaaccttattagcacatgattaattaattaactattataaatttaaaaaatggatttatttgcttttttaaatcaacttctagaaactttttttttaaaaagcatcatttaacagtttgaaaagcatgctaacggaaaacgaggaagttgaaattggagttgaagaaatagaacagagcctaagtctttatatgttcaacagtacctttcgccaaaaggctataaaactaatccacgtgatttctaaaggaactcccattttttcctaaataaatttgctcctactagataaaacaaaaacaaatcaaatccctacatcatttcatatctggtacatatttttccaattaaaaaattattggagcacacattagaccaaactcgctcaatttcataggcttgcacaaagactatggtccatggacaagacgacacggtgaaaggcaggtgatgctcgcccgccatggaccatgtgtcggtaaaggggaagcaaggggcttggcactgaaggaccaaaaccgctggcgaagggtgattgacggcttcgtcatgatgggctgtgcgaggccatttgaagctacaaggagcccacatcgatctttgaagaatatatgatgaaatggttttggtgttggcatcccttaagacaaataaaggaagatggcatgaagacattcctattggtataattattttcctatttatatttgaggatagaatgccatactattaagaggtatgcaacgtcgatgtgtttttgtatgtctcggtgcttaaagtgacctatttgagagaaacccattaacctatcctttgagtgattttggaccttctttttggttgagttgggtaatcctctgagtgagctttccataaagtctaagatcgtaaaaaatggacttccgatcaaaaagttatggccattttgctctctggtgtttttcagaatgtccaaaaatattttgaaaagaccaaaaattttcgaaaattccgaaaatggctgcaaaactaagattgttttctgttgatgcatttcggcacatccaaaaaaggaatctttgccagaaacgactagttttcaggggctctggtatataaactcctccacccctccattagtgatggctattcttgagtttgaaacatatctatccgaagtcacataccccctctctaatcccctagctaagtggtagatctttgtgagtgagatttgagaagagaagggagttgggttgagaaaaggattgggaagagaagctaagagctagtgagtttcacttcatactttgagcactcaagttcatacttcgtagcaagcaattcttcgatctccatctacatatgtgccttgttatgttaaacagtaatatactaatcaggaatgagaataatttagtgaattaaaaattatacattgagattatgcttggtggatcttcagaataacaatagctgtgcattgatgaaatcaagtttacacactaccaggatactcgcagatcggacacactacaagcagcaacaactgcgatcacgaagacgaggacccaaggaggacttgccggcgaccatcgagagtttcaaccaagaaatcagaaaagtggaaatgggaggtagtggaaccctacccctttaggccttgttgggttaatccccatgagggagggattggagggaatttattccatacctattatggtgtggaattattccccctcaatcccctccaatcctcttcaatcccctctaaaccgaacaagaccttcttttaatccctctctcacaagtggaccgagaggattcggaaggatttattctacacctattatggtgtggaattttttcctctcaatcctctctgaaccccctttctcttgcagattaaacgagcccttatggcggcgataaactgctggaaatggaggggaatagggggccaaactacagagaagctattggggattttgagtttgcctaacttgttgattgactgaaaattaaggagagaaggcgatctactgacctagattgattcaatgcgcaataaataaactgcaagaagaatcgactgaggttaattgacccaccggtgtgcaaggaagaacggaggaacagcactgccgggcaccggcggcagacagccatcgccagattgggttttcctattctgttacaggagagtagagatggagaggttcagggatgaggcgtggaaaagtatgtcatgtggagtcattactaccagcgctgaagcaagctggatggtgctcaaccgcatgcatagcaagcaacaccaatcaaggaatagtcctttggaaagaatcaaacaaggaaagagttaatttaggaggaataatgacatttccttgtattaagatggccacgagccaatataaactatgtatccagccttgctaaaggcaagcaatatcaatcaacttttcctaatctcccttcttccaccattgggtgtgcagggaaggttcctgacacctcaaccgagtcgagctacaaactgcgtagccgcggcccggctatcctcggcaccgacacgcttgacaacttggtatcaggttccaggcgttcctcctcccactccaatccaccatcgtcacccactccatccatcacttccaccatggctaaaccatccaccaccgagctcgccgcgctcatcaaggtgctcacggccaccgttgacaagctccagacttaggtcacctcgctccagcaggctgcaccttccggatccaagtcctcaggcgaccaccacaacgatcggcctcctcgcttccagaagatggattttcccaaatacgatagcaagtccgatcctctcgccttcatcaatcgttgtgaatcatactttcatcagcagcgcattgcggatgaggagaaggtttggatggcctcctaaaccctggaagatggcacgcaaatgtggtacattcaagtccaacaagacgaaggcactcctccatggtgtcgcttcaccgagctgctccacctccgttttggccctcccctatgttccaatcctctcgcacaaactccgtcatcgagtaccaagacaagttcgagtctctcttgcctcgcgcaggcacactcacggaggaacaacgcatgcaaatcttcatggccggccttcaaccaccgctcagcctcgacgtcgagatccataatccacagacgctcgccttcaccatgagcatcgcccgcaagctcgagctgcgcgaccagtgcgccgcagctgccgtaccagggcctccgaaccagtgccaaaactagcggggcctgctgccggcgccaccccagcaactcgccctgccggcgcctcctcaaccaccagtgtcagaccctgccacggtgaccgttgagggccgaatggtcaagcgcctatctcaggctgagatggaggaacggcgtggcctcggcttgtgcttcaactgcaacgacaggttctcgcgtggccacaaccgtgtctgccaacgcctcttcctccttgacttggccgtgcctgacgatgaccacgacgacgacagcgcccaagaggggaccggggagacggagccacaggtgtcgctccacgcgattgcgggcgtccgttgctgcgacactatgcaagtctgcatcgaccttggcggcgccgcactcctcgcgctgctcgactcgggttccacccacaacttcatctccacattggctgccaacggcaccaagcttccgctcctccctcgcggcaagatgcaggtcacagtcgccaacggtgaacgcgttccatgtccgaggttgtaccgcgacacggccttcaccatcggcgccgaaaccttccacgccaacttcttcgcgctgccgctggcgggctacgatgtcgtcctgggcacgcagtggctggcgtcccttgggtagatcttgtgggatttcgactcacgatccatgtctttttggcggcacgaccaccgtgtatgttggcagggtgttgcaggctcgacggccccatcgctgcaagtcgttgccggccacgacatcatgggagccctgctcgaggaattcaccaccgtcttcgccaaaccaatgggcatgcctccacctcgatcacgggacccctacatcaacctcgttcgtgcttggcgccagtggccgtccgcccttaccgctaccccgcttcccacaaggatgagttggagcggcagtgtgccgctatgctgacacaaggattgattcggtgcagcacattggctttctcctcaccggttctcctcatcaagaaagatgtcgggtcgtggcgatgttgcatcgactaccgcgccctcaacgccatcacggtcaagaatgcataccctattccagtggtcgacgagttacacggtgcccgcttcttcacgaagctcgacctctgctccggataccaccaagtcaggatgaatgctgccgacgtcaccaagaccgcgttccgcacacatgacggcctctacgagttcatggtcatgccgttcgggctttgcaacacccccaccacattccaagcactcatgaacgacgtcctccggacattcctacgtctcttcgtcctcattttcttcgacgacatcctcatatagagcgactcatgggcagcccacctacgtcatgtacgcactgtcctctaagtcctacagcagcaccgtctctttgtcaagtggtccaagtgtgctttcggcgtctcctctatcagctatctcgggaacatcttctcctccgagggcgtcgccatggacccgcccaaggttcaagccatctccgactggccacagccgcgatcggtgcgtgtggtacgaggattcctcggcttggcgggctactaccgcaagtttgtccagaactacggcacgaccacagcaccactcaccgcactgctacacgaggaagggttttcctagtcggatagacaggagcagccttcaccaccctcaagacagccatcacgaccgcaccggtgctcgttatgccccacttcgccaagccattcgttgtcgagtgtgatgcttccacctatggcttcggtgctgtcctcctccaggaccaccaccccacggcattctttagccacaccgtcaccctgcgacatcaatccttggcggcatacgaacaggaattgatcggcctcatcctcgtcatccgctaatggagaccgtacctatggggtcaccggttcctcgtaagaactgaccacttcagtcttaagtttttgctcgatcaacgtttggccaccatccaacagcatcattgggttggcaagcttctcggctttgatttcacagtggagtacaaggccggtgtcaacaatacaatggccgacgccctgtcacgacacgacaccgacgagaccatgctgctggccatctctgggccgcggttcgacttcatcgaccgtctgtgccaagcccaagacatcgatccgacgctgttggcactcagggaggagttcatggtgcaccagcacgccgccccatgggcgttgaccgacggcatggtgacatacgacggccacctctacatcccgccggcctcacctcttctccaagagctccttgccgcggtacacggcgacggccatgagggggtgcagcggactcttcattgactccgctgcgacttccactcacccaacctgcgcacggtggtccaggaccatgtccgcgcatgcatcacttgtcagcgctacaagtcggaacatcttcactcggctaggaaactctttccactcctagtgccgatgtccatttgggcagacatcaggctcgacttcatcgaggcgctaccccacgtgggcggcaagtcagtcatcctcacggtggtcgaccgcttcagcaagtattgccacttcatacccttggcgcacccatattcggcggagtccgtggcccaagcattcttcggcgagatcgtccgcctccacggagtgccgcagtctatggtctcggatagggaccccgtgttcacctccctattctggattgagcttatgcgtctcatcggcgccaagctccacatgacgtcggcatttcatccccactccgacggacagaccgaagccgtgaacaaggtcatcgccatgtatctccgctgcctcaccagagatcgtccctgccagtggctacgctggcttccatgggtagagtacatctacgagacggcttttcagtcctcgctcaagcagcggcaaggaatgcaacaatgcactactcggtagataggggaatacaacagcacatgcacctgcatgggtatgcatgcctgtaggctctacaggcgcacggctgtgtggtgttgagtattcgatatttgtgaaattatcagatgtccaacatgtggcatcctcctaattatacgcataatatcgcacatcttgaattgttgtttcttccgtaaataactccaataaatcccttaccccatattattgggcttagctattagcccaatatttttaagagtaaatttcacaaaactacacgttttatggtccaagttgcagaaaaccacacatattttgacacttggcacttaagtacatatattttggtagtgtttcacaaaaccacactatcaatgaatggatccacccgtgagatgacgtggttgttccatctaagatgaggacgtgccatcctattaatttcgtgcgatggctagtaatatgatgccacatcctcgtcctggtgaaacaaacacgtcatctcacgggtgaatccattcattgatagtgtggttttgtaaaactacactaataaaatatatgtacttatagtgttaaagtgtgtgtggttttctacaacttggaccataaaatgtgtagttttgtgaaatttactctatttttaaattcgaatccacatcaatttaccgtttcctgggcctttaatgtgctgtgtttgtgttgtgtttcatctctagatacatattacacacgatttttccgtctcacggatcgatttgtccatacactggagttgctgtaagtgctatacttggatttatagatggccataatgtccgatgtccgacggcccagcccacggcacgatattttagcccggcccatgaccgccgggccatgcatgggcctccccaccggcacgttgggccggtccggcatgactgggccagcatggcacaatgggtcggcaggccggacccgacacataaacaatagggagtaaaattagacatattatatgtcacggtccaaagaatgagatgaaaaatagatttattttagctatatacgtgtcagcccaaagagaagagagggaaaatagacttattttagctatatatatgtcacagcccaaagaggagatggaaaataggtttattttaagaaggcacgatgggccacacgttccttcgggccggcactgcacggcctgacagctgatgggtcgtgcctaggctggaggtgcagaccatgagctggcacggcctagcacgaagtgccgatcgggccgtgacgacccgattgctggtggaccgtgcctagccgtgtctgggccgggccgtgccaggcgggtcttatagtcatctatactgggattcgatttcacacgcgagggaaacctattcgcgcgcatgagggagtatatagaaatatcacgttatatatccgatcagttcccattaaaaaaaggtaatatatccgatcagtttccataaaaaaattatatatatccgtaaagaaaaaagtatatacccgtgcagctacatctcgccttctgtttggcatggggaagagaagacgaccacagacaacgtcgacgcatcaccggtactacctccgccgccgccacggcggcgacctgatcagcgagctcaacgacgacgtcctcgcgcacgtcctcggcctcctgcccaacgccaccgacgtggcgcgcgcgtgcgccgtgtcgcggcggtggcgttgcctccgggcgcgcgttcccagcctgcgcttctctctatctcatctaattaacccatcaggcgacgtgaagcggcaggaggatgtcgaacggttcgtcgccttcgtcaaccgcgtccacgccacgcgccgcgccggcgttgagcagctcacgatctccatcgagctgcacgagggctgctgcgcccgggccgtgccggccgtccacggcgcacacgccaacgcgtggattcggtacgccatggaacagcaaggggtgagatcgttcgccctgaaactcgaccagcccaacctgctgccactgcctgaacagcgacggtcctacgacttcgacgaagacgccgacggtttggtcctggacgagctccctagctcgacgatgctggagtccatggcccactgacctacctaactcttcctctcccggccaccgtggcgttcgattctctggtggatctttcacttaacgaaatccggctcgacgacgtccaccttctcggccgcctcctctcgtcggcgtgctgcccgcgcctccagaagctagccctggaggaaatagtcgggttgaaggagctacggctcgacgccggcgagctcctggagctgtccctgatctgggacggcgtgggcctgaccctggtggagctcaacactccaaagcttcgtgttcttggcattgaatgctacttcatccaccacaccacgctgacgatgtcggcgccggggctagaggagctgaaatcatccttcaactgggaaactttggagaggctcgacgtcggcgacataatgtcgtgcgtgcggagcctcaaaaatctgtacttgagctctgatgggctccgcatcggcttcggtgatgtctccggacgccttctccggcgatgccccgccgtcgaatccctcgatgtccaccttgcttgtaaggtatctcatgccgatgaggaaggcgaggaggaagaggaaggggtgattgatgacgtgatgatgatgaacgacataccacatttgcctcttgtcacatctttgacggtaaatcctttttctcccgaggacgagactttttctgatgtagacgagcatacaaagggactacctagagaactgttgacagttttttaaggagaaaacttgctcttcctcctagttttttaacgagccaattataaactgttgacagtttataattacaatataattttatatataagtataatgtaactcgtatataaatattaaaataatatatgtaacactatatctaaattatatagagatgataatgtagttacagttcagttacatagtagttacgatgtagttacaatgcagttacattgtagttacattgtaactatattgtaactaggatgtaactgaagtataactaaaatataactcatcaaacttctctaaaacatgcaacagatcaagtggctagcatgcacgccttccaggatggagctctctaagatatgaacgacgcttatcttgtggtaagtcccctcttactgaattgatctcgacgtctatttcgataaacttttgttagggttaatttgcattgctgcacactgcaaatgtgctaatttaacattacaacaatcaaacattatgaaattagcacagtttgtcagttcattaaaaaaaattaaacattacaagttttgatatgctaacaactctcggattttttttctctccttttaattgtataggagcagacgaaaccaacagatcctgctggtaatcaagccgattacctcagcgtctcgttaccacatctcgtggaaattgggataaatggcttccaaggaacaaagtgcgaagccaggctgatggaatggctacatagaagtgccccagttgttaacaagatttgcttttttgaaacttaagacgcggaaaggaatatgaagatttgctacctcgaattcctttctctgtgcttggtagatggacggcaacctggactcatcgtaactgtgtgggacgtttgtgtggacgccgacgtctgaagaagagagatataattatatctcgtgagtttccaagatgagaagtaaacaaaaatggaagcatcatgcttattaaaggaaaaaaatgtgcgtatttactattgggaagtaatttaactatttgtcactattagatttgacaactctctatatgccccttatctattcatacaaatttgtcactggagagagattgcttcttaatttttttttcattttttgcatacatgtcatgaggactactcatcatcgtcttcttcctctagccgccaacctcctacctctttcttccttctcccatgtatggttaaacttccgcaatccaaaaaagctctcacccaacaggcgacacccctgccttacgcctcttttcaaatctctctctaggaaaaaaagtgggaaaaatagagagatggatgggaataggaaaaatgaaaatgttcaaaatgcaacagactcattttttttaacagtttggggtgctccgcctcccacaaccaatgcccatgatgggctgaaccgagcgaaaattaattgaaaatgggccgagcccaccgcgccacaaaaatgacttaggcacctcgcatcgccaaaagtggacaaaaacacatgggccaataatggtggggcagatctgatcaagcgctacagagttgcacgactgatcgccaaagagccatttcgatacgagtatgcagtgcagcggtgagcatggtgttttaggagccatgtcccggtcaggcattgtgtcgagcaccgttaaatttctccaatcctaaaaagctcttactgaacaggtggtagtgacacccccaaccacccataggcacaacttgatccgcggtggtggggagagct

SEQ ID NO: 69133 - DNA, 1271 bp, Oryza sativa
ttttcatttgaatacccttgaattgagttggcccacccctgcccatgaccatgacaaatagagtaaggccctgtttagttcaggggtgaaaagtatttgtgtgttataacggatttacggacacatatttgaagtattaaacgtagactaataacaaaacaaattacagattctgtctgtaaactgcgagaagattttattaagcctaattaatccgtcattcgtaaatgtttactgtagcaccacattatcaaatcatgacgcaatcaggcttaaaagatttgtctcgcaatttacacgtaatctgtgtaattagttttttttttttttgtctatatttaatactccatgcatgtgtccaaatattcaatgtgattggggaagctggagtaggtaaaacagtactcatcatagaattaattaacaatattgctaaagctcactggggctgggtgaaaattttttatttaggaactaaacagggcctaattaagctgtgtatagtaagcacaatttccacgccgacgcactgcaattttcacgcaactttcaccgcctatttccttcttttacccccacaaccacgaccacgacgacgaccagagtaaacaagtcttattataaccacccccctctccttttccatctacctcctccaacgaagccttccttcgcccttgtcgtccaaccctcctctcctcccctcctcgtcgcggggctagggttacgccccctcctcctcctcctcctcctcctcctcgtgtgggggcatggccgggagcgaggcggcggcggcgcaggaggcggagatggacccggacttctcgggcgggggcggtgggggccccagcttcgagttcgccttcaactcggtcaacttctccgaccgggtgctccggatcgaggtcgtcgcgggggacgacgacgacgacgacgaccacgcgcccggctccagccgggacggcggggccggctcgctctcggattgggcgcgccaccgcaagcgccgccgcgaggagctcctcaaggagaaaggtgcgttgttgaaaccgcccaaattaaacgcttgtttcgtcaattttctttttaattttcgaattgtggacgatcgttttacgaaaatttcggtgccttcgatcatatattaggtggtcaatgaaaagcgaccagggtaacggagaatggatgaaaggggattttatttttctccttccaatttttagatgctctcgtgtacttgtaacagataccttttcagaatttgatatttt

SEQ ID NO: 69134 - DNA, 957 bp, Oryza sativa
ttttcatgtgactaaaaagcgcagtaaagaatggcttgtttgtgtcatggctatatttcagctggcagttgctgtgcagtgggctaaacaatggatgccaagcacactccagagcaaatagacacttctcaacagcatctgctgacgattgatgttctccagaatatttgaaaagttcagcaaatgttaacaatgattctgggtgataagggtactttgctaatatagctgcaatagcattgagatcatttgcagatttggcaacttcaaacaagtcttgcacatgactgacagaaggatcatatatgtacctgcacgacatgaagagtttgattatagagaaagttaaggaaaagcacaggcccattgggagttaattctgaaatcttacatcaccttaaagtttagaaaaaaatatactgagaaataagattgtgaggaaaagcagtacagtgaacacaatatacaatataactaatggtcatagttgtaagctgtaaccaaacaaaatagtgatgtgcagagatgataaacagggatacatgatgcacaaaaaatacgaaatggcctcacctgaaatagttgaaaccactctttgtctccacaatatccattgacattgatttatcccatggtggccagtagctagatggagtaacaagaagggtttttcttggattgtgggcaacgcgcctaacacctcgtagccttgatgttgaactgctaggcacattccgttgattttcaagtgaatccactacttttgatccaaaaatgcgcctcatctcattttcagcttttagatgtttgggatcaattgagagaatagatgatgtcccaggagtggtttcatctatctcaatctccttcccagatgctctttcattttgattaactctttgctgcatgggcttcttttcaatagataaatcttccagaattgaatccagtgacttt

SEQ ID NO: 69135 - DNA, 782 bp, Oryza sativa
cgatcgatacacctctccgtgggttgttgatcttgccggtgcagatcaaccttattcctgcaagcaaatcgaagaaacaagcaagaacaagatagaagcaatctgaattgcaaataggaatgaatacacaagataagttggggttccgaagaacaagcagatggacggtctagccgacacgcgcgctgcaaggaagtagcaatggctaaactttcatctaaacaaaacccaagaaactctaaaggggtacctaactatttaaggaggtgggaggacgacctaaggggaccctagggtcgtgctccacctggttggggcgcaccccacatgggccccacttgggccggggttccagacgaagttacaagcccataggcccattataggtgacgcagcaccttctttttgtgatttcggccgactgggatggaatttggcgatgaagctggatccattggaaagatgactctgagagctttccatcaagtactcatggacctaaaatggagctcgcatgcatatttggtggccgtttgaagttgacactgtagcaggtggccgaactagattgcagaacttggacggcttgatcttgatgtggacgacggttgtatctatagtagccatggtcacatcatcagtcggtgttgagtgtggctgggcccgacgtcgaggttactcaatgaagcttgggcagcctgtgtggtcgtcggatggcgccgtcagtcttgctccgccgctcggtggagtccggtcattgtgcagatggtgtgaatagtgca

SEQ ID NO: 69136 - DNA, 981 bp, Oryza sativa
aatatagatgtgaaagttctttttaaaaaaaggacatctaatctaatggtctacaatattgggtcaacaatttaaataaaaatcgacggtgagattaaacagtgccatgtggcggtctaggagtatttgtagaaacgctatgtggcagtttaagagcgtttctaggaagtttaatggacttttagtatataatagatagatagatagatagatagatagatagatagatagatagatagatagatagatagatagatttcatgttgtttcagttgagaaagttaatttctagaatttccaaagttggtaaaaaaagtatttgagacatgttgtctattatcttgtcaaattttggtagtgccaaatactgtatctattatgactaaaaatagtagtaaaccaaacatgtacacatatcataatgagatatggtgcactcactttgattccaacagtagacttagttacccttcgtttatactacataaaaagaattatttattcataaaaggggtagcatttatttagcaagggcaaacaaaaaagaggctctgtagaattacgtataaattttaaaacaacttaaacgacttacatttggaactattgggagtatctatactactataaaagatattagtagtggtggttattctgtcaccatcactatttgtattttctttttaaaattagtctttgttatttttaaatattatacaatagtctaatatttatttgaatcaaatggatatattatgtatattcaaataagcaaacatgtctataacaacttattattattattattattattattattattattattattattattattattattattattattattattgagttaattgtactttggttcaccttttattaccaaagtttcactttgagccaccctctaactaatattgtcactttagactaggtaaaattacctttgttacggtttggaccacccca

SEQ ID NO: 69137 - DNA, 11391 bp, Oryza sativa
ggtggttggcaatcggcagaagaggatgcaatccctctcccttaatcgcactgcctatccatgattaatgtccatgtgcttcagtactagattttttttttaatttggaccacttcagttctgattatgagttttgtcattgaagtattaatgttcttagctgtatcggtgctaatgtgctgtcttttcctccttttctgaacttaaggcatagaaaagaggaagaaacaaaggatacatcattatgttgcgacgctggttctgctgcactcagtttcacgcaccatatcgtgaacacgaaaatgaatttcctgacatcccagaggagaaagaaggtatctttcttattgagcgcccctccttattctttttccttttttgagcagctatcttcaagtttatggtattgtatggtctcaactcccaagtagtcaagttgaggaaaaaattgctgaggtgttcacatcatcattgttcattctatatgaactaaactttagtctgtccaaggttgctatactagatgtcagtgcattttcagcatagttgtcagaaccattctttttcccccatggccttatcagttgaactgcacaattccttgcatggtagtagtatttttatcttgattttctttaatgctaaaaacaaggtcttgtattatatatccgcgaatgcttcatatcctgttgtatttttgcctttgagacctaaacctatttgtcaacatttggctagcaggaaatggttttgctcccaaaagtgatgatcccacaaaagcacctcctcccattgaagtaccagaattatcatttgatgaactgaaagagaaaactgataattttggttcaaaggctttagttggtgaaggatcatatggaagagtgtattatgctactctagacaacggaaagcaagttgctgttaaaaagcttgatgcttcaacagaacctgaggttgataatgattttttgacacaggtatggttaatgattatataatcatatgcagctcttgccaattatatgcattctgctattcgatgtttggaataaggttttactctaaaccttacttttcatttctattggcataggtgtccattgtgtcaagattaagacatgaaaattttgtggaaatgcttggttactgtgtggaaggaaatcagcgcctagtggcctacgaatttgctacgatgggttctctgcatgatattttgcatggtatgagaaatatgcctttacggtaaaaaaatgccatcgtatctcactaaacacatacaagccttttaatataattgtgtatataatatagatacttcaaggtttaagttggttgcctgtttcttttgtaataactcaaaataattcatatatagcagtgctctgatattgtttttgtttttcacatccttgtcatacataaggaagaaagggtgtccctggtgcacaacctggcccagcacttgactggatgcagcgagtgagaattgctattgatgctgctaaagggctagaatatcttcatgagaaggtccaaccttctatagtccatcgggacatacgctctagcaatgttcttctatttgaggactacaaagcaaaaattgcagatttcaatccttcaaatcagtctcctgatatggctgctcgtttgcactcaactcgtgtccttggaaccttcggctatcatgctcccgagtaattgctctactcaagtacttgaatagtttatgcatttcttttttttcccaagcaaaatatttaatcaccttttttgctataatagattactctgtaatatatattgctagaagatgatagtgttctgccttcaatattttgtactgttgattgcgtggctgtagcatccaggcaattcttaaatatagctaaacaagaccaatagttctatgaataactgaagttcccattatttgttaccatgcttgttaatcattcactcagtcatgtatcctttgttctcactccatgcaggtatgccatgactggccagttgactcagaaaagtgatgtatatagttttggagttgttcttctagagcttctaacaggaaggaaaccagtagatcacacaatgcctaggggtcagcagagtctggttacatgggtaagcattttatttgtaaatttactacaatatttaacatgagagctgtttgcctcagctattggtaaaaggagaattactttgttgataagatcactctagaataaaacgaagaaaaatgtggtcttaataacaaattactaggcatccagctcagatggactgaagttaaggttttgaatggtacttcaaagaatctctcagactagactttgcacgttaatgattcttcattcaacaaggctttcaaaccaaacagaattttattgtcctttgagaaactatactatttttactgtcactgtgcatagatgctattctatcgtgttatgtaacacaccattctaagttgtgtacaagctgctctgcatatttctgattagctcttgttactacttattttgtacgcaggcaacacctcgtttgacagaggacactgtgaaacaatgcgttgacccgagactgaagggcgagtatcccccaaaaggggttgccaaggtctgcctccctcctcccttccctttaaatgcacaagcactctcttgtatggtcactgtgtggagccaagcaacatcgtaaccaaaatttgagcccaatggtttccatctgtttattgcagctcgcagcggtggcggcactctgtgtgcaatacgagtctgagtttagaccaagcatgagcattgtggtcaaggcactctcccctcttctccagcataaaccgccaccgccaccagccgttgctcctgagacctgagctccagattcaactgcttcttatgcttttacttccgagtttcaacatggatgtaaagagggatggaatttcttcatcggtccctgtcgttactgtttcatgcttgccaattggttaccatgccgtttaagtactggtcctgtgagctttacaatagatttttggtgtttacactcggagctttccttgtcattcctttcatgtgtgcttatgctgagtgctgtgctgccttcgttggtcggcaaagttgtgtttttagctgcccagcggtggtgatcaccgaataatcttgttctgagttgaactgtgacatgggaaggttctaaatctaactgttcatggcttgacatgctttcggtgtgtgcctacgtgagaggatgatggttcttcactttgttaacatgtgagttatgaatggatgcttttggcttgctacaaatgtgagttgaggctaaatgctcgtcacaaattgaggttgaccagctaaaacatgcaagttttgataattgataacctgtacgccatgcggatacagcgacttgaagttgcccatcaacgaaaccggaatcaatgatttgccactataaagatttgtcatttttattgcatgtcatagtgataattgttgggctgaactaaatccacaatgtgcaaatgtaaatttatcagccggtaaatataggacacaactacatatcgacctgttgttgatttggttaaagcaacgaccacttcatcccatgcataataaatccttctttagcttaaaaaaaatgcaatggtaggtgctatctttttaaaaaacttcttcgatgacttctatcttaggatctatttttagcattatactccaatcaaaatatgtgacaaaacaagatcaatgttgaatgtatttaaacattttatttaataatttgaatatattcaatattagtcttatattttgtcacatattttaaatagagtatgatggttcaaatggatcttacaaataatatacgatctaaaaaatattcctatatcataaaagactaaaaaaaactaatataacggtatgttagcctcagtagcatgcacgtgaatcgacatgacaactaacaactagccgatagtgtgtggttctctttttctagcaagtggtctcgtttatctatttgtccgtacaacatctacgtgtttgtatctcagccatcattaactgattgaatggtttataaaagggtctctagatacaaccaaatagagaacgcatctcacaagggtgaggtaatcttcactactccctctgttttacaatggaagtcattttaacgttttccgcatttatatttagattgattaacatcaatataaatgtgggaaatggtagaattacttatattgtgaaacggaggaagtatattgattaatagacaaatcaacgattcatatagactaaactcttacgagtaaatcgcaatgagtcaagtacaaagctccacgtgaagagaatttaagtagaccaacaacaataatgacacacatgagtacgcagtactctatggcaaacacttcggtccgatccggtccggtccgcgccgcaaacacgtcgatggttcgaccgcaaccgggtgacccctgctccgaccaggccacccccgttctcctccccgccgccgccaccggcgcctcccgctcgtccccggccggcgagtcgcgtaggagggaagcgccaccggcggcggccgcggcgagatgagcggcggcagcggcggcggcgccgcgagcgcggtgttctacgcggagaagtaccacccgatccaggcgggcagcatcgacggcaccgacgtcgccccccacgacaacgccgtcctccgcgccctcctctgctccaccgccggcctctgtgcgtgctctcctccccctcctcctccttttgctccacgcggagaagagcgcgaacgccgccgcagctccctcactgactcggttggggttcggtttccgattttcgttttcagatgatccgttcggggaccccaaggccaccggcgacccctactgcacggtgttcgtcgggagactctcccgctacaccgacgacgagacactccggaaggtgcgcggattccctttggtgtgtgttgtactattagctttgctcgttttctcatggctggagttgttgtttctcgttgtgtatgtgagagagcaggagatgagcagatatgggagggtgaagagcatgcggctggtgcgggatattggtgagtttaaccaatgtgattcatgaaaacgttgcttttactttttgaagcatggttcatttgtaattgtaatggttattgaacatagcatccatacaatttatattatgccaatgcaaattgacgttgtattctgcgcggtattgataacacattggagcattgatatataagaaaatgggaagtgctgtcctgaattttggaactgtacctttagcggctattgagttgtcggtaggcagcaaatagcagtgcttcactggagcaacatgccagcatctcatcctttttcgcttttgcaaattcagtttttactaaccgaattacttgattttcagttactggtgcttctcgtggctacgcatttgttgagtatgaaactgacagggagatgcgccgtgcctatgaggttatatgatgttcttatttctactgcctgtttgtttccttcttaattcttagtacacttgaaatataaaagaatacatgttacttttgggtctataggatgcacaccattccattattgatggcagtgaagtgcttgtagattactacaggcaacaacttatgcctggatggataccgaggagatcaggtgtggttctctgccgaagttttatgcagagctaaaaatacttgagatggttttcatactacttttatttatcattttataggaggagggcttggagggaagaaagaatctggccagcttcgatttggaggtcgagagaggccatttcgtgctcccttgtatgaacccaaactcttgttgcagtccaatatttctcatgtaaagaatcatagaagaagttgctttggagtttctagacataaagtaacagcatgttgtacttctgtaaaacacaggaggccaattccgtatgatgaactgaaaaggcttgggatcccaccaccacctgaagggcgatacatgacacgttatcaggtagttcatcacttctagagggacaggctatttgactttttttttatttacatgaagtattattgcaaccgtcatttatggtttcaaaatttcatcatttaacaaaaacttgttgcattcacctctgtcatggtaagaaacaaagaaatgtgttattcacgagtgagcataaggaaatgatatgaggttgaaacttggagcgattggctagtgagaatagcagactgttgccctgaagataagggcataggaagtaccatgttcttatgtgaatcacagtcacatcacttttgcacaaactgtttagctcaacccacatgggggtgatgggagcattagtagcttatttgatgcagtagtatctgttcacagcctcgcaggcacaactgaactttctagtcactttgctatccaatgaagttggaagtgtttcattatgcttgcttactgccatgaagtgacactgtactcccactatcacaggttcccccaccaccaagacgaaaaagcagtgatatctacagggaagagtcacctcccaagagaagatccaaagacagggttgatagcagtcactacagaagatattgtagcccaacccaagacgacgacagcacggtcagcacccataggcggaaaggtagccatgaccggcgagaagaaaccgagaggaggacaagagcatatatcagcagagaggccggcagctacagtaagcggagcccaaccgaagacgatggtgatcgtcgtaagaggagaagaagccgagagcctggagaattatctccatacaaggaggatgatgataacagcaaaagaggaagaagttcagtggagccaggcttcagcccttatcagtctcatcaccacaggcatcacagggagcgtcatgacagcagcagccattctcgccacggtgaacgtcggcatcaagacgaccgtggaaaccactccaggaacaggagatcagagagccgggactacagccactagaggtgtcgagtccatggtgggttcctagtgttttaacctgaatccctggctgcctgttcgctgcttcaactcatgtatatgatctagttttctcaggcgtccttgccttgggttgcctgtgtagtgagggctactaaacctgaagtttcgactttggaatacatgaattaatagaattcatgatttagttcaaacctacctataaaattctttcattaaagccttattcagttaatcccttgtccaaggaggttgagagggactggaattaatactcccttatccactccaatcacttggtcattgggactaaacaaacaagcctagagtaagcctaagcgattgtggaaaatccaaataactccatataagttgctggtcttttcattctctccctacaacttaatttcatacaagatattcttcataagttctttttcttttcaatttcccccatttgtcttgtttctagtgattctcgtcatgctcatcgatttctcacatcctatgcacctcccgcatggtgagtgaattcctcctttgttctttattgttgggaattagatttaatacaccttatatgtaatacgtgatcgctgtcgtgttttatcgccgtacctaagaaaaaattgaagtatgcaaaagcaaaaggagaggtatctttggtgacagaggcaacttatttacctcaccataatgctcataaggcacaagaaattgccgaaaactgaatagtggtgggaagttggaagagaaaatgaacttacgagaatacaaggagagtgtgtttggataatggaaaatagagggtgggattgggattgggaaatgaatgaagggttaggattaaatgaaatagggagaatgaatgtttaggatttaaagatgtcttttggtgggtgggaaatcacttccatttcccattagccaaacattgccggagtgttttgcacgaaattaccttataggggagatttaggatgtgttcggttggagggattttctaagtttgtttgggtcgagtccattttcatagatgtttggttgtgagattaggtatgataggataattccaaaagagaatatattccactaaaaaatgggttgagttaatctagaaaaatgtgacggaccactcatatctgtgtatagcaatccgtatgagcatgaaactctacacaagagctcttcgcatcattttcttttttgactttgttcgtaaaaacaatgctcctgttttttatatccttttaagcataaaacgtgtaccactggaataaaaaatgtttgaaaataagtgtacatttttccaagaaaaaaaatctttcacgcgccacgatacaaataactcgaaaatcacagccaagaaaaaaaaaagcagctcacacgcacgcgtgaatcacatcgccccgtttccattttccaacactagtccacttaaccaccgcttccttcgccttccaaaacaaaaggaaccccaccaccgctcttccgcgcttcgcttctctcgccgtctcgcggctgcgcggcgcggcgctctcatccatcccctcctcccgcttcccccacccgccgcccgatctcgacggcggatcgccccgggatgggctccgacgaagacgagctgctcgacgacgaggagtactactactactgcagcgacggggagtgtagcggcggcgggagcgggagcgacgaggatgaggagttcgggggccgcgggagcgacgagggctgtgaggccgacgaggtcgtctccacgcgcgagcaggtgctgtctgtgaattgcgatcaatgcccttgcgtgtttcgttccgtcgttcaaatgagagaggcccccccttttcggatttctggatagcgagtggcgctgctgttgtggtgatggtgatttgtggctttgatgctgattcggttttgggtgcgagaatcctgcgtgttctgtggtaattcgacgttctgagcgacaggtgcaatgcgatgtacgagtggtttatgcttgtatggtgatggtgattagtgtctttgatgatgatcggttttgggatcagaaaccctcgcgtattctgtggtcatttgatagaatttctgggaaacaggtgcaatgcgatggtggtgtgcttagagtcgcagcgaaatttgttcatggcttctctgctttacagatagcaaaacgtttcatccttcggggaaaaaaatagcaaaacatttaccaagatctcaatagattatagatatgatgttttctcttcataaattgtttcgatagcttggatggttgtttactctacagattgagagtttgagactgctattttccttctctgcattgtatgtcattaacgtaattgtgttttggtccttttgttcatgctgccctgcctttctgtttctctattcttaattcttgtatacttggtgtcagaactaactcaaaatctcaaatgggcctcttctgtgttcattttcttatgaacagagatatgttgtgttgaccgaagatgatatacgcgagcgacaagaggaaatgataagccgtgtgtctgcaatattttcagttccaagggaatcagcatgcgtcctccttcgtcactacaaatggtcagtgccgccgctccagcagctcgtcctttctgaacacactctactgttttatttccgttgtagtgaatttgagaagcccatctcatgtatctcttgtttacaagatgtactgcaaatgctttgtgtagttatatgtatatgtaatagcattttcttactgctggcctgccacaaaggtaggatgcttttgagctaaactagaagatccttttctatgttaacaatgtatcttcattttgttgttcaggagtattagcaagctaagtgatgactggttcgcagatgaagaaaatgtccgccgttctgttggcttgccatcaaatgttgttcatgttcctgactgtcctgaggtagaattacattcctaaaagatatggagcttcattgggtttttttttatcatattgtatcatatctggtttgaattggtgactaatgtagttaactgcatgttgtaatttctatttgtttctttggttgcagctaacttgtggaatatgttttgaaggatgtgctgcaaatgcaatgagctgtgctggttgttcccatttctattgtcatgaatgttgggaaggtctatctgtctctctctctctctctccatcactcatttttacattataagttctttgtgacttcaagattttgttattttacttgtaacattacgaattgattgctattgtaactataacaaattgatagatgactttgttgttctcactttcagtagtttgtagcattcttgttcttaaaagaattctgaaatttatggtgctaaaatgaggtaaattttcagggtatattagtgctgcagtaaatgatggtccagggtgtttggtgttgcagtgccctgaaccatcttgtgatgcaatcgttcttgaagatatgattaatagtctgacgaaagatgaggataaagtaaagtatgcacgatttgtattatggtcatatattggagttaacaacaaggtaattctttaaagtactcagcgctcataatggttcacattatcgttctcccaattatgtttattaaaccttactgtattgcccatcagatagtagtactatttactatttactatatagttggtatatacttgcttatatttatgccaagtgtcaccccaaatggttttcaaaaaaacatatttctgaagtaataaaaattaattcctgcagataaaatggtgtccagctcctgattgtacctgtgcagttgagtttcttggtgatggtaactatgatgtctcatgcaaatgcaaattcagtttttgctggaatgtcggtatttctttatttatttatttacttgtatacctttcagattgattgtttgatattaccagttaaatctttggtaaatgcagtgtgcagaggaagctcatcggccagttagctgtgacacagtctcaaagtggatactaaagaacagcgcagaatctgaaaacatgaattggtttgtcgcacacataatttccttttcattcttgtatttgatagtatgtcttgtactttattctttccatcttgaatatttcttgtgtaaaatactttttttctttttaatttcctaagttcataaggaaaaactggaagctgtttctcaagtgttgttttctcccccaggatattagcttattctaagccctgtccgaaatgcaaacgacctatagagaagaatcagggatgcatgcatatgacatgca

SEQ ID NO: 69138 - DNA, 8067 bp, Oryza sativa
atcgcgctgagtagcactggtcacccgtccaacgccagacgaggtgatcctcaacacccggcgagagctgggtaggtagcaccgcgtcccagactaacaggaactgagagatgaccgggacagtgagggtgccatgtatgtcaccaacccaggagttgttcgctaacccagcagcaactgtgtgcgatccccggaaacgtggaggcacggcgtggaggaggtcaggagctatagaagctatcgagcgaccatcgatccaccgatcagtcctgaagagcgtggactgaccatctcccaggatgctgcgaatatgttggagacgctccgctcaacaggggccttcagatcagaccagtaggggtgtcccgagcgctgaagccagagccagcgaactctcaaggcaaagccagccaccctgagatccggaatgcccagtccaccgagatccctaggacgacaaaccctcgtccaggacacccgtcactgtcccccattggccgagtccgtacccatccacaagaaggcgcgacgcttcttgtcaatggctttgataacccagcttggcaagccgatcgccatagaaacatggaccggaatggaagagagaaccaactagactagaaccgagcgacccgccagagtggttagacggcccttccaggggggagccgatgggacactttatccacaagcggttgcagggccgcttttggcagcttgcgaactgacagtggaatgccgaggtaggtgcaggggaactccgagatcgagcaaggaaaagaggactgaaccagctccaggtcaagaaccgagcagcggatcggagtaatcaagcacttggtgaagttggtccgaagcccggaagcggcaccgaagacagagaggatgccttggatgaactcaaggtcttgccgaacgggggaaaggaagagaactagatcatcggcgtagagggatgcacgatgttgaatagcacgatcattgaggggaagaaaactacccgagtcagaggctttgcggagcatcgcattgagcacatccatgactagaatgaaaagcatgggggaaagaggatctccttggcgaagacctctccgatgggggaaccgtggacctggcaccccattaaccagcacccgggaagaggaggcactgagaatgagggagatccaatcacgccaacgttgactgaagccaagctgggctagcacctcaagcaagaaaggccagctgaccgtgtcaaaggccttcacgatatccaccttgagaagaagtcggggaacgcgtttggcgtggagcgcccttgccgcaagctggacatagcggaagttgtcatggagagagcggcccttgatgaaagcgttctggttaggcgccacaaactcgtccaggcgaggggagagacgagaggccaagatcttggagaacagcttcccaaagctgtgaataaggctaatcggcctgaaatccttaacgtcaacagcctcgtccttcttcggcaagagggagattagggcgtcgttgagggaagcaaaaccttggccgttggtcaggaacaaggagttaagggccgccagaatttcgaccttgatcactggccagcaagacttgtagaaacggcccgtaaaaccgtcaggaccgggcgccttatcagagggcaaggacttgatcaccgcccagacctcatcctctgtgaagggacagtccagtccctcaagctgcgcagggcggaggccaagagagtggaggtctagggcgagttcacgcttgacgctcgtccccaagatggcgcaaaagtgagaggaggcaagctcttgcagcgcattatgggagatggcaagctggtcaccatcacgaaggcgtgtgatgaagttcttctgcctacgagctctggcgtgcatgtggaagaacttggtattggcatcaccctccttaagccagaccaaacgcgaacgctgacgcgcgatagtacgctcaagcgaggcaagaccaagacacttcaactttaaatctcgccgcagccaggtctccaagggggaaagagaccgactctcctgcgcaacatcaagccggaagacaagttccttcgccatctgaagctgcagacgaacactgccaatgtgacggtcactccagctctgtaagcgcttggctgtggtagagaagcaccaggcaagagcggcaagagggggtaggttggcagggggatgccaggcgtcctgcacgacttgaagaaagccatcgaacttgggccaaaaggcctcaaaacgaaaacgatgcgctttcggggaggtgacgcaggtatgaaggagaagagcacagtgatcagaggcgatagaagaggccgcttggaggaggcaagaggggaaaagctcctcccaatccgcagagaagaggacgcggtcgagcttaacaagcgtgggcgactcgcgctcattgctccaagtgaagcgacgtccgtgaagcggcagctcccggagttccaactcgtcgacgagccgacgaaaacaacccatcatacgacgattgagattaaggttgtttttatcccgagcttcgagaatgaggttgaaatcgcctacgacggcccacggccccgtgcgagaggagtgcagcgaacgaagctcatctaagaaacgaagcttgtcaggctcctcctgtggcccatagacgatggagagccaccagggggcgacatcagaagagtgtcgaaccaacgcggtgagagagaaatccgcaaggtgaacatctgagacagaccagacagtcgtccgccaggcaagcaacacccccccactccgaccgaccgcaggcaagaaggaataatcaaagtcgaggcctagcatttccagaatagtacgagaggggattacatccataatagtctcctgaagacagagaatagagacatgctcatcacggactacatcacgcacagcatcccaacgggcgcgcgagttcagacctcgcacgttccacaccaaaacgttctcgttgcatgatcccattgtgggggaccacaccgagagcagaagagaagaaaccgatcagccgcacacgaccaacgcctctgcagccttggccgggggcaaggagctggagaagagcgaggagagcgtgatgatgtgctcttgggaaagtggcttggagaagagggcgttgtaagccgcgaccgcctcggccgtgaccgggcccctctccggaactaggccgagcttccgcatcaggttgcgctgggcgcgcgacactgcgtggatcgacccctcaagcgcctcaagtgccatcttagcagcgatacgctcactgcgcttcggcacaacctccaccaccttggcggcgagaggcggcagcggcaaaggcggcgggaggagcgcaggagggagaggcctagagcagctggtgaggaaggcgcgaagagcggcgttgtctgccacagaagatggaagcgagtgcgccagcgggcggccatcgaggtcaaggacaaccatcggcacatcgtagaggacgccgtcgggcccatcaaccaccaaagttggagcctgctgaggaagcggcgactcaggcctcaaccactccccaccggtaggctgtgtgcaggcagtccttggcagagaagtgccgcatagggtgttcacatataaagttttagcatgttaaatcgggtattatttagagtgtcgcatagggtgttcgggcactaataaaaaaactaattacaaaatccatcagtaaaccacgagatgaatttattaagcctaattaatccgtcgttagcaaatgtttactgtagcaccacattatcaaatcatggagcaattaggcttaaaagatttatctcgcaaattggttgcaatctgtgcaattagttattttttaagcctatatttaatactttatgtaggtgttcaaacgttcgatatgacatgttgaaaaattttgttgtgggatcttaaacaaggctatgaacaaaaaaaccgatgtgagatagttggctgcatcaaccaaaaggctttctagcttgtgcactctgttcattcgtgtgtgtgtgtgtgatgcaagtgaaaaatacgtgagtgtttgcgataaacaatacacaagagagggagtgattccaacaatcaattctattagcaaatagatatattcatttttagcctttctaattgagatttgaataatggatttgagtatctaaaagtattaaaaaaaagttaactagaaaatcataaatattgtcaagagctacagttttcatataaaccttatcataattcgaatttgtataaaaaagttaagtttatatcccaaaccgacacggatgcttattaagacccgacattgatgactttttccatcaacaggctagtccatcccactctaatcgacttgaaccgacactgatgattaaccgatcaatgtcgggtattcttataaactggtatattggtttgtatgtagaataaccaatattggtttgtatatgacccgacgctgatgtcttcttattagtgttaggtgttacctctgcgtagtgctagagtgttagggcggaaaaccatcattaatgttgggttttattgaaccggcactgataatagtgacaccgatatgctattatatactcccttcgttttaaaatagagcaacttttagctatcaggatttgtcccaaaatatatcaatttctccaccaacattctcttcccaaccaataacaaccctccatcattcactttttccacataactccactactcatccaatcacaactctccaccactaacttctatctacttttttaataaccgtgtctaacactaaaacttcttatattctggacggagggagcagtatttatcaatacgcaggtaagcgcaaaaggtcagacctaatccctaaagaacttaaggttaagtttggttcaaacttttgctagatacgtgatacgtcactcaagtaggtatatactccactaaagaacttcaaacataataattgctctccaaatcacagtcaaactaattatcccacaaaacaaagttaaacctgcgcctaacaagtcgacgtggggcgacacgagtggggccccgggtcatcaaatgcaggcatgcagtagacagacacctacgtgccctgtacacgtccgtacatgaacattttgatggaaagataacgacagcgacagggtaatgcaggtggcacaaaggagtacagcaactcaaattggtcgccaactctcaccattttttctgaattccaggtgtttctgatctcctctgttcgtgattctgtccgatttttccatttacatccatacacattctctggcctccttctagaagacgatgtcgcttttattatttttggctattgcgtggagggttggaaccttccactttcgtatatagtaaaaagaaaaaaaatattaactgcatactttttttaaaaaaaaaacccaacctaaaaatgtgacccctcctagtataattcagaatcgttgtactgggagaggattggcttttttgggacggagagagtagtaagttgctcatcttctagtctacgtctccggattaatatcttcccgattcataatgcgacgaagggtttcaccggccggagctcgccgccgttgaggaagtcggagtaccaccgtgccgagctcctgacgtacctcgtcctcgccggcgcggtgaagtcgacgcagcacaggccaaagcggttgccgtagccggagaggaactcgaacccgtcgagcagtgaccacacgaagtatccccgcgtgttcgatccgttcctgcatcgcgaaccaagaaactaaattaactagagtgtctctctctgaagttccaaagatttctagactggacattaatttgacgttatagaaattagtttatttttcttcaaatttagccatattcgaagaagtttaacttagaataaaaactgaaacaccttacaatatggaatggagagtaacaagcagggagagtgagcacaccgtatggacaggtgcagaacttccaggtagctctgcaagaaatccgatctaaagtcgtcgtcgtagtcgatcttgcccggggtctccggtgaatctgcgtcgcctgagccatcgagagggaaaaaataaaatcatattcacatcacattgatcagatttacattacgtatgttcagaaatagctcgataattcagaccatccattctcgtggatcatgactggggggttgccatacttgagcttcagtgatgtagcatcttgccaagagcccaggatgaagctgatagtgctcctgtaaagggagggagcattcaagcaactgtcaagactgaatttctgatgcattgaaaaattttctgaaacaactctgctccactgcagcatgattatctatatattaccttgtcgaatcctcctccaccattctctgcaccaggtgagcagcaagtcagctcggtttaatctcatatatggaactcaaaaaactaatgcagttgactgtagaaaaacatggcaatgcaagattaatttgcttgggaacatctggcctgtggttgttcagagatccttaccttgaacacctgcatcaacgtagtagtcccttagtttctggtcatgatttgcgtcgctggattgcacaaagataacgaagtaatggttgatgccgatgaagtcgaacgatccccgtattttctccgaatcggacgccgttatggatggcaaccgagcgcctacgcggctcctcattaccggagggtagtctccatgcaccagaggattcataaacctgcattatttcagaggggtacattgtaaattcaggagactgacaaatagccaaactgaatgtattttcgtatgaacatcgttttgagtttgaaaaatctgagtatgaacatcgttttgagtttgagacagtagtattcgactacaatttaagtagttactaccgcaatttaagtactaactaaccatccaatatggaattcattcatcctgattgcagcagctgcatctgccaccgcgtcggtgtagggctcataccaccagcccagcagagtgatccctatctgacctccttgaattgcctgttgccaactttccatgtccaaatccaattttcagggaccattttatcttggcacgtgaaagaaacacaaatgcataatgaaaagtattttgtataatggtgaacagtaggaattagttatggaatttaatatgacctgatacttctgtctgtagatggacactgccgaggcatgagcaagcagcaggtggtgagccacgatgtacggctccgtcgaggagtcgccgccggtgcagttggtgccgaaggggtaggagcaccgccgcggcggctgaacgccggcgtcgtagccgccgatgggctctatgttcggctcattcactgtcacccagtgcttcaccctgtcaccgaagttcttgaagcaaacctcggcataagccgtgtaatcttctctgaaaatatatggtagattacaccatgtcaggctgtcagcatgatcccctcaaagagaaattgcctgaattcttcaccatttcgatcactttgcattgcgaaaagccgaaaatgttcagcttgtcagtttgtcacacaggattttgtggatttctcagggtgcttacatgaatctggggctgagtattccaccgtactcatcctgaagggcctgagggagatcaaagtggtagatggtgacatgaggttgtattcctgccaaaacatggcagaagatgggtcttgattgatcaagattttggtaattaagaatagagctgcatggatcatgtaatgtttaccgtgcattatcaattcgtctatcagattgttgtagtattccaagcccttggggttgatctctcctcttccatctaatccaattgaagctccctgtcagaaatgttctgaagatattcaatactaccttatttatgtgattatgtctacctggaataactacgaggccatacaatggagaatctgtacgcatacaggcccatgtcatacataagctttacatcctactgaaatcattga

SEQ ID NO: 69139 - DNA, 14548 bp, Oryza sativa
cttgatgggtgaaagtatcccagatgctaggcttcctcccatcctctgcagctgccccttccacctactccaggtgttgttatgttacaaagttgcagacaaattcagatcttgaacagcaaagatcatgccatacaaacaggaaacgatacagaaattaaacagaaatccaaatccgatgcaacaaattcctgccaaatttcagggatatcgtatcgacatatgcactgtctgcacaaataataacatagttcatctgacaaagtgaggtgaaactggctaattaatctaggagtacttggcacctggaaagcggaggtgcctgcgccgaagacgaagccctcggggaagtcatgccgggtgagcgcggaagcgtctctcgccgcggcggcgagcaggaggaagacgacgacgatgaagggcgagggcacgagagctcgtgccccggccgccatggctgctggctcagctgctgtgcctagtgcctaatataaagatggcgaggttttgtcttctcctcactgtttgatgctgactggagagtggaaggagagacaagtggcactgaagtcgacgcttcttttttttttcttttgggatttttgtgtccctgtggggtgggccgtgggcctacgaactcgggctattttgcccggcccaatggaagatggggacaggcccaatgatggctgtgttcggaagacagtgttactaaccggaagcacggaaaactgagcggtccattagcgcgtgattaattaaggacgtgattacacagctagtggtagctggtttgtctaaactagctaccactccatacgtaagagacactatccacctatactttaaatacaattttctcttaaactacttatccgatctacgatccgattacaccgttgtgttcgtaacaattaaatcttaataacaagatcccacatgattatattttgatgaaaaattataaattacttttataatatatctaaattacttttagatttcactaaattacttcttagacatatgaaagtaaattcaataaagcctaaaagtagtttacatatattatagaaataacttataataaaaggaaagtaactttaatgaatgtcctttttcattgggcgtgactacacagctaaaaatgaaaggaaaaaacaatcgatgattttatagatagttacttttgaacaatgcaaaagttatttccaattaacattgaagttacttttaaaaactgttaaacttacgtgtgttgatatgtgccgattaaattttatttctagataaattcatatttttatccctacaacgaatttacttctaatgtcgtgacaaagttacttccgttttgttttaaggtacttttataatatatgtaaattacttttagactatattgaatttccttttatacgtctaagaagtaatttagtcaaatctaaaagtaacttttatatatatatatatatatatgataaaagtaactttcacatgtaataaaagtaatttacaaatataaattttttttcatcgtaatataatcatgtaagatcttattgtgaagatttaattgtaacgaacacaatgttgtaatcggattgtagatcggataagtaatttgagagaaaaaattataagaaagggaaaaaacatgcatgtgtaatgaaaacaggcatgcatatgtactggcttctccactccactgttcacacggttgggtctcgcgttaagactatcgcgagaggcctcgctagatagacctttttttgcaaaagtggatcaatatgacttttttaagtaatttctgtatagaaactttttataaaaaatacactgtttagtagtttagtagtttaaaaaacgtgtgtacggaaaataaagaagttgcaaaccaggggcaacgaacacagctggcatggtttaccacctggttactaaccatgactatctctcatggatcacaacctgagtgatactgaccgcgactgagttcttttctttgctttctaaacttgcctctttcatttttcagtacatactttttaaattactaaacggataaaaaaatatatatatacaaaaaattatattaatctattttcaagttttttttctaatacttaattaattatatattaataaatgaccacattttttttccgggaagtagagttcgagaagcttctggtaacagttgtttctttaggaagctttagtttctcagacaatatagattcttacctagattttaagaatatgtagctataaaatacagaaaatgaccatctagttgtttatcaaaatcttaaaaatttctctagtagagcctcagcttctcagaatcaagtcgtaaaaaaataaataataattatgtagatttctccggagtcacaatgtgatgtcggatttcttcggccggagctttgccgccgaggaggaagccatagtaccagcacatcgagctcatgacgtacttcgttctcgctggcgcggtgaagtcggcgctacacgggccgtatcgcatgtacaccgtagccggagagcaactcgaactcgtcgagcagcgaccacacaaagtaccccgcgttcgatccgctcctgcacccgtcggtcgccggcgaaccgagaaactaattaagcatactctagctgaagtccaaatgtatggaatatatattgcaatataatggctttctaatttccaatattgttccgaactatcatcccaaaaatattatttattgtacacgttccatctctcgaacgaacattccaaagagaaggtataccgtcctatggtttcttgacctatcgccctagtaattttatgacttacttataggatcaaagttaaaatattttataatttaaaacagaaagagtagctacgaagtacgtgctcagtacatgtccgtacatagacatggacttttttagaagaaaaaaacaaataaaaagataacgacagcaacagcgaaatgtcataggtggtacaaaggagtgtagtaactcaaattgatcaccatttctgaattccggctgcttctgatcgcttctcctctcttcgtgattctgtccaatttttccatttacattcatgcatccatcctttggacttctagtcgccttcttctagaaggccaggtcatttttatttttaaccaattgcgtggagaggtgaaactttccactttcgtgtagtaaaaaggaaaaaaaaagatattaccccttttatttctagggacaatttgaaccatccacataaattttacaaaatttatgatatgccaccctgacccatatgtcattgactcatgtgggtcctacgtgtcattgagatacgggtgacatatctcaaattttgtaaatatagggtggtatgtttccaacaaacccttatttctatatgacgttggttaattcatcatattaaaaacaaaaggaagtactagtactccctccgtattttaatgtaggcaaattttgctacaagacactatgatttcgtggttttagccgtaagacattgcccaaactcacttctaggagaaaacactccataacatggtaatttgacaatggacaccgcgctatataaaataataatttccggttgaggaggagagagaaatcacgtgaaatgtcaaaaatacccttgggcccacatgtcaactctccatctctcttcctctctttcttcctctctctctctctctcttctcccggtcatggcttgctcggcgacggcggtgacgcccgtagcgcgcgcggcctactcggcaccggtggccgatggaggacctcctcctccacacctgacaccggtggccgcctcaccgtgctcgacacgctcgccaacatcagtttgctcgtcctcgccggcggggatctcgagcgccctggggcgggcgcgccagacgaacgccgcgccacaagcacgtcgaagctcgtcgcgcggccacggaggtgcggtggcgacgtcgccggggctgaaagaaaaggtgcgcatgaccatgtcgccggggaccacggccggcgccgggggcgcgacggctacgtcgttgtactctcggagctagaacgccggcttgggtggcttgcgcgcatccagcagctagctcgcgggatcggcgacggtgtccatgaactgcacgacactggaggcatcgcacatggcgtggttgaggcgtattccgaggacgaatcctccgcagaggaggcgggtcacctgtccgtccatggatcaagtcaacacatgtggacatgtgccatgcatgccaccattgtcgatgcgtgaatgagcaaaaatgaagcttacctggatcagcagcaatggcgtgccgagcaccgcgggcggagccgtccacgtcgaattgaagagcagctgatccatgcacgggaacggcgccctgagcccgtgcggcccgtgctcgtcttcatgtggcccgtcgctgctgatgcgggtgctgctgcgtgaggcgctcgcgctcgagtgccacaagcagtgcctcggccgccgagtaggccgcgcgcactccgggcgtcgccgccatcgccgagcaagccatgaccgggagaagagagaaaggagggagagagatggagagctgacatgtgggtccaagggtatttttgatatttcacgcgatttctctctcctctccaaccggaaagtattattttaatcggcacggtgtccactggcaaattaccatgtttatggagtgttttccctcaaaagtgagtttgggcagtgtcttaggcctaaaaccacacataacgagtgtcctgtagtaaaatttgcctttaatgtatgacgccgttgactttttaaacaacgattgaccattcattttattcaaaattttttttgtgtaaatatgaaaatatttatgttatgctttaagaacatttgatgatgaatctagtcataataaaataaataataattacataaattttttgaataagacgaatggtcaaacgttagataaaaagtcaacggctttatacattaaaatacggaggtagtaataacttagccagcgttggccatcttcctgtactgtacgcctccgaatttctctggagtgatcacagtgtggcgtaggatttctccggccggagctcgccgccgcggaggaagccggagtaccatcgcgccgagttcttgaggtacctcgtcctcgccgcggcggtgaagtcgacgccgcacaggccaaaccgcaagcggtagccgtagaggaactcgaacatgtcgaacatcgaccacacgaagtatccccgcgtgttcgatccgttcctgcaccagcagaccaacaaagcccttgttcaattcctaactttttctttaaactttcaacttttccatcacatcaaaattttccttcatacataacttcatacataaacttctagtttttttcttcaaacttccaattttagtcaaacttttaattttaacgtgaaactaaacacacggaaactaattaagcaggaggggatcctctactgtacagcatatgtagtaggtgacccacatgtcagtggcacctactttaggtgcagtacagcacacaatttgcatccattaagcacaatctatcttaagtccgaactgagtagtacttccgctatatataatgagctgtttcagttttgtgctaagttaaagttctctaattttgactaagtttataaagaaatgcccactcagatttttaatagatgatgacattgaattttttaacatatgttcaaccatatgtctaattttgactaagcttttatcattaatgataaaaccaagtaaaaaattaaatatatattttcaataagatgaatgtttgagttaacggtatcatctgttaaaaaccaaaagaagttattaatatctttaataccaaataaatgtaccatcacgacatattttaatgtggattttaataaaattaatttgatgttataaatattggcatatttttctgttttagttatgtttaaagaagtttgtcttagaaaaaaactaaaatgtcttacaatatgaaatggtgggagtactcccttcatactagtaaaggaagtcgtttaggataatgtttaagtcaaaccctgggaatataaatcatgaataactctcaacttgttaagtttgaatatgtaaaaattatataaatagatttatcttaaaaatactttcataaaagtatacatatatcacttttcaataaatatttttatagaaataagaagtcaaagttgtgttttagagaccatgtcgctgtccaaaacgacttcctttacgagcacaaaggaagtaagtagctaggagagtgagcgcaccgtacggacaagtacagagcttccaggtagccctgcaagaacgccgatctgaagtcatcgttgtagttgatctttccgaagatatccggtgaatctgaataacctgaggcatcgaggaaaaaacataatttacatcgtactaagccagtgacaaatgccattttaaagctaccaagaactatggaagatggattttcatccctctagatgagacctgttcgtttcttacatgtcacctaaatagttgtaatttgctttttttaagaaaaattaacaacatagattaatatatatcatttacaagcatgtaagatcaaatttgatttcaacaagttagaaaaaaaagaataaattaaactaaaaatagtcatatattcacagttatattcattatttctgttaccaacttatagaagttaaatttttaacttacacgtttgtggatggtatatttcatattaatctatcttatcattttttaaaaaaagtttataactttttaggtgacatataagaaacgaaggaatatccccctaagggattaaaaacatttcccacgcagaattcggacctaccattttcgtggatcatgaccggggggttgccatactcgagtttcaggtgattcagcaccttgccaagagaccaagaatgacactgaatgttctcctgcaaagggagcatcgaaagaagaggtgttttactcatatctatttatgttaccacattaattaactactagtagtaaaacttataaatcaatggttgagatcacttccaaagcgaggatagtaaaatagtgtcagtagagagcaccatctcgaaaggactatcaagactgaatttctaatgccttgaaacattttcaaaaacaactctgctccactgcagctcgattatctatatattaccgtgtcgtcttctcctgcaccagatgaacagcaactgatcagctgatcggtttatggaactcaaaaaactaatgcagttgagagttgattgtagaaagccatggataatgcatgcaaagtttgactgattacttagcttgggaacatctggtgttcagagattcttaccttgaacacctgcgtcgatgtagtagtcccgtagtttctgctcattcgcgtcgatggattgcacaaagataacgtagtaatggttgatgccgatgaagtcgaacgatccgcgtattttctctgaatctgacgccgttatggatggcaaccgaacgcccacgcgactcctcatcaccggagggtagtctccgtgcaccaaaggatgcaaaaacctgcattttcagacggagatcagtacattgaaaaaacaggagaccgacaatttgttttctaagataattgatagaaatctgacctcgcaggctcgcacaagtggatatacacggtcagaagatacagaaatactccctcctttccaaattgatcatcatataatggaattcaaaatttcttaaattgaatatcatataaccacatagacatagatttcatcataacataattaatacaacatggaagaatgtctgcatattaaggtgtaattggtatggtattttaatcgatacatgcattgtgggagaatatgtgcatgatatcttgattgatgtgatttaaattatctttggtcttggtacataaacatatatgatgatcaatttaggaatgagggagtacttgactaacaaattgctgaaccgaataaagtttcatatcacaaacacttgttgttttatgcttgaaaagtccgggtataaacatcgttttaagtttgtcatgagtgtacttgggatttgagatagcaatgccgagaatttaagtactacggagtactccctccgttttaaaatgtttgacaccattgactttttagtacgtatttgaccgtttgtcttattaaaaattttgtgaaatatgtaaaactatatgtacattaaagtatatttaacaatgaatcaaatgatatgaaaagaataaataattatttaaattttttgaataagacgaatggtcaaacacgtactaaaaagtcaacggtgtcaaacattttgaaacggagggagtagtagttagtggagtagttagtcagtggagtagttagtatggcatggctagttggtactgcaatttaagtagcagtactaaccatccaatatggaattcattcatcctaatggcagcagctgcatcggctgttttgtcggtgtatggctcatgccaccgaaccatgagagtgatccctatctggcctccttgaattgcctgctgtcatgtccaattcaatgttcagggaccatttcttggtatgtgaaagacacaccaaagacataccaatgaacacagtatgaattcagtattgtgacctggtatttctgtctgtagatggacactgccgaggcatgagcgagcagcaggtggtgagccacgatgtacggctccgtcgaggagtcgccgccggtgcagttggtgccgaaggggtaggagcaccgccgcggcggccggtcgccggcgtcgaagccgccgatgggctcgatgttcggctggttaaaggtggcccagtgcttcaccctgtcaccgaagttcttgaagcacacctcggcataagccgagtaatcttctctgaaatataatatgtggcaacatgtcagggaattgactagtggttgtagtgacctgagtagcaccctatggtcctgagttcaaatcttcatagaagcgaatttcagattgagttatttgagggctaagttccctgcttgataggctaagttcctaatttaaaaaggttgcatatatccggttggatgtagagaccgggtaaaaaatacccatctctaaaaaaatataaaaaaaattttagggaattgcctgaattcatcaccatttggatcagcttgtgtcatgaaaacatttagattacataggattttgtggagtttctcagggtgcctacatgaatctggggctgagtattccaccatactcatcctgaagggcctgagggagatcaaaatggtagatggtgacatgaggttgtattcctgccaatacatgacagaagatgagtctaccgatcaagattcagctaggaataaatccaaggtgcagcaagtaatgtgtaccatgcattatcaattcgtctatcagattgttgtagtactccaagcccttggggttgatctctcctcttccatctaaaaacaatttgaaactcactgtcataagtgttcagaagatattcagtagtactaccttatttatgtgattatgtctacccggaataagacgaggccaagcaatggaaaatctgtacgcatccagccccatgtcatacataagctttacatcctcctgaaatcattgaaaataaaaaaaggtagattaaactgatcttttttatagattttgtgtcatatctgaacttatcactgaccttgtaatggtgatactgatctgctgagacatctgcattggagccgtcaggcatgtaccctgtaagcatcaatcatggacatattcattctagaacaatgcaactatatgcatgcgtaaataaagaacatacaagaaaaaaaatgttctagaataaaagcatgaggagaagattatcatctactccatttttttggaccttgattgatgaaggtgtcccaaatgctgggcttcctcccatcctctgcagctgccccttccacctactccaggtgtgacacatttgcaaaaacaaattcagttcttgaacagcattgctcacacggtagtaagcacatatcttggcatatacaaacatgatgcaatacggaaacacaaatccgatgcaacaaattccgccaaatttcagcagagcatgagcattgagcgtgagcaggatgagcatctgagcatgatgagcttctgacatgcatgatcgatggattttatgtatatatacctggaaagcggaggagcctgcgccgaagacgaagccctcggggaagtcatgccgggtgagcgcagaagcctctctcgccaccgcaccaagcaagaggaacacgacgacgatgaacagcgaggacacgagagcgagctctccggtcgccatggctctagctcgcagctggagcaaggctgctgttgtgcttaagtaggcgaggcttgctccttcttctttctttttttttctttctttttctttttctttttctttttttttttgagaagggctgcttgttcttatcatatcaaatctttagttttcgtgacccactaccaacagtgttgcgattcatcttaggccagagaaatgctgctacagtactacagtccctcgccatgcatgcgccgtcagatgtccaactggtgattccatccagccgtccacacggtcatcgctcatccctccatcccctcagtccactcaatcaccacaccagccaccgcctagacatcctcgtcttctcggcgccgccgccgcgctgtcttcctcctgcgatgctcggctggcgccgtcttcctcccgcggcgcccatagtcaatgaacgatgtttttaatatcctgcagtggttcactgcgcaatattgtcaatataactatagaagaatcaacctggatgtccctagatgaaactgtgaacatgagatccaaatggtgaaatggtgggcataagagcaaagtattgacatctcatgtagctcctcagagctctacctaattatgtcaagtattagcattaccgttacagtcaaccacaaaatcgaagagtacctcagtaatagaacagttaaatcgaagagtgtacttcagtaatagaactggcttcttttgcccaaaaagtactgcaaggtatacatgctttagctatgttattattgctgaaacatctttgcttgtcacaccaccggttactaatcagtttatatgtcacaccgctttgattgctcctttgggaaaaccagtttgccaagtgctaatttacacctaaagtttagtatctactacgtatgttctaagattaatattttacacttagattggtatctatgtgttaagtgttaacggtgtcaacactatgatatgctctagtttacaactaaagattagcgcctatgtaaattaccagaaggctatatatcaagctatatgaatctgaagcaccacataacaaagacatatgccattaattttgtcaaatgttgctggaatatatggtccagtagaaatagaacaataagttagataatggagatatgtttcactggactaacagttatccgatgcattttgagctttaaagagaatataagatggatggtattagtagtttactaacaaattgtgcttctatcatcttgtttcggcgcaaaaggaacagtacatgcagttggctacaatgagggcatgatgtgacaaacagttaatttgaggttccaaatatgaagatatcgatagttcagaaataattataagtatgtgctagaagagatcatgaacatgatatatgctattcttgccaaattcctatgcttcatctttcatagagctgcagagaccaaggcagtttgctcaaaagtaaaataaataatttaagatgcacaaggtttgtagatcaaacctttagtttttaaactgtattacaccaacagtgacaattaatccctatacacagatatgtacagttgtacactccgatatagagagatggagaagcaagttggttgaactgcacatatggttgtgtgaggctggagagtggagataatttggagaattttggattcagaggtgaaattaaagcttgttaatgaaaaccgatgtaaattctatatcttaaataagaaaagtgacagtactatggccccgttcgaatccatttaaaagtgtggattaaattttggattatagtggtatgcttttcaaactgttaaacggtgcgtttcgtgcgaaaactttctatatgaaagttgttctaaaatatcagattaatctatttttcaagtttgtaataattaaaactcaattagtcacacgttattaccacttcgttttgcgtgaaacacttaatctttatcttcatcttcagaagattcaaacaccacctatctatgcctagttgcctactggtgtattaaattaaggtattatttgtgtcactgttgggtggggcccattcaggttcgtttatttgcccggctcaatggaagatgggcatgggaaaaccttttcaaccaaaatttggcgcacactaaaaattagatgctaagcaaatccatttctcgaaaaaaaaagttttgttttttgtatcaagaagttggcacatactcgctccgtaaaaaaacattacctaacccctcctagtataacgaatctccgtccaaaaaaactaacctagatttgttgtactagtagatgggtcacatgaccatttataggttagtttttttttgacagagggagtaggatattagttccttttcacgtatcaattttgaaaataagttttgtgatagtttatttttaaaatttataaaattaataagtttaaaaagttaaaaaaaatctgcgtgggagccgtacgagcatcgaggtggcagagtttagtacagacaatataaaatcaaaccctagcatttcaatgcaaaattagtggagagtgaaaacgactaaaatgtctctcattattgaaaaaaatagtaattgtgataggtagataaatgatattgaaggaataatacttctcattttacgtgttgagggtaggtagaatggtaaaagttaatttcctgtagaataaaatttaaactttagaagtcgattttttttatagagggagtacaatgtttggtcaaacgattggcccttgccgtgcagtaggagtccgatgccggttgtggtttctgaatttagaaactgtaataggttttggaaatagaaagattgagttctgatgggattagaagttgacttctagtactaaatctatgtcggagattttttatataaaaaatagacgaagagggttagatgaacaataaaagttattaatatttgcctagggtttaatatattcatagatgagagaggagtgatttgtaaacaaacacacaccccctccaacaccaacggcctgaatttcgccgtccccttggcggcgcctcctctccttgcgagttcgcccaccgcctgcctgcgccgatcgatctccataggcgccgtcttcctgcggcttccgcccgggtgagcatcctgtccagttacgcaaacccaccccacttttgtctcggatttttgcttgcgttaaccctagcttctcttgatctagacctgtggaagaagctcttattaatattaacaagtacttcctccgtttcacaatgtaagactttctagcattgctcatatttatttagatgttaatgaatctagacatatacgtgtttagattcattaacatctatatgtatgtgggatgctagaaagtcttacattgtacagtttgtccgttccccccaaaagtttaggggagttattagccatgagtttgttcttgcatttactactacacttgattgaacttcgtaccagcgactgtcatcttccgagaagtactgtaaaaagaaaggagatattagcctgcttaatattaattgaagtgtttaattgcattttctttaatttgcagttgtgtaattgtattttctttctgatttgttttgccaggttctaccttggttaactatcaggaaagatgtcaaataggtcaaagttctggagattagcagcgctagtccctgaagtgcagtgtcctgaccagcccatctctccccgtcaaaaatttaaatacacggccattgtacttttcatctttgtgactgccagccaagttctattgtatgggatccaacaccaacctcgaaccattgagcctgatccattacattggctgcatctgattctggcgtcaagccgtagtactctcttgtcgcacgggatcgtcgctattctagtacctgaggttctggtgaagatctgggtgtacctaaagatcataactctcgataccagtgcacctgaaactggtgttcttatgtaagtgctgattctgctcacctccaattaatctaacggcaatatttgcatatggagagatggaatggtgacagtcgatctgctatgctttgatcggtttcataaagaaatgaatatt

SEQ ID NO: 69140 - DNA, 3094 bp, Oryza sativa
attcctgcagcccttccacttgccatattcttccaaggcttctatattgtactgcctgtcaggacacggcgtaattttcaagcctactgccacatcaagctctcacatttcttgtatgggcctgttgtcttgcaccgtttactgctcccacttccttatgttgcctcaaaggtgcttgcctacactattacactttataatgtgatactactaacactgctgaggcttcctatgtaaaacatgctaactctgttttttgggttgcaggtgctgtacaagaaatacagtggaaacacactagtgaatttgcttggcaagtgggatggattgaaccattttggacagtctatccctgttggagggatagtgtactacctaagaacgccccctatgtgagtgcacatacttgtggaaattatattgcccacatttctgatttcaatttaaaagtatgacttgatacctaagtcctaagtgttgcctttttttttgctttgccttatgtttcccttttctctcctgcagcttggctgatttgcacagggacccgttccatgcatttatatatgtcgcattcgtgcttatttcatgtgtgtttatctcaatgggtcttatggtctgtgcatcttcaaaaggagttttcaacgggtttgttgtgttaaatgtatgtatgaaaagaaactctgcgcagcattgttgttttaccctcttcccctgttacatattagcaagttaatccgtttactttgattgattcaatgcagatgcaggaggaacgaagactgaggcttgcccagcccgactcaatacatgcgaacgaaattcggcgtcatgtcatgagggcagcttgtgttggtggtttctgtgccggtgtactaataattttcgcagatctcattggggtgttttgttctgggactggaattatgcttgctgtgactgcttcatatccttatgttgatggcagagctagtgaggtcgggtcctttggcttctgactgatcgagatatctactcctaaataaagatgagatacagaaagcggctacttgtaacgagagttaaatccatggatatttatttattatgtagtctgcaagaagctaatttttttttctttttacaatgtatatatttgttatttgctgaaaaccggtgtttcagtgaaacacactaatctgttttggtcgcaacgatcagggttaacaattccgacgaaaaccggtcgaattctgcgaaatttcgaggtttcgacgaggctcgaaagtagaagccgttcgatgagtttaatccaaattcaaatttgaattgataaaaaaggaaaaaatcaaaaaaatcttataaacaatatgatattcatataatctattgggatataaattttcgaaaaaattgatgtattccgtatatttactgaaatttacagtagaaaagaaaagtaacgaattaaaaaaggaaaaaaaaatcagtttacctctttttctagttaccgattgaaatttcaatgatttcgcttggaattttgccaaagccgaccggttttcgtgagcttatcggtaaactcaggaaatttgttttcgcgggtttatgaaatttgttcgaaatctaccggttttccaccaaatttcatgaaaaccgtcattccgccagagcccgaaacagaaggccatctcggaatcgtaaacacgggcaacaatgttggaaatttggaactaatgaagtcaaggtcctgaaaaaatccccaacagctactgataaaccaatggaaatccccaacagagtcaggtcctaataaaaggtcctgaaaaaatccccaacagagtcaggtcctaataacaggtactgatagaccatactgatccaacacggtaataagtcctgaaaaattatccccaacagagtcaagtcctaataacagctactgatagaccatgctgatccagcgtaatccccaacatagtcaggtcctaagagcacccgccagatataggcccagatgggtaatatcatgcggagaccgagtcactgctcgtacggctggaactggatccttctcacctgataatgtaacacagaacattttagcatgcaaacactcaaaaagcattgcatgcgcaaacaacattcatttcggcttagaatttgcagagaattaacacttacccccaacgaggccgatgataagggccacccagaacacggcgaatacgctgccgacggcccatctgagtataccagatccggcgccggcgccgtgatccacctctacgaatccggcggcgtcgcgtgcagcaatatccacctgcatctgcgtgacgagctgattgaagcgaccatgcgcctctagctctctagcggcctcggggactcccccaaggaacgtataagtctctgcaagtacacgcttgatcagtgcactcggtggaagccgacagacaaatgtacaagatgtgattgcgaagacaatgttcaaagatctagatagttttatatacaccataaattacattaacaaatgagaaacattaatatctactaacacattaatttctgaaacatatatatagatactatgtgctagacaaaaaagcaagattaaattacttgcatgtaatgtttggcattgacactacagacttcgagtattgggaaataattgagctagatttcagaattctattattctattattgataaggaaaatgcacttgattctaacaaacgaaccacaagttctgcaaaacgcaacaaacatttaaccaaagatcacagaacaaaaaataaaaagaggggacaagaattatccttcttcgctgctaagaaatctggtgctgaaggaactaaagaaatttcctaaatctatcttgtaacttttttcctcatatatgatctttgaaattaacaaatcacaaattcacaaagatcagtgtgatttaagaattttcaactgtaaaagaataggagttaccagatggaatggggagacacagcaggatggctagcggaagaagataatgccatcgaaccatcgctgagcggcggcggcgggcgagtgcagggtacacggatcgcgctcggccaggctgcatccgga

SEQ ID NO: 69141 - DNA, 4446 bp, Oryza sativa
aaaaaggcgccgacttatatttggcagctcgggcgctgggctcggttggagggagccttgttgttgttgttgttgggcccccggcccatttagcccactcccaccccagcctccgcccccacccccgtgtgccgccgccttcgccgccgccgcgcgccgccgtcttccctctccgccttccgccgccgtcatgccacgccgcacctccaccgccccgcgacccgagacggaggcggcggcggcggtgtagatggtcgtggcgtggtggccgtcgcgaggatttcgggtgcagaggtatgggattctggtgtagtggattttgcagagtagattttggtaactaggagtacttcagaacaccatggcttttgcatttgcaagtacggtgacttgggtgccgcactgaatctatgattcgattttacctgttttggttggatggaggagaaccggagaagtggcgtttcgagtaagtttggcttctttatattactgtactcaattaaggctaaaaatataaataaataatcctttcagatagagtatgcacctcttatttagagtgtagttcaaggatgcagacagaaacatcactgccaagtgcattttcacagatggaataccttttagtataacatagcattagtcatttgtctcttttgcaatgactttctccttgatcctgttcaatgacccccgtttaaccttggggagttggggagtactttgtaaaatgcctttgcctaactacctttctgctcattttggactctgccagtcaccaagtagcatactagcatcactggaatcttgtgtgttagaagacgccatcctatggttagtctatttacgcacttttgccaatgatattatggcttccttgtaactgggactggcagatgccaggataagcactacaaggaggtctgctgaccgcaaactgtaaacccgaaaagctcaatctgcacttcttggctccagcatggtgtgctctgctgttcacttttatgtaattgtgtgtaattcttggatgtttgatatttccatcatgttcgttttagctcctgtggcactattggtcattcagaacttgaatgtgaaaaccaagcgaagagggatgaaaagggtctgataccatatgagtgcaaagaaatttttttacttagaacaagccgcttctgcaggtagtaggagtggattgttttttccttttgttgctttgcatgtcttgagcgacttatattgatgtcgattgggtgcaaatggttgggattaaggtaatgtattcactgcacaaggcaactgcacagtatgtttatttttctttccagttccgttctttcaaacaaactgaaaatggaaacttgattacatcctggtctggatttcattggtccatcagttcttactgaatctttggtcgccactgccggtggggtgccacactaaatttatgactcagttgaataccactcttaaacaagtgcagcagttactttccacatttcatctgcatatctttcattgtactcttctagtgcactagtgtataggttatgaattgggggttttactcaccagcagacagcagtctcctttacttgttggtaattttcttcatttctggcattgaataacagaaacttattggtttaatttactgagatagacatccagtactacaaaacagttaatagatctgccagcataacaatattgcaaatatactccttaatccttattctgcaaaattctgtctgaaggtttgcttgattgtttagttatgtttcttgcggtctgagctaattgcacctgcctcctcctcccaagcgctgtctcttgggactgctatttttaaagatgagcgcttgtgcttctaatttgtttcttgggactaaaactcttgctcaataatttaattcttgtggatttttttctcttttacaatgataatgacatttcatgtgatagtgctattatgctttgcaactgcaattttggctacgttgcatgttcaacactcaaacattcaacttgaaccttttatttgttcctttgatggtgtcttgtcataactatgtgctatataatcataatctgttttattttttttccctgtaggtcagcaggttgtctttgaaacatttactcaggtgatgttgccagttgccacactattatataccagtggaacaccaaaaggagtgatgcttatctgctgaaatctcttgcatctggtcgaaagagcagtaacattcacttcttttacctgaaagtaatattgaaatataaactgtacttttcttgatgtgatttcttgtcatgtgaacatcagaacccctgttcctcttctatccaaattaagttctatgcagttatgtttgtagatgaaaactttctgggatagtattagcagtacctggtgatagtttcctaagcatgcttccaccatggcatgtgtatgaacgtgttatcaagtacttcatcttagcttatggaattcaacatgtttacatgattgtcaagtatctgaaggtaacatttcaggcatcgtcatagttagtaccatcaagggtcttatgatgtcattaaggatttattgcgaccaattacatgacctaatgctgtactattctttagcagcttactgaacgctgcaaagttgagtttgatatattataagcaaatgtaacaatcgtcaggtccagaccttctaatctactttagggaaacccaagtgtcatacttgatatgatagggttccttccctttacagtattctcctttctggtcactattttctatttcttatgaagatgctgatgttgttcaggtgttttgacttctactctattgataggaagttttgcaacggtaccaacctcaatacactgtatcagtaccactggtctatgagactctctacaggttagttcttctattacgatgaactgcttccatattgtattatacatgaaattgtatcagagatgtaacatttacttcagttcactagtatcctcaatgtggcaccatgcaagatgcataatctatattttatccatctattgtttctgttcaatggcataagctctaactaattttataggaagcacccaatcagtgtaggcaacattcttttttgtccttgatgctggcattttcttgcaaactggtaatgtttaatgattgctcctttatccattttctgatgtttcttctccactttgtaagtctcaattcagagacacatatcttccagttcaaatgctcgaaaattggctgctcttgcacttatcaagatacgtttgcataatctgtctcatatatcctctgtctcatatatgatgaccttatgatccagaaatttctatcccatgaattctacttgtaggtgtagcatgattctttaccactaagatccaactttcttctaattatctccttctcttccattggaaagggaatagtcctattgagcaatcccgtcaaaccatcatttattgtgcatatggtcaattggctattggcaagaattgttgctgcacttctgtggtctttgcataatctggcaaagaagttagtattcaagaaaatccattctgcaattgggattccaaaggtacttttacttatccccatgcacctgtttctgtgtgacattgataatccttgtgtaagtacttagtgtgaagggagtttccttaatgttgattacaaatataaactctgggttctgtggtaacttgctgtctggtattagcggtggtggaagtcttccaatgcatgtggacaattttttgagttagatgtatatcatttaataaagttctttgttaaatattcatgccttcattagtattttgttctttgatacatggtgtgcttccatagaaacgggaaaaaaaggtcacaattttatgtattttaaagcatattcttctcagtggcaatttcgtccttaaacaatgaattcatatatcattcatagtctgtccttgcaaatttactcaccataaatggaaacaaattcttctgagaggccattttccttcaacaatgaacattgatattattaacatcctctccttggtagatttactcatcatcaaacatttgatcttactacactagtagacttgtatctggaagcatacatggcctgtggaatgcataaagaagggagtccctattgtattcctggcatatttgcattacttctcatcatttatactattttctatgtatagcttatgataatactaagatatgtagttcatgccacattgcaggttcttggcacagttggtacccagtaaagcacacggaaatcaaggtagtgagcatagagaatagtgaggttctcgcagatggttcaaagggggttgtgaaagtcagaggacctcaagtgatgaagggatattacaaggatcattttttccagtt

SEQ ID NO: 69142 - DNA, 937 bp, Oryza sativa
agatttcaccagttacaaaattctaaagcctttctttagccattttggggcctggaactgcacgcaaatcaaacccatttccaacaaaactaaggtagtattaagctgactggattatttaccctaaacccccaaatcaactaagccagaaaaagtagaaaaccacacaattttcaactatttccagtaagagaaaactgaaaattaataagcgaccccccccctcccctttttttttcccaaaaactataaatagtttacaaaagaaatgttacattgggcagattcgaagcaaatcagcaacaaattcccatttcacaaaacttgctgaattctaggcatagtctactaaacttagtcttctcttcttttttttagcaaaatatcttggatcctcatccaagtgtacaagaaacccaggaagcaacagtaatttgatggtttcctatccatgtttttttttccagttggggtttacactttacacacatgtatcaatacttcaatagtataactgacatgttgtgcatatattcaacaggatggtcgcattagctatcaggagtttgaatcaatgatgatatctggatcagactggagaaatgcttcccgacgatactcaaaagcaaatttcagctccctcagtcgtaagctgtgcaaaggaaattcatgaaacagaggaggatctgagcaacagttacttactgagtgcatcaagcaatcaactaaaaacaaagcatcagtggacagcctaaaatataaaaccagattactgggtagaggacatcagcagggtgaaaggagattttgtatctcagttgcatagatgacaaggttcatcaagcagcgagccctatagcatcgtcccttgtaatggaatcaagacattccatatctaggatatatattcatgacttagcataggcacatgtaaggg

SEQ ID NO: 69143 - DNA, 1903 bp, Oryza sativa
ttgatttaattagagccatgttgaatgttttgttaatatataaatgccaggatgatgggttgctccttccaaatcagccctattctaattgttaacgaatcatttacggtaagttttcacctagtaattatatagcttttcttgctatcaagtttgacagtacttttttttttttgtattcaggtggataatggtttgctaacatccactttgaaaataaggagggacaaggtaacagccaaatatcatagagagatcgaagcattgtacaagtggtatggagtgggcttgagtaaaacattacaagtggtatggtgtgggcatgagtattttcgtttgttcttgccttaggggacatctctgatctctcgagtagaagtacagcagctagttcagcaatcagcatacaataatgcaaccatttttgtattattgtatgccagtttcgctcagcaaatgaaacagtagatcacttgtttgtgtcttgtccactggctagatttgcttgcaatgtgattgcaagtgcttttggacttgaaaagatcaatagcattcaacacttgttggaagcttggttaaatgaatttgacaaaaagaagaaacaactagttgcagtggggattgcagccacactgtgggcaatatgggaagttagaaataaagcatgttttgagcataagatgatctcacatccaatagaattgatatactatatgtgtcactggatttcatcctggtcaattttgcagaggtcggtggaaggccaaagaagtctacaatgtgggttcgacacttcgacttgctaaagcaggttgcaaaagagattatataattccaagtatggctggaactttgatagaagacggctggaggtgtgagacaaatcagcaaaggaaggaaacagggaatcgactggaggaactgaagcagaggaagagacaggtttttgtggctggaagaacaaagaatgggaagatcatgggatcaagtagttttagttgttcttttcgtctagttaaaaactgtactagctcgtctccttctttctgtttggtaattgctgtatgctggtgtggagatcacacataatggagggatgacactatttgttgtgtgatttgcccatggtccattaatgctcttctgtttcaaaaataatactccctttgtttcaggttatatgttttgactttggtcaaagtcaaactactctaagtttgactaattttgtagaaaaaagtagtaatatttttaacccaagactaatatattatgaaaatttattcaattatagatttaatgaaactatgttggtgttgtaaatattactattttttttatagagttagtcaacttagagtagtttaacatcttataacctgaaacggagggagtaataacaataataatgcaaccattttaggagtcacttcttcaaaccaggacaaggcacttcgcagcaagataaattaactatctgcgactcttacaagtgacacttaagaatttgttgttggactcacatattatagataaatgagggtccacatgtcatagacaaatgagagtccacatgttatagactacgagtgacaaatccttaattgccacatcttataaaagtttaaaaagtggcaaatatttataaagtgatggaaactcctgtgcatcaaactggagcttgggcttgacaatccaacgcgaacaaaactagtggttcggcccaggcgcagaatggaatgggccggcccaagtggcttctgcaatggggacccacatgtcctcctcccgtctctcctcctcagtcctcacgcctccaactccaagcgccgcctcctcccccaccccaagcaaagcccccatcgccggagaagcggaggtgagcccgtcgccggctgctgcg

SEQ ID NO: 69144 - DNA, 5220 bp, Oryza sativa
gggaggaggaggaggaggaggacgacgacgacgacgacgaataacattggtttttctgtgtaatatgcatgtaagtttggttgttatattctgcatcgatcatacatgttggggggattcgaacactcaaattggattccttttgttatgcaggggcgttatctccaatcctgtggtcacgtgtatgaggttctaaactgctaatctagctgcaattttgttgcacaatctcagttaccatgtgttttgtgctgctgcagcttgtgggcatatattctgccgtttatgcctggcgcattacatgtctcgaggacctgcaatcttattggttgcgtgatttcaatcctgcaccctggtaagggaaatgcagatgaaggtgagtattcaacctttaaagtcgtctacatttatgaattattaggacattctacgccttagcaactagctgacatgatgcattacaatttcatctagctggacagcaactagcttacatgatgcattgtataagttcatccagctgaacaagaaccaggggtaaagagtaattataccatcatgtgcatactgtacaattactctttccccctaccttgtgccttagcacgttcttctctcgcaatatttgcattgacccgttgagcaccaggggcgctcgtctcccgcacgtaccctactatttccccatttttgtactatatgctattgcttccaacttgtgtcctctattgctttaattcccatgtgatctgctgaacacgaactattttgggttaagaactttgccggctgccaagtgcaaaagtttcctttagaggcctgctatttcagtgtccacttccccttccttatttactgtgtggggtatcctctagttctcgttgtttcttgcctgaccatctccttcattctcactgttttttgtagttgacgggatcagatcggaagatgtggcttgtctcatttgccaggaacttttgtttgacccatcggtcctgaattgtggccatggtaagctcgaatttaggataaaatattgcagaactatgttattacttcttttctgttggaaaattgacattgttttatgaacagtttactgcatgccatgtttaacatctgtgggtggagaggaacttgaatgccaattttgtggagctccacatcccgctgaacctacagtatgctcaaatctgaagaactttctgaaacatcgcttcgaagaactgtataactcaaggcaagagaaaagttcaggtgttccaagcaggaaggaaggcactcgcaaagggaaaccttcagagatattgcatacccacgttggggtgggctgtgatggttgcggggtacgttcttattccaaacttagttattatggtttggctagatatgcaccagctgttaaatgcatttattgaggaggcagatgttcatgatccttgtctcaataaagcttaccatctaaattatatctaaaagcagcctgtttgaatggatagatctgtttgtttgtttgttttgcaggtcttcccaatccaagggagaagatactcatgcaaggagtgtgaggcaccaggtttagatctgtgcgagaaatgcttcatgacaggatctactgcagagggacgctttgatcagaagcatactgcagatcatgacatggaactggatgactcattccttttccccaacttagtggattacatggatgacctatatatcgatatgacttgagtgaggggtggacggtgctgaacatgaggcagtggaaatagggaatgagcggtgagagtagaggactaaccaccgttgaaggtgtaacttttgtctagaattcaatatgtagatttacaaatgctgcatctgcggtttaactctcggacaaatttattacaacgtttggtgctgtgagacccatgataatttgggcgtttgcacgagtccgtgtgcttttgttggattcgattgactgatcggagtcagacatccatgccgacctctatctacttgtaccgatgtagtgccaattatttttccatgccagaactactgcttaccgttgtcaatagggaatccaacacagtgtggcattatcaaaaatagcaatctgtgatctattggttaatggttggccactagtttaattctgcagttggctcaactatactattgggataatatgctttctcatccctggttgttagtttttacctcattctttcgtcctggtatatttaactattcgccacttctagatgtggcaattaactatttaccactggactcacatgccatagatacatgtggacccacatgtcattgagatatggatgataaatagttaaatactaaatctaaaagtggaaaatagttgtttccaagtgttcaagtcaatggaaaagaagccaagattccattcccctggctagtgttcaatgagaaagctgtaggacctgttgcgactaaaattagcactacatatcgactgttagggtgtgtttatagttcacaccaaaattaaaagtttggttgaaattggaacgatgtgacggaaaagttggaagtttatgttagaataattgggctaggcccaatttatcctattaaatctcaaaggcccataataagtgttaaggataataataccacctcaggatttaagcgaggaatatctcaacctaaatagggagttattggaggctccctgttgactagttgaggtgggggtcggaaggccccacgcgcgtgcgcgcgccgggccagggcgaggcgtggcgggcgtacgtcacgtcgctactcttttgcaaccacgaacccacgttcccacgactgcctccgcaacagcgcgtccacgatcctacgttcccacgactgcctccgcaacagcgcgtccacgatcctacgttcccatgactgccctgtgctgttctcgtctcctcgcttctaatcgcttgcgcgcacgagagatgcactgccctgtgttgttctcgcctcctcgcttctaatcgcttgcgcgcacgagagatgcacgactgcctctctcctgatagataaggaggcctgatagataaggagtcgcgagtccgatcagaacgatccgcttgcttctttcccgggtgttagttcctcctcctccgcgcctgtgctgttctcgcctcctcgcttctgatcgcttgcgcgcacgagagatgcacgactgctcgtcctcgcccaccatgtctgcgcctggagccggcgctgctgcttctgctggaggagatggcgcgcctggagctggagccgccggaggtggtgcgccaggagctggagccggtgccgcgaacaacaacatcaacggaggcaattctgcctcacaatccagcggagggccattctgcctggagctggagccgccggaggtggtgcgccaggagctggagccggtgccgtgaacaacaacatcaacggaggcaattctgcctcacaatccagcggagggccattctcggggtatatccttctcctgttcctgttgttagcgctttactgctatgttcctgttcctgatattcatgatgcctttagcatgctactgcgttactactatgttcttgttcctgatattcatgatgcacatgatgcatttagtatgctactggttatgttacatgttgtcactagatcaccctacactgtttatgccatgattattgtcttaacattttggattaaaatatgccgatttattaccatatttccgacaatccaaaaacctgataggtcattttcggtagttggctttgctgctgcactaaaaccacatgcttttgatggttctaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgttgagcattgatcagtgtactcgctgacaacatagtggacgtgtacatgcacatgccttccgggaaggacatgtgggatgcacttgaggccaagttcggagtttctgacgccggcagtgagctgtatgtcatggagcagttctatgactacaagatagtcgatgatcgttctgtagtagaacaagctcatgagattcagatgctggctaacgaacttgagaacaacaactgtgagttgccggacaagtttgtggcgagtggcattattgccaaattgccaccttcttggtcggactttgccacttctgtaaagcacaagagacaagagttcagtgtttctgatctcattggctctatgggtgttgaggagaaggcgatggcaaaggatgtccggggcaaaaaggttgagggaggttctagtgccaatatggtacagaagaagaaccctcatgcatcccacaacaacaagaaagtcaagcctaatgtcaaacccaaggctgcaaccaactttaagaagaaaggcaagggaaaggcaaagggagactactttgtgtgtggcaagtctgggcattgggccaaggactgtcctgagcgcaaagacaggaagtctgccaacatggtcattagcgagggcggaggaacatcggggtacggtaaaatattacctacagttctctctattttccaccacctgattggtgggtggatactggtgctaatattcatgtatgtgctgacatttctctgttttcttcttatcaggtcgggagaggttcctccttgttgatgggaaacgggtcgcttgtggctgttcatggtgttggtacggtcgatctgaagtttacttcgggaaaaaccgtgcagctgaagaacgtgcagcatgtcccttcaataaagaagaatcttgttagcggctctctattgtgtagagaaggttttagacttgtgtttgagtccaataaatgtgtcatatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtcaaaggttccaagtgccatacttgtgttcaatcgaaacaacctcgcaagcctcataaggcatctgaggcgaggaatttggca

SEQ ID NO: 69145 - DNA, 10377 bp, Oryza sativa
cctgtgcaggcagtcaaacagaatatccttatatgggagtatgtgatagctctcagcaacaactgttgttgtagggtatggatgtttttcaactacaggaccaatcatcctgttaaacaggaaatgaaataggaaaaaaaaatgaaaacgttagaaactgttatactgagaacagtagaagctaccagcaattgaaagacagctacataaattaggctgtattcggaaggtggagttgggaactccacctccccgcatggaatagcgagtgagtgatcaatagattttttaaagcaactttcgtttagattttctttgggggggggggcgcaaaaaacacactatttagcagtttgaaatgcgtgcgtgtggaaaacgaggggagtgagttgggaactcacacaaatgaactcggccttaggaagtacaattagccaatattttcatgattagtataataataacaaaagaacatcaagcatgcatgtaatgaagtttagtcaaaagctcaaacgagaataaaaagaagagctttagcacctagcaagcacagcattcaatacaatagaaatgtttctaaacaaactatggactataaaggatataaatttacatcaatacagtaatacacagtgagcagattttgtttaataaataaaaccattgttgatcagagagcaaattcgcaagtgtgtaaacagcaaacctcttgatcaattcttcaataggcatttccgcgaagttgccttttgcagtttgctcgtactgtaagatgaacagctttgtagttgtcccttttttagtcaatgagtatgctaaatgctcatcaagaagacgcaagcttgaccgcttaatctctattaagaaaatcacagaaatgaaatacattaatttcagttatatgattcataaatgaaaaataaagcagataaaataatatagtcgaacagagaattggttgatatcagcccatatcatttacaagggaaattaaacactacaatgttcctagttatttattgatgtatcagcaatgctataaattcatgtttcgggaccaatagcttttctggttggtaattttcaactaaccaaagttttcaagctacataggcatggtccgaagctaattgaatagttcaaatcgaatgaaactaacatactgggggtgcaaaagtctcaacggatgaagcacactgataatgaaaaaaagagggcaaaatttgtttagttaagaaaatagccacacatggaaaacaaaatagagcaaaatggtatagtaacaacctgttctacgctccacctctgaaaatgctaacttttggaggacatatggtccagtctcttcattttctaaatcttgtccttctggcttgttgctgccatgctcactagtgctagatgtgtcaatctctttctccaaaagggagcgaacatttttaccgacagaaccactctccagcagacatcttttcctagttgaatcaagaagaagcacagcgacctttgaaattggccacatggccatgtctggagagtcttggtttgcgtcgagggcttcagcaattccacacgcatccacgactgctttgtcagtcacagagagattcacaccctccccaggacttccagaactcttctcatgttggtggaccatattggagtacgcgagcaaactgtcaccaagagtaagagatgcacatttgaagaacctcattgcatcagcaaaagcaagctgtgggaactgcttccggtggtaatagttatacagaatgactgccatatgaacctgcaaaaacaaggtggcacaacgaggaagtattcagccgtgtattacaagttgcctaaagagaatgcaatgtatgatgcatagggatacagtacagaatgtaagagataaaaaatcaggtaacatggcactcaattttgccatatttgcacacagctacattacagaatataagagataaagttaggtaacatgctactctataatgctatctttgtacacaactataatacagaatataggagatgttgtcacgcctcccacgatcctgcaaatttttttaatcaatgagcgcacccccccccaccccacaaaaaaaaaccaaaaaatttccatatattagaactcccgagatttcctagaggtttaatggaaacatctgaattccctttcctcttgaaatttgaaaaatcccaatccctcctcggaatggaaaaaaaaaacacaattgccagaagagggaaagccttcccgatctggaacgtcccagttagtttacgtcttccctcttttgaaatccgcctccgtctattcgttggcacctacgcccgcagccgccttctccgctactctcgggcttgtcggaactcggaagcccatgccaaccatcacacgctcacggcgcgccgccgccacaccatcccgctggcgcgtcgcggcccaagccatggcgctcgctccgcacgccgcgccgcgccgtcgcagcccgcggcgcggcgcccccacaaaaacaagctaacaaacccgcgccacacgccctgatcgcgtcgccgacggcgaccaccacccgaaacccccccaaacctcccatagaccccgggacccgaaaccccaccaccaaagtccatccattctcgcatcgcaggctcacctggcgcgcgacgtcggcctggttctccggcgtcatcctgctccccttccgcagcgccggccgcaccaggtagtccaccagtatccccaccgcgtcctccatctccaccaccccgttcacctccccaccaccacgacgctccacctccatcacccacccacgacggattaaaatacaaacaagagggaaaccaaaccgccgccgccgccgtcgccgtcgccgcctcgggatccgcctccgcgacggcgaggcctccttttatagagagagaaggcgaggcgagctgtgtcggataggcgcgaagggacgcgaggggggtaggggggtgtcgaggcggaaatgggaaacggtgggaggggggtggagtggggcccacgcgcgatgatctgggccgtccgattgtcgcctgggcggatctgggccgtccgttggcgccgtcacgagaggagcgtgcagtgcagtgcagcccagcgaggcgagaggggagaaaatgatgagcgggttgaaggctgggttgggttgggtgcgcatcggttacggcttacgaggcctttggagctgggagacgacgggacgggacgtgtcacctttggccctgttcagttctcacttaaaaaattttcaccctatcacatcaaatgcttggacatatacataggttattaaatatagaaaaaactaattataccgattgcgtgtaaattacgagacgaatattttaagcctaattgcttcatgctttgagaatgtggtgttacagtaaacatttgctaatgatggattaattaggtttaataaatttgtctcgtggtttatatgcggaatttataatttgttttgttatttaatctaccgatgtgacacgctaaaaattttcaacgtggatatatattgtgaatggatgttgtgtgatgggatgcgatggacgggagatgctgaattgctgatgaatggggccggtaagcaggggtttcttttcctcgtttatttcatttgtatttttttttaaaaaattactactttcttcgtttcaaaaaccttgtctaaattcatagcgaaaagttactatattttattttagaatgtaagcatgtttttttcttgtttatttcatttgtaatttttttaaaaagaaattactactctttctgttctaaaatacaagcatttgtccaaattcgtaacaaaaagttattatattttgggttagaggtagtactatattctctctgtctgtccaactgaacccttagatgctacataacgtaaccattacattgttgctcacatgggtgacatgaatgttactctctccgtccctactagaaaatatttccgatcctatgttcttgtattttatgataaaaaaagtagatgaatagatggatgggtcatgaactggtatcgagggttccatttgaacgtagtaccacaagtttaacatgatttattttttaaaaaatagtttaattttattttgaaataattagaaatttcttcgttttttaaagaggcattttttttcctgttcttgatgtggacacttacacatctctttgtgttaatgtagtttgcactctttttttgatggtttgctgctgagttggattctttgctggctaggctagaatttatgataaataaaattattttataatttacaattatgtttgaaatgggtgtaattaattgtgggaatatttcaatattggatcctaaagagagggttggataggcactggtgtgaacaagttcatatgaatttctattcttatgtttttaggaaatggttgattacttgaatactccaggctgtgttttgcacatgaacatttcgtacgaacctattgttcacaccagtacgtgtcaacccctctatttaaaaacacagcctagcatattcacgtaacataattagtctttcctttaaaacataaaaatattgtttttatttgaacctattcatacccagggatatccagccctcttttaaaacaaatcctaaaagattcacacaattaattatacccattgaaacatagttgtaaattataaaatacttctattccttcctttaaatctttcacgggaacatgttcacaccatacatgccaacctctttctttaaaaacacaacttagaatatccatgtaattagtccttacttaaaaacatataaatagaaatttcataggaagttgctccagggtttacaaaaccggctgcaaacatggtaaccggcttacctccatggtatagtaacagttaaactacggtaaccccactaaattcaaataaaaattaaaataatttaattttttgataaaattttgtacggtttctcatggcaattactgtgcggtaaccatgcaaaccgccaaagtgtggtaaccctgccctggacagtaagggaaaccttgacgtgttcatagtagagcatatttggcctctttacaaacaaatattaaaagatcacacaattaattatagccgttaaaacatacctgtaaattatagtatttaataatttacatctatgttttaaacgatataattaattgtgtgatctttcgagatttgtttcttaaagactagcgcaaatccgacccctttggaaaaaaaatctcgaaagatcaagtaattaataaagctgtaaatactataatttacagctacaccctccaatcccgaaagagtcaacttatagtgatgaatctggacaagcatttgacaagattcatctctaaaagattttttttaaatgaatggagtatgctttaatgggtataattaaccgtattcgagatttgtttcctaaaggacaacacatatctggccagccctctttagaaacaagtctcaaaagatcacacaattaatatagccattaaaacatagctgatcttttgggatttgttttaatggctatattaattatgtgattttttgggatttgtttctaaaggggtggatgtgtgcgggtataaagaggtatatatgaaatttttatttttatgtttttaagatagggtaattacatggatattctttgaagagaagggttggcatgtattggtgtgaacaggttcctatgaaagatctaggagtataaatattttaataatttacatagctatgctttaatgggtattggtgtgaatcttcctatatttatatctaaacatatggctaaatatgcactagcatgaacatgttcttatggaatttctatctttgtgtttccgatgaagggttgatacgtggatattccaggatgtattctaggctgtgtttttaaagagagggttggcatgtccaggctgtatttcgggttgtgtttttaaagagagggttagcatgttcaggctgtattccaggttatgttttcaaagaaagggttggcatgtgctggcgtgaacaacaaaacaagttcctatggtaaatttaaagtaagtgttcaattatgtagatattctaggattgtgtttctaaagagaggtgttgaatgcattttaataaaacaacaaaacgataaaaagaaattcaatcatttaccttaggattctaacttgttcagttgttcccatcttcattgttagggaagttgattctaactattgtttaaagaaatggttctaacaatcgaatagaataatgtaaaatagctaaataaatctacaagtcaacacatgtacttaatttactaacctcaagtgaataaaatttcttgatctaacctgtgagatggatgaaacacaacttgccgatatgccaccacaactaatttaaccgatgctggtgtttgacgcctagctttactttggcgttgaagatctgccactggtagctagtttcttccttatctcttagatctagatgacacaaaaagattgagctagtcatatcatcataagcactaaatcaaatacaaggaaaagaacattaacaacgaatccctctccttacccataggtttcaggatgcatgccatctacgccgatcttgttgcgttaggaagtggtttggtgggaagggaaataacagggagacaatggaaagacgagagggcaagatgtcattttatagtgaattattgggtctcgtagccatatcgtgaggttaagcatagcgaagtacagtggacccatcacctcatagccatatcatgaggttaaacatttcttagtacggtggacccaccaccagtctctcacgaggttaagcatatcgaagaacggtggacccatcacctcatagccaccagtctctccgatgttccgttaaaagaatttcatcgaaaatgcccactttagttagaattgactaagcttaaaaaaaaaattggctcgacaagtagagtcaagagctaaaattaaaataaagcgcttgtttggcactctaccgcttctagagttggagtccaaccaaacaatttcagcttcaccaaaaacagaagccaagcaaactaaagtgctctcataaaataaactagcaaggtggagcaagatctagactgctctacaacttaactctaaatccaactcctttgagataaatttaagagttagagctatcaaataggcttgatgtgacttgtataacaggtggtgctcacatgctaatgcaacgtgtgtaacacatttgaccgtttcaacaatatttctctaaagtgagacacgcatttcatcatttgtaccaaatacgtatcaagaaaattaaactatgttcacctctacctgaaactctccatcgctttctcttctgtgtacatgaggttaggttagcagtttagcacaccttcaccttcaccgttgcccctatccccttccattgacacggccacaccgcggtggcaacttgtgaagcagtgtaattgatacatatacggtacttcctccgtttcacaatgtaagtcattctagtattttctatattcatattgatgttaatgaatctagataaatatatatgtctagattcaataacaacaatataaatgtggaaaatgctaaaatgacttacattgtgaaacggagggagtacatcacaaggaattgcaacccaatataatatctggaataacatacgatgcacaagaacacaatattggagtaatatcagtgatcagttatgcccaaggaaagttcataacaaatgtagctaggcacctcaacgcccagaatcacacgaagatagaagatatctccattatgacctcatggaggccactgcatgcttcaggtttgagaagaaatagtggtcctgtaccaggaccagtaatttatccgcaggggatcacatctctgcaatattgagcagattgcagtcgcaagatcagcatctactgcttcatctgcttcaggatcagagttctttattgcttcgatagttcctttgagttcatctgaaggttgtaaaccaatttgaagaagatcgagcagcaagctcaaagcaaatacgcaggtcgaatcatgtttcaggaccttgagacaaacatcagagatgcgctcatcagccatcagcaagttattttcacccttgtacaggcctttgaggtatctccaggggctttcattctgagggttagccagaatagccccaactgtgtaatccacttccgagtcacgcattgctgcaaggcctccaagaagtggtgaacttgttattacaaggtatctctgttgcaaaacaaacataacatacttcagtgtaatcatttgatcttagttaatcagccaaaaaaagtcagaaaggagacagtagtaggacaaaataccacgtaaagcaagaagagaaagaatcaatgaatttagttaataaatcatgaaccggcatatggattttcagactactattcaagatgggacgaattaaaagtgaaattgtataataaactagaaattttaaagccaaacaagcatatcaactgacctgattccaagctgaattattgaagacgtcttcctcaagcagctggttgcaatactgtagttcagtctcccatccacccagtgcttgaagaacccactgcagcagtaatgatacataaattatattattagaactcagctttccctcaaaggtttgctcagtgcagcactcaaatatagataaatgaactcaaacgagtatcaacagcctaattttagcgcacatcgagaggaaacattatatacctgcctatgagaccaagcatggtaatttttagcatccatagaaagtatcttccttgtaaattcgtgctctttatttgcaatatctggtcctaatttctccgcaagccatctcttgtgatgcctgagaaaatatatatagtactgggacgttaatcaagatttcccaacaaaaaagcagaagaatgaagttttaattacagaacgctcagaattaatgatagcaagtataaacttcatgaaaaactccacagctaccaaatatgggtataaacttaatgtcactcaccagatttgataattttttgggttacattcagcaattcggtccacaaaatccatttcctcacgcagatcagcatccagtgcctctagaacaagacgcctaaaatgccacacctatcaagcaaaaaaagatcattaagttcaaaactggcatccaaatgaaatgcatgacgctaaacacataacaaggaaagacaattttacatgccaccatgttttgttgcttgttaaactcagaactgggagaaatttgcacattctgcatgcaaaatgccaatgaggcaacaacagatggctgagtacaaatttggagggagcaaacaaagtaaaagtcctattatggatatggactaaaagccccaaacataatttggtacagtactacagtatattttaattatatttatctttctgatcatgaaaagtacagcggaaaaactgaaaatttgataagtctgaaagagacaccaccacagtatgcagattaaaatcaaacactaactgttttctcctgctctaccataaatctagacattctcaatgcgtccacaagaaaaaaaaattaatcaattttcctaaatttgtcttgccgcgttgtgtctccaaaacaacattatatatgctagtcaagcttgccatcacagttatacttttataatcaaattccgaaatagataaatccgccaagataccactagctaagccggaatttgccaatatcccaacatgctactcttactataacaagtgaaggctagttctacatgtacataggccttgtttggatgctccgagctattaaatagccctccggaatcttgctatttagaagtattaaacatagattaccgataaaaccgattccataacccctaagctattttgcgagacgaatctaatgatgtatattaatccacgattagcggctgattactgtagcatcactgtagcaaatcatggattaatatacctaaacagggccatagttctaaatgagcaaatctcctgcactgcaaattcaatttccaacatgaaaaaaaagggggaataacacgagcaatctcaccgtgtagttgccgggattaaggtcgatgacctcggcggtgaggtggagggcgcggacgctgcgctcgccggcgaagtagagggcgcggaagtagtccatgacctcgcggaactcgtcccggtaggcgatggccaccacggggtggggcccgtcgtcctgcgtcacggggaccacgtccgccagctccggccgc

SEQ ID NO: 69146 - DNA, 4554 bp, Oryza sativa
ggagaaggaggagatgagggggaggggggagaagaacgcgagggaaacctcaccggagacggcggcggcggcggcggcgaggagggcggcgcggcggtggccgcgggtcgtcgtcgagaagacggcgagcggaggaaggaggaggaggattggaagcgctatgaccttaatccagccattggttgcttcttcaacggctggatggtgatgactgcgctgctttgacttgcagtcaaggctgtaacttcagcctatatctgcacccacttgtcatggactcaatgggttccatataacattgtcacagggtgatagtaacaaactaaagagtacaaaaagagtaatcagcagaattcagaaacgaacttaaaaacagtgcaggattcaggttttggtcctaattactccataggattcaggttttggtcctaaatactccatagattatttacttcaaatataaattactccttccatcccaaaatatacgtttgctagtagtatgttttttccaaagaacttttatctattagattgcttacaccacttataacatatttgttaattttttaaaaaatatttaacccataatcgagaggataatccattgcaataatctggtaaataaatcgtttgaaatagagcctataacccacaaccaaacaaacttaaaaatgataataattcaacaaatcaatactggtgataagtgataactcagcataacaaactcaaaaatatttggcagctgaacaacgaatactggttttgagttgtcatgaattttcatcataataataccacacttccgagggggaaaaaaagcccaaaaacgacacaaaaaacatggctggaactctgaaagtatattatgtacagaactggtgatcatcgcagcttgtgatgaaatttgcagcgccacaccgaagaactactagtttactactacttgaagaagaacttccagatctccctctctgggggctcagagacgaggtgcgcgccaaatgcgccttcttcatccaccagggatcggagctgccgcaccgcgctgctcgagccgatgtaattcttccttgcagcaaggtacatcaccccatatggcggccttaggcactgcaagaaccaagaacagaagttttagtgcggagtacatgttaaggctatgaagcaggttctgttccagagcagacggcaaattcggacaatgcatttgatattatctggataaacgagaaggatgagatgaagacagtcccagaaacaaggggaaaagagccttgcagcgaagctaagccaattcctaagtctaatgccaaaaaaaaaaaaaactcagttcttggtctgctgtaaagtctgatataaggaaattcgtctacccatactaatctcctgcatatcaatgcagagtgacctcagggaggagctctacactcattctgcgcttatcgctatcatattatgctagtcataagtcataacaatgcagtgattgtctgtatgctgtctatatatgatgtctcatggcgagaatttcctgaagaaaaaatgtatggagaacaaaccttttttacgagcaaatagaggttttgaagagagcttgcagaataagggatctcattgactaacagtatatcatatccaccatctcctgtggtagtctcattccccctctcccatgcacggcttcctgatagttttcttgatcgccttgaagaggtttcatggcaaatattgcttgcatcttggctactgcaaccatccagaaagtcatcttcacagaactctagtgctacacctgatgatgtgtccacctcatcctcctgaatcactgacagaacagtgtgaagctcctcccattccccggcatagaaatggatatcttgaggcaattgctgccgagatggagtaagggggcttccttgttgttgaccatgtttgtcttgagcatgctcaagatttgcaagcacattgggtattgttttgcaccttattatttcagcactcggatcctgaaaatgcactgttgaagctccctaagaacgtttgagaagaaaatgtcagttatcacagtagccaaacacagagcagaacacagctaatatataactcattgtgcacggatgcaacaactatgcaacagtaatactagatacatggattcatgctagtcaagatttaaggctacggtaaatctaagattaggctagcaataacacattctataaaagtaacgaagagatgccatggataactacagtaccttcaggcaagcaaatatcccaggaagcccatatccacagccaagctgcattttgggaaaaaaaaaaaggactgttacagtttgcccaagtaccataaactaatcaaaccaagctatgagtttggcatctgagggaccaaagaaataaataagaccaagaagtaagttataagtcaagaaccttttcctggaacataaagataacaattccatgtccaagggattaaggagtgcaagttggaatttatacaagttgaatcagaacataacattatctgaatacagatcataattcaccagaaccatggactaagccatatccttccattttcttttacatatgcgcacaccctttagagttttgtgtaccaagataacttaaataaatgacatatttaacaaataaacaaacagtcaatgacagagatggaagtcaaggaatgcatagcttcactagtactccctccattcagttttgatcatcatataacaactgtgcagcgagatcaaggagcaatcaaaacatggtagatgaagcaggcgacacatggactcctacatgatgaatggacttaattatgatttctaagctacgaacggatgcacacatggtgaacgacgtatgcatgcagcttgaataatgtgcatattgatgagaagccaagaaatcaacaatcacaccattagttactcatcaatactgattttttttttgttttgcatatgcgctcatcaatcacgaacgaagtgagtagtactgaacacataaaagcgttgtacctctaaaacctgtttgcttctgaatgtcaatagtccatcacggatctcattcttaagaacattcactaggtcaattgaactctcacagcacttcagaggccctataataaaaaccgttacttttagattctcagtgttttaggtagtcagtacaaaatgattatcattaggggtatgacacttaccttcaccttttggagttataacctctgatccagatagaccaacaatatcgacaacactgacctttccctgaaacaaggttaaaacacagaacaattaattccaaaagccacaaaagattaggatgctatatagcttatatagaggaaaataataatgtttaccatgacttgcctaccatataaatggccactatgaataaaaactcaactctgtaatactaattccatggttctatgaagtaatctagtaaaatgaaaaaaaaaagtagggagttaagaaagaattatcaccttaaatatattcatgccatgcatttcaatattctcgcctgcatacttgtatggatgaacattctacagtacaatgtaaagaatgggagattagtcagtagataacagtcctttccatcagtatatctatgcacaaagagccaaccatggccacacaactttgcaatgaacaagaaagtgtagacaaaagttccacctttgacgggacaatctcgactgctggtgacggagggtgtgactctctctcgggcacgacattaacgcagtgggctgcagctttttcatgcgacaggaagccggccaggcactgtgagagaattgaaggtgaccgcattgcctgaaacgaccaaatcataatgacggtgaaaagaaatgtaatgcagtagcactgtaatgatggtgaaaataaaatgtaacaattcttcgtaatgtcaatacaatcaaagtgacgacaaataaagtgtcaaattatcaaaatcttgggcatgtaaaatttctttctactgggataactcttcttgaacccttctcacttccaaaggacacagaaaatcaacaactggggcacaataggacacccattcctaccggatgagatttcatagccggaaaacttacagctacatcacacatcaagagtacccaaagtagaggggaaatcgcaatgagctaaacccccattgaaatgccaaatgccacaagaaacggcccaaagacctgttgtcaacagctaaaactatagagccaagaaacatcacatccaagttccaacatcacaaattcaagagaagatcaagacatctcgaaaagagggagagaagatgaaggaagaaacacttacttgtacgaacccccaagatctgtccccaagaatcacagacaggttccaaagaaaagtcgggacaaaaacgcaaaattaatcaatcaagattacgaacaggaggggggacagatgatatgagatgagcagaagaaagatagagaaaagctaatcaaaacaggatgcggaagagtggtggcgagtttggcgactgg

SEQ ID NO: 69147 - DNA, 2041 bp, Oryza sativa
aacaacaaaaacaacgacggcggcggaggcggatgcgacggcggcgagcaccagaaggggaagtcgtggaggaggtggcagtacaggagatgcggcggcggtggcggtggcgggggcgggaggaagaacgccatcctcggggacgcggccgacgtgaagacggcggcggggttcgcggagaggtacaggctgggggcggagctggggcgcggggagttcggggtgacgcggcggtgctccgacgcggccaccggggaggccctggcctgcaagacgatccgccggaagcggctgcgccggtgccgcggcgacgccgaggacgtgcggcgggaggtggagatcctccgccgcatctccgccctcggcgccggcgccgactccgtggtgcgactccgcgacgcctgcgaggactccgacggcgtccacctcgtcatggagctctgcgagggcggcgagctcttcgaccgcatcttgcccgcggccactacaccgagcgcgccgccgccagctcgcccgcaccatcgtcggcgtcgtccaggcacctccttaaccccccacccgccattgccattgcatcgaatgctctgccattgattcttgcatcctgttcaaccatcaacatcgccattgattcttgcatcctgttcaaccatcaacgtcacttggtgtagtgcatgaatcaatgcatgttgcatgcagctgtgccacgagaacggggtgatgcacagagacctgaagccggagaacttcctgttcgccaacaagtcggaggactcacctctcaaggccatcgatttcggcctctcggtgttcttcaagccaggtaggaaggaactcactactcaacaacacaattatactatgtgatcacgcactggacatgcagcaaagaacgcaaagaaaatcaaatccgaacgaacttaagtctcaaatctcaattacctggctcttggctgcaggagaaagattcacccaggtggttgggagcacatactacatggcaccagaggttctcaacagaagctatggcccagaagcagatgtctggagcgccggcgtcatcctctacatcctgctctgcggagttcctcctttctggggaggtgaatcgaaccatccatgctttctctgcttgttcttcaccacaatagctagcagaatgtgttagataaaaggatacttctctgataattactggtgctgatcgatcgctgatgcctcctcctttgccaacgatgtgcagacaatgatgagaaaacggtgacggcgatactccagggtgggatcaacttccagagggagccatggcccaaggtgtccccgcatgcaaaggaccttgtcagcaagatgcttgaccccgatccttctacccggttgacagcaaaggaagtccttgtaaaaacaaccttcatccagttcagattcttttttttaaaaaaacgaatctcattcagttcaaattcaagttcatagccatatcgaaatctagaattttgccatgtctttgacattattgcaaaaagggggaagtttaataatgtacagtaagtagtgttacattacatgctcagttgagattgtttctcctcctgcaaaaaacagagcatccttggctcaagaatgccgatagggctccaaacgtttcgctcggagagattgttcgatccagactgatgcaattctcagccatgaataagttcaaaaagaaggcacttggagtaagttgcagagaacctgctgctactattcttattttcttcaaatgtggtgtacttcttcactgtgaagcatttgccgatgaaggtcgttgccaagaatttaccggtggaggagatggataaatatactcagatgttccacaagatggacaaagacaacagcggtaatttgacgcttgaggatctgaagttgggcctccagataaatggtcatcctgttccagagacagagatcgaaatgctgttagaagctgtgagtgctttattatatccattcccatagcactatatttcgttattcttttataatttagagtttagaa

SEQ ID NO: 69148 - DNA, 10762 bp, Oryza sativa
tgggcaatgctagaaagtcttacattatgaaacggagggagtacaaggcaagaaaaaaaaatcagtgagacaatgttgcagataagagaaattgtgattatgaaaacataacaaatggattttcataaagataaatttatcacaaaatgtttaccagaattacctgaaaacctgtcttttatggagaatggcgagaagtccacttttccaggattcccaagaatcatgtcggtgaccatttcagcagtgcctaatgcctgaagtaaaatttaccacatgaacatcaacttctgtaccttcttaaaagagataacagtagaaccaatctctacaaattaaaaaaaaaatcaagcgaacacaacacgactatttctgtatacgacacaggacacatgcctctattgggcctattcgtcccaactcctgtagccctgtcatcaggagaaccaaggactgaggaagtcctatgcttgattgctcaactacataaataataagagacaaagctactaactggagcagatttatacattgcccttaccaaagcaagtccacttccttcatgtcctgtcgcaatcaaaacatttggcagatcaggaacagatccaataactggcttcccatcaggcactgaaacaaatgagatatttatttccaatggtactacataaaagagcaaaaaactactaataacattgcaatgaaatatctttgaaagactatgtggcattctcttcctgagttgttctaaaatgagaagggcttactaaagggacggtgcccgatcctgatttcagtgttttcatcaatatcaagatgaacattcttcagcgtaggaaagaactctgctgcacggtcccatatacatttaaggatggacatgtcaacttctcttgaaaatcctttaaactctcgactgcttcctgtaacatagaaatgtggtgatcttgcatggttgcatctgtcattttgtgttgtatcttaagttggttaaatgaaaaggagtttggttcatccacacgaacaaaacgtgttacaaaggatgaagtttgctagttcataaattacctaggattaaatttccctttgtattcattgttgcggtcattgatatggataaagcaccatgctcatcttcactggattctgaagataggggtgtgccgcttgatttagcaacttgatggccaacgtatcctagctccattagtccatgatttagtttaagcttgtcaaatttatccaacacaagcaaatgaccctgaaatggaagactacagcattacaacccccatcctcaaacagatgtggaccatacttgcatgaaaatgatctgagtggatttacccccaaaaaagtatcatttcttaagttaataatttctacaaacatgcaattaggaaagagtaattgtcaaagttgagtataaggactcggtgaaagtttaagaaacaacagaggaagtttcttttaccctaatgttgttaggtattgagttgggtacaagaagaaaaaaaatgtaattcctaaatattacagagaaatgaccatcatgttagtactatattagggaagaactgaagatatgtggtgaacaatttgtaatgatttagttttagctagcatgtcattaggatcatttcaatccaaatatttttcagatcacaggtaaattcaagaaatttcagatgtatcatgtaccttacgtggcatcacaggaatgtccaatgtaggattcggttcaagaaaactacgcaataaggttcgagtccaggcaccagaagcaattacaatagcttttctgccatataggatgtgcttagatgtttggacaccttgaactgttccagtagtctctgatctgcattaaattaacacaattatcagtaatgcagatagaggtagatggtttggcatagctgaaagcccatctcagtagcctgatagacaagtaatcatctaccaaccaacataagttatctgaaaagaagaggccttgataccttactaatgacatggcaggatcattatagatctccatatatcttccttctgaggaatatgaaccattggtctattgaatgaaaatgttaacggttggagaccactgctaattgcacaaatatgaaatcgaaattctgcagaagaaaccttttcaatcaatgagacagcctggaaggcatcaatctggcagtcttcaggcaagaacatagcacccccatcatgtccaacatagagttccggctccaatgcatgcaatgaagcagcagacaagcattccgcacgtattcctgcctgagatagagctttggtcctttcctccaatgtagccatctcttcggaagttctcccaactagtaagcttccttaacaaaaatgataacagaatttcacatttcattcagactctgactgccatagagaactaaaatttgatcaaacacagtacacataatgcaatgtatatgataagccatttcatcattgaacgagcatagtttccaactaccgcatcaacattacagtcctggagtattggagtacaaaagtacctcaattaccttggtcgttaaatctgttggaccgtaagagtctaggggatgccattaatgtccattgtactctctaactgaaatcaccactacttacaaagttataatcactctggcaagcaatttagacgacgcgactccatcggtcccaaatcccccaaacaaattttgaaaaaacagcaattcaccatcacatggattttacctgtcctcatccaccccagcctctcccgcgcaccgccgcccccgaagccatccacctgggcggggagctcctcccacagctgcttgctccgcaccgccagctcccacgtgtcactcccgggcgtccggtgtgacatccataggtatccctgccctgcgcgagcgcacacaccaacgggacatcaaaaccctagaggccatattacccaactccccccacgcacatgcacgcgcactgagggtacctgcgccggtggcgccggtgcacgggacggcggcgtccgcgacggcgacggagagcggggtgtggaggaggaggtggcgcgcgatggagagcccgatgatcccggcgccaacaaccaccacgtcgtggtgggacgcggacgcgggcgccggctcggggcgctgcgatcggagcgcgtggagcgggaggcgctgcccccgccgccgccgccacgggtcgcggacggagaagcggagaacccgcgagtacgaggcggagagagaggaggaggaggagggcgcgtggctagggttcggagcggaggcgaaggcggtggcatccatcggaaggtggtgtggtgagcggcggcgagacgaggtgatgagtgatgagctcgaagagtcgagaggaggtaggtgacggaggagggaggcgagtcaacggtcttcttttatacagacgctgacgtggcttatcctggtcccacatagtcagttctagtgggccgaattttgataggcctattgggtcgagtagtttcacttcgatccatggacgccacgagcccatgattgatggtttctttctgagttccgacggattttttttttttgagggacatcgcttgtagattgatccttcatcctgcttggtcgaaaaccaaatcctttctttgtctgcggtatttgataggaggattttgtgacgccatctccgatttgaaggctacatctgtttgctgctgttttgcgaattgaaggtaaggtactatttcttccttcctcataatcagggattacattaccggttgatcactaaatttcgagccccatcggtgtcacggttttcgataaattttaatcggttttcgaatttggaccaaatctacagtttaaccttcgaaattccaatcgaaacttaattccgagccgtgtcgaaactcgaaatttcgcggaattcggccgattttcgttgaaattgtgaaccctgctcataactgttagatcgatctgaggggtttttcctcttttctccatgcacccaatataatttcctttcttcttcttctttttttttcccatccttcccttttacagtcggtcagtaagcaaaggtcggctcgaaattgggatcgaataatccgccatgggcctatcgcggcggtttcagaatctcatcgtggactcttcctacgcgggcgcccaatggctgcgctccatcgacctgacgcgccatctgttcggcaacacagcagcagcagcaccggctgctgactcctataatccgaagaataaacggggcttaaggatacaaatagagaggattcggtttcccagaccgatgttgaggttgaaatgcacatatatgccctatgatcagcgtaatatcgactgcttcccccttgcagatcgcaaggtggtaatggtggaccacactgggatcacacgcctctgtgacgttgatgcccgcagcgtgatggctatgccaaacatccacaagcccaagtcagatcccatctctctcttcgtccccagcagcggcggtggcagcctctatgtcatggagagatatcccgacccggaggacggcacgcagctgaggttgtgttcttgagttcaagttaccaacctcactctctcggttaccgcgtgtgcgcttcctaaactgctaaacggtgcatgttttgaaaaaaaaatctaaagaaaagttattttaaaaaatcatattaatccatttttaagtttttataagctaataagtaattaaccacgtactaatttattgctctgttttccgtgtcagatacattaatcaatttgaggcctttgtttggggcaagtcctcttgccactgccacctcctcagcagtggggtatgaggaaactagatagagttatagtccccctcccatctacatatgcagtggggtataaggaaactagatagagttacagtccccctcctatctacatatggtaaaaaaatttagtggggtcaaatttagtggggtctgaggaaactatatagagttacagtccccctcccatctacatatggtaaaaaaaataggaaactagatagagttacattcctcctcccatctacgtatggtaaaaaaaatttagtggggtctgagaaaactagatagagttacagtcccccctcccatctacacatatggtaaaaaaagttagtggggtcttcgtggggtagtcttcacactagtagtggaggagtcccctcccatctacatatgataaaaaaaatttagtagggtcttcgtggggtctcttatagtcttcacgctagaagtgggggctgaggcaatggctcctactgcttggacacggagatgaacacatggctgtagcttgccaaggagatgccgctgccattcttctctggcaagcttgagtacgtgcccgagctcaagctctggtttggcctctctgctgagcccagccgccgcctgctggctgctgctgatctgatctcctctgactcccagccacaacttataggcgactggaatgaatttgccccacctgagggatggctggaatatcaagaaccgcagcttgtcaacctcggctccgccaggttctgcatttcaaggttcttccatattaggtccatggataatgataatgaagtaattgacagtgttgtagtcttcactggtgtggaggtgatgccagttgggcacaatggcgatggtaatgggaaggttaaacttcgaatggaaaagcacaagtcaagatgttgcgtgtctggtagcaccatgatctgttctatcttctgaataatcctggggctttcgctttcaagactcttgtacccataatgcatgtgatagacaactcagaatcttatcgtatgtttttttttgtgctttgttatacagtttcaggtattatgtgttgtcacctgtatcttgtcgcctgctttggaaacgaactatctcctttaaatcctcttcggtttcatcttcaactccgaatatctttgccgaaatttggtgttaacactgtgcctcctcatcttgctggccacctcgctgccgtctgctgtcgtactcacctggtcggcgcgtcgccggagctcgaccatcctcgttgtctctcgtagctactcatcgctcgtcacctcagtcgcccaaccgggtggtgcgggccccgctcatccgtcgggtcccctacgaggcaagggacgggtgatgtttcctacccgacaacctctgcagggccggggggagaagtcgcggagcgaaggcgggcgtgtttcagcctaacctactcctgacccgcctcgttgcctagacccgcccgatggctgcggtctaggttctttataaattaggctatagtttcctatttcttactctaggagttaaatttgggtttaacacatattttagagatggtatttcttgatttgagaaaaaaggactacatatcttgcaagcgtcagtgaaacaaatggctatgcagatccttgctaattatagatgaaagttgttttctctatcttttagattggtgttttaactagttttcttatttttaatcaagttgtgatcttatatgtcgtagtcttcgacatgtaaccttataataattagctgtaacttttttttaaaattacacagtacaacgcagacactcacaacgcacgcacacacgaattctattattgaaaaacaaaatggattgttttgccttagcacacggtgtggttgcaagtgatgttttgtcgtgcagacaccgtgacaagtttcgacgagagaaaaaaattgtaccgtcactgaaatatttttctcctgcactttgcataacttataaagccaatgtgtttgcataagtagttaattatgcatagaattttgtttgctatttcctcttttttaatagatggcgttgttaacttttaaaaacatgtttgattatttgtcttgttcaaaaactttatgtaaatgcatgagatgtaaatcatgcttataaagtactagtaaaacacatggtgggaggccactgccagcttgaaggaagctacaaagaaagcaatctgcacgctaactctcctggtcaattgggaaatctggaatgaaagaaactgtataatcttccagcataggagctatcatcgggaagcctactggctaaaatcaaagaggaggccaagacgtggtcattggccggggcgaggtatcttggtagctggctagatttttaatttcttagctcgactgaaccgaaggtctgaagctgtgtttcctttcatacttgtaaagttttcttcattctttattcaatgaaattggcagtttgccgattcgttcagaaaaacaaaaagcacatggtgccatcgtcctgcaggtcgagtgtgcggtgtgcccttgaccagctcctcccatcatctggaaatcatacctgtgctcacgagggagagaaacccagctagatgaagatggcgatgtggccgggtgtcctccgaaaccctcgccgttgctgccggtggagtgtcctccggagcacctcgccggttggccaccaagcaggtagccgccgtccgccggtgcctccatccgccgccgaaagaaggaactgcatagaagaggaaccaaagaatcaagaaccaaagaaaagaaaaagaaaatcaagaacaaaagaatccgttgctagttgctatgatgtgaaccacagtaccagtcttggggggagttggagacgggaggaggactgaaggagcacgcccagctgccgccgcctcaaaacgcggtggagcacaccgcgaagtcgaagctgtcaccgccgccgcctccgccgggagccgccgccgccacctcgatccgtgatggagccgtgccgccaccgctgccgcctccgccgggagccaccgccgccggctcgatccgcggtggagccgcaccgtctcaggccgggagccctaaagccgccgccgccatgtgaacgcgagcaagcggagcgctcgaacaaggccgacccaaaaacccctagggtcaactgactcctggacccattgtcacctaagaaaatatgggccggcccgaaaacctattagtgccacaaatttaggttcgggccacggacctaacgggtcgacccaccccacttgcaggctgaagtgtgcccttgaccagctcctcccatcatctgagctccggtcgtcagatccgtgtggagtcatcgtcctgtaggctcgatgttctgaagcacaaagggcaaaatgggctttctcataagaatttgtttccacggctgtaaaaaaaaatagaggacaatttacaggtcagaattgaaatcaccaaacttaaacagttaagcttttccaatctgagagcagaatacagcaaaggccaatttaatggaaccactcatccatacaggccaattttaatttgaaccatagctgaattcacgaagttgaaaaatacaatcacatgtgaggaccccacatgtcattctcacatgcaatcctattttataactcgcagattttccaggctggtactttcctaattttctccatgaagtaatatttacagctaacaacacacacgcatatatgttttactactacctaattttgtccaagcctcttgcgctgcattcctgagattgttcgtttcttacatctcctctgagcatcatcagatccctgggagagtctgcttcatgttcatagcaccagagtgttgggccaaatgagcaccactttgttcgaccagaatcccagtgagaaggtgttcctttgcacaactgcattttgaccaatcttcctatctgcggcggggcttgttcctgccgcacatgttgcatgagttcgtagaggacgggttgatgaaagtgcagcggtcgcatggccatctgtcgcctgagcgctcctgcgatgttctcgccaccttactccgccctgacttccccttggtgttggtgggaggcttcttggagctggaggtactgactgaagctgattggtctgtagcgcggacatcctgcagacccgcttccagtgtttgaacaaggttctcgaagtagttgcgggttacgctgcaatgaaatatttagcttagatcatgttctcaaaaaggcttagttgctgtacatactcataaacatgcaagtcttatagtgaataaaatgatcaagcaaatttggcactgcatagtgacatattgagcagttcatggatatttggaaaatatacatttgcatcatgcatgaagcaagcgacactgcaaggataacagtgatggttggagcaagcgtgtgcccttcagatccaagtaaattacaaaattaacggcaaatacattcacaaaaattcactgaagtgatgatgagtgaagatatctctgcaataccttgttagaccagaaagcttcacacgaaattcaccgaagtcttgcaatgaaagagaaggttgagtggaatccgctgtaggtaaaaattcacgcatatccttctcggcacatttatgaagacgctccaaaccagactcagcttcacctataaattttaaaacatgtacagccgtcaagtatgcataagcgcctacttggcaaggcagaaattatctactaccttggaggtacacaaaaaaatcactcttcgctttgttgtgtagatagtacccataagcatatgtccatttcagcactcgcctgcattctatgatctgtcacaacgaataatgaacatgtaaattacataaacagtcaatgggcaatagaaaatgatttataatatctaacctgtgaccaagcttcaggtatgaactttagttgggtctctggtataccaacaacatcacttaactttgtaagctatacacatgagaaaatagtcaaacgcaaaactgaaacatcacagaagtccaaactaaaagtatttacaactgataaaaggactgccaaaacagtgagttttgctacaagtattaataaaatcaaacttctgctatgacccacaaatgctgtacacatggtccaatgtaaaacttacatcttcattttcaactttttgcagatctgcttgtgctttctgccttgactgccaacagggaaaagaaaacagaaaatgtatcatacataaaagtacagctaaaatgtaaatttatggcagacccttcacattatgtatgcgaaaattgaatggaaatatacagcattgtggaaaattgttatgaaagtatgagaaagataaatataaaataaagcactgtgtatgtgtttaccactcataatattggatggtaaatataaaatgaaaagtaagtagacaactgatttgccaaggacattagtgccagacgctgtactttgcagcagcaacatgaaattagatccttccagtcagcaaaactaaaagtctccaacctaatgagcttactatacacattacatggtccatatgaaaatcaaaagggcatgtagaagcatgaataccataaaaaatcagataaagactatgtaaagtgactggatcctagacatactgtttgattggacgcccagcgctcataataatgcatgtatctctcaagcgaatttttagctctctctctccttgcttcagcctcatcatactgaaacatgaggaaaacattacaagagattattggcatgaaggaaaacaaataaattaaatacacagcaaagtagtataaaagactagagcaaacacatgaataggtagcaatagaaaagcttattctagcaaggtaaaaatcacgattcttcttgcacaatacagtatccaag

SEQ ID NO: 69149 - DNA, 11863 bp, Oryza sativa
tgggattacacttgtgcaatcccactatgtggacaaggttttgagtcgctttggatatagtgactgcaagctagctcctactccttatgatcccagcgtgctattaaggaaaaaccgaagaatagcaagggatcaactgagatactctcaaatcattggttcattgatgtacttggctagtgcaacgaggcctgacatctcatttgctgtaagcaagctgagccggtttgtctcaaatccgggagatgatcattggcaggctctggaaagagtaatgcgctatctaaagggcactatgagctatggaattcactataccggatatccaaaagtactagaagggtatagtgactcaaactggatatctgatgctgatgagataaaagccacaagtggatatgtgttcacacttggaggtggcgctgttttctggaagtcttgcaagcagaccatcttaacgaggtcaacaatggaagcagaacttacagcactagatactgcgacagttgaggccgagtggcttcgtgaactcctgatggatttgccggtagttgaaaaaccagtgccagctatcttaatgaactgtgataatcaaacagtgattattaaagtgaacagttcaaaggacaacatgaagtcatctaggcatatcaagagaagactgaaatctgtcagaaagcaaaaaaactccagagtgatagcattggactatgtccaaacggctagaaatctggcaaatcagtttaccaaggggctaccacgtaatgtgatagacagtgcatcgagggaaatgggcttgatacccaccaaaggttgcacaatagtggaaacctgtccattgtgattggagatcccgtgaatttggatggcgaaacaaactattgtgtgactgagagaagagacccttgaaaagggcttattttcatgatgtacttctcttctttcctgcatggtaggatggctcatgccttaatgtgatccgagtggcttttccaagcagagatgttgacctacagaacatctcggaaggaacacacctatatgagttcgactgctagtcacagtctatgaggtttgggcgatctctagatactcatgaaaggcctggagtttgacttatatgctccaaacaaaggggatgcgaacggcagcccagtaccagtcaagggtctgagtgaaacctgatcacacaaaacagacaattcaaggcatagtccattgttcagttttggtctgatgtagctcatttcctaggtggaagttcaacttaacagtcttcaccaaaaccctggtatatcgaacaggcacaaccttgagaacatttcttatgagccttgaaatttagtggggattgttagaataattgggctaggcccaatttatcctattaaatctcaaaggcccataataagtgttaaggataataataccacatcaggatttaagcgaggaatatctcaacctaaatagggagttattggaggctccctgttgactggttgaggtagggggtcggaaggccccacgcgcgcgcgcgcgcgccaggccgggccgaggccgtgggcgtgggcgaggcgaggcgtagcgggcgggcgtgcatgcgtcacgtcgctactcttttgcaaccacgaacccacgttcccaggactgcctccgcaacagcgtgtccacgatcccacacgggcgtgcatgcgtcacgtcgctactcttttgcaaccacgaacccacgttcccaggactgcctccgcaacagcgtgtccacgatcccacgttcccacgactgcctctctcctgatagataaggaggctgcgagtccgatcagaacgatccgcttgcttctttcccgggtgttagttcctcctcctccgcgcctgtgctgttctcgcctcctcgcttctgatcgcttgcatgcacgagagattggaaggagcagggcctccggaaccacaccttcgcctgagatctgcaccgagtaggcgggtgatcaggtttttagggagtgcttcccacacgactgctcgtcctcgcccaccatgtctgcgcctagagccggcgctgctgctgctgctggaggagatggcgcgcctggagctggagccgccggaggtggtgcgccaggagctggagtcagtgccgcgaacaacaacatcaacggaggcaattctgcctcacaatctagcggagggccattctcggggtatatctttctcctgtttctgttgttagcgctttactgctatgttcctgttcctgttattcatgatgcctttagcatgctactgcgttactgctatgttcttgttcctgatattcatgatgcctttagcatgctactgcgttactactatgttcttgttcctgatattcatgatgtctttagtatgctactgcgttactgctatgttcttgttcctgatattcatgatgcgcatgatgcatttagtatgctactggttatgttacatgttgtcactagatcaccctacactgtttatgccatgattattgtcttaacattttggattaaaatatgccgatttatgaccatattttcaacagtttatgtgtgtaggaaagttttgatgtgatggaaaagttggaaggttgaagaaaaaatttgcaactaaacacggcctaaagggaggagttaatactggatattcagtgaacatgagagagataatagttagtgacagatatcagttgtaattgctaaagcgataattcatgaaaccagggtttataaaggaaaaatatcggtaattttgtgtgtagatcaaaacttgtgtgcttccgatcataaatattgagccaccagttgcagatgacatcaattggagagagatgctaaaggacaagatcaaacaaattgtttcttgaatgaagtttgataccgcaaattaaaaatttgtgcttcctcgaacttctaatgctgtgttcgggaaccctcacttcctagcacgtaaaacgaagcagcgtcaaagataagatgagcagatattcaaagacgggagggaaagaaaacaaaacaagttgatcaaaacggcagacaaagcgagagagctcaaaggatgacgacttgacgagccggccgggtacagaaaagttaccggctccgggttgcttgctcgccgtcgacgccagcgtccgcgaggaccgcgaactggcggacgcggcgcgcaaggcgcttggcgtggcgctcgcgctcgggggcgccgccgcgcacgtcatgctcggcgtttacggcgcgctcaatagtgtgctcatcgtcgcccagtcggggccagcgtcgccgtcatcttcctgtgttggatagtatagagagagaggatactgcaaatattagacacattgtattgagcctcaggagactggtatatataggagtacatggagaggagataaagaaggattacagttatggaaagagtctacacaaatcaatcctatcttaatatgactctaactaccatatactctaacatcctggacgacctcctcgacaagggctacggcctgcacggggcgtccgccatctccctgctcgccgccaccaacacctgcgagaaggtggtgtggcaggtgttcagccccctgaccgtcgacaccgggcgggcgggcccggagttcgaggggatcgccgccatccaccacgccgtcctccgaccggccatgttcgccgccacctcccgaacgtgatgggcctgctggccacctgcgtcgtcctcctcgccaccgtcttcctcgagggcttccgcgtgatgctgccgctgcggtccagggacgcgcggggacggcagctcgccctcccgatcaagctgctctacacctccaccatgccagttgtgctgcactccgccgccgtctccagcctctacacggtgtcgcagcttctccactacagccggttcgccggcagcctgctcggcacctggaagaagaccggttacgccgccatccccgtcccggtcggcggcgtcgcctactacgtcacgccgccggcggggctatcccacgccgccgcctacgccgcgtcgctcctcgcgtcttgcacgctcttctccggggcttgggtggaggtgtccaggtcgtcggctcaggacgtcgagaggcagctctcggtgcagcgcctcgccttgcacggggcgcgcgagcgcgacgctgctctccgctcgcacatcagccgctacatctcgacagccgccgcgctcggcggcgtctgcgtcggagctctcaccatcctcgccgacatgaccggcgccattggctccggcactggaatcctcctcgccgccaccgtcgtctacaatctcatcgacgcctttcagaaagaggagtagccgagtagggttcgttttagtcattactccatgtttcataatgtaagttattttagcatttcccatattcatatttatattaatgaatctagacatatatatctatttagattcattaacatcaatatacatatgtgaaatgttagaatgacttacattgtgaaacggaggaagtactggagtatactatactgcattacaactttacaagtcagtcttttgcaggagtataatcattacttcttcctcttcttggggaggttttcgattatgatcaatgatccatgctccattttatttagcaattaattcttcgaaacaaaaagttatagtacatattagcaataggttgtcttgatattcacaaattactcctctacgtgctgataaaattaagctagtacagaaattataaggtttgggtttgaattatcgatatgaaaaaatattgggggcaccgataaacatgattatcggaaatctcggaattttattgaagataaaaaaattttggacaaactttgttagattttgcctcaatttgtgcatgaaatcaagtagattgtatctagagcatttggtataaaaaaaagtaacatatataatccgcaaatgaccaggataggtgcaaagaatcatatagacagtcaaagatcatagtgtcacgcatgcaaattcaaaaaaggctgaaatattcgaccgatactgtttttttttcggtacccaccgataaactcgatttttgaaaaattcggtccatgtttcgtcaataatgtgaacccttcccacctttactgtatcctattataagtcgttttgactttttttttaagttaaacttctttagctttggcaagtttttaaaaagttagcaattatctataacatcaaattagtttcgtaatattaaataaattttggtaatatgtttttttgaaaatattattgtgtttttctataaatatcgtaatttttttaaaaaaaaaagaatcaaagcgattaattataatataaatcagaggaagcagtaaggagcaatttctgcaaagcttaaccagccagagctaaaaacaagtttgggcgctgaattcttccacgccaaatcaggaattggagaaatcaatcctatggttttttttctgatcccacatgtcaagtattgttttcctcaaagaaaaaaatggaaaagaaaaacaacaccaaaccatccacccattttttttaagcaaagggcaaaggccctccattttcactaatagaattgagatagtagcatgtaagcatcaatggacatgttcattctagaatagcgcaaccattctaggctgtgtttagtttgtgtgccaaaatttttttaagtatacggacacacatttgaagttattaaacgtagactaataacaaaacaaattgcaggttccgtctgtaaactacgagatgaatttattaaacctaattaatccgtcattagcaaatatttactgtagcatcatattacattgtcaaatcatggcgtaattgggcttaaaagattcgtctcgcaatttacatgcaaactgtgtaattggtttttttcctccacatttaatgctccatgcatttatccaaacatttgatgtaacagaaaagttgaaagtttgacgaaaaaattttgaacctaaacacggcctaggactactactgcctcgagatctgtgcccgccacttgaccgaagaccaagttgcgcttacgtttggtgtttgtgttttacgagatgcatttgacagtatagtggcaagggatgtgtggtttcaaccctaaaatctcgtgttcagctcctaacacgtacataatttcttttaaaagaaatatctggagggacgttttcttgtttgtgttttgctgacggttgggccctataaaacgggcccacttagggcccgcccagttacagcctgctgcctaacgcaaagcaaagccatttagggcccgcccagtcgggtctgggcctgctattgctctcgcaacgcaaagcaattcatctaaatccgtccattgccgaacggacggtacagatctctttggctgacgcgcccggatcacacgaggaagcgtgtcgatgtgatgtgatgtcactcgtccaatgggagacgcccaaacaccgaatcagcgggccccacgccgtggcacttatgcaaaaacacccttatactctgtgaacccttacataatgttcacgccgtggtactaatagaggtcctaaatccaaatatctcattatgtaagggtttaattgtaattagggatcactccagaaggccagaaacctatatatgcagatgccaccctggagtctcgaaaatttgaatttcgaagaccttctccctctccacctcgctcctctctcctctcgtggccatggcgatggcagcaagggcgcgctgctcgaggcaacccaactcccatcgcctcctcgccgtggttgtcctcgccgctattctgctccttccggtggcctccgcggcggcggcggtggtggcggcggtggcggagggggacggggtggagaaccggtcggcggcgaggcagtgggcgacggggaaggacgagggggagctggtctccggggaggagtcgaggggaggtgggtcggtggtggaggacgagttcgcgggtgggttcggctccctcgacagcatgctgcagtgggcgatcggtacgtgcagcccgaatcccaaattctgcgattaaatctttagattcgctttgggattttgagattttgaagtgcgaaagcagcggatttcagtggcgctggcgaattttcagcccagtaatatgattgcaactagctgtgtacaaattggtttgattcgggttaattggaagtagagtgaatgagtggtagttactggagtagtattctgcacattgataatttattatagttttgtttgtgtgatgctcactttgaccacctgtagtcttaatcttaagctgttggaactagtaggctgttattgttactgaagtatgaagtttggttaattttggagacatgactgcattttgctgagttctaccttgttggtgcaggaaattctgatccggataagttgaaagaacaggcagagggtgtgcagaaattgtctgcagatgagctgctcaagcggcgaatggagatcaaggtgaaaaatactgcttcaggatccatcctctgattttgtgttgccgttggtttgtcaatgcattatcttatgacgctttctgctctttgtaacttattataatactggccatacccctagcttatagcagcagattggaacatgcttctgttcttgctgtggtttggattaccaacacatattgttctgatgccaactgagcaaactttatttcttgagcatttttcccatccttgaggaggtactatgaggtaccatgaggtacgaggtatcatgaagtaccaatctaatctaaccgttgatttagcaggggtatgatcggactaaaaaaacatgtgtactctcttcatcgtccgtgcccatccagcccaccgtcgtcgtcgtcatcgtcgccgtcgtgcatccagccggccgccgccgttgcccatccagcccgccgtcgtcgtcgccaattgaggccgccgccgccgtcgtgcatccagccggccacttgccgccgccgtcgcccatccagcccgccgtcgtcgccgccgtcccccatccagccggccgtcgtcgtcgccaatcgaggcttccgccgccgtcgcccatccagcccgccgtcgtcgtcgccgtcgtcgtcgtcccccatccagcccgccgtcgtcgtcgtcgccaatcgaggctgccgccgcagtcgtgcatccagccggccgctggcgtcgcgcatccagccaccgctgtcccgcatccagccgctcgccgccgccgtgcatccagccgcccccgccgccgcgcgtccgtccgcccgccgccgtccccctcgagcccgccgcgtccagccccctccagccgccgcgcgtcccgccgccgccgcgcgtccgtccgctcgctgtcgcccccctcgagctcgccgcgtccagccccctccagccgccatgcgtcccgccgctgccgtgcgtccgtccgctcgccgtcgtccccctcgagcccgccgcgtccagccccctccagccgccacgcgtcccgccgccaccgccgccgtccagcccgccgccgccgtcacgcgtccaggcgcccgccgccgtccccctcgagccagccgccacgccgctgctgtgctctcccgacgttttttctctctcatgaaacagtaaaggacataaataccctcccacccataataccacttcaatgaggaggtgcagtaccatgaggtacggatgatttctaaccgttggatgatgccagatcaatggtcaggatttggtactgcacaacctcaaggacagtaaaaaacctcttatttcttacattattatgccatcaatgctgtcataagagtgatattcatggaggtatcccaaatcaataacatgctctcagttagattttgtaaatttttattttatccgtgccttacgttgcactgttattgatcaaataaaaatagaacaatttatcacactcatgtaaccggatgatatgggctcctaattgctggtgatccttctctgcatagatgaaagacaaagcgtaagaatgttttcatgacatggccgtgttgaacccattgaatttttcttgcaggagttgatggagaaattaaagatgccgtcagatgctgacttaatgaagattgcaattgctgacttaaataattcttccatttcactggaggatcggcagcgtgcactgcaggaactattaattctcgttgagcccattgacaatgctaatggtaaacatgctctagtccatctgaatactatccactcagactcagtgctctgcacatcaagaaaaatatattcttataactttataagtacctcagattgaaaaatctaacttttggccttgtagatgtaggtgtcagtaatattatagtttttcttgtcatagcgattgttttagactaaggccgagtttagtttcaaactttttttttcaaacttccaacttttccatcatatcaaaactttcctacacacacaaacttccaacttttccatcacatcgttccaatttcaaccaaacttccaattttcgcgttaactaaacacaccctaatagtgatttaccgaggtactccaagcccaagcgtcacatatgtgtgactgaatgactgtgtatagttactagttttcaccaaaaaaaaaatccatgcttttttaatacaatgctcaaatccaatcttgaagttgcttgcttgtatttctgataagccagcagcattttcttttttttttaacaatgcaacttcaacttgcgaatatatttttcaaagtaataaatggcatgccaacatatggttcttaaatttgatgataaaaggcactggtagcctgttaatgaatgaacatgattcaacttatgaaaaaaattcaaaataaaaggaagtgcatgccaacatgcaaaactctgttccatttgatgaagcaagggcttatatttgtgcatgcagttcttagaatagtgatgttctaaaatatatgtttcttgtgtttattatcagatcttgacaaactaggaggcctcgttgctgtgattcaagatcttaataatgcaaatgaagaaataaggaccacttctgcatgggtcctgggtaaagccagtcagaataatgcccttgtccaaaatcaggtatcttcttgtttgttcgtcgaatctgcatcattgttgtttataaactttatgcagtgtccttagtggatataccttttaatagtcacttctcttgtgtggttaagctcagggagtagtgattcctctttgttgaaacttgaacacacttttgatcattgttatcaaactcgatgtttcatccttggccagatcctaggttatggagctttggcaagattagtgaagatgggctatgcaacttctgcagaagaagctacaaaggcgctgtatgctatatccgctttggttagagacaatataaatggtcaggaggcatttcattcagaaaatggaagtgcaatgttgcaggtagttaaaacctggtcttgataatattagcatttttgttttagttgtgacatttccctttttgcagcacatattggcgagtaatagtgttgacgttcggcttcagaagaaggcagtgtttctagtgacagatctagcagattttcagctaaattctggaaattcaggacttcctttcttaagtgaccgtatttttcttaagtcattggttgatatgctgtcaagatttgacctcgaccttcaagaaaaggtattatctgtggttctgtactgcttccagttctgtacttccttgtggttagcactgcttagcagcaaaattcttcactcgtcatcagagttgttgctgcttatgtgcaataatttgctgatttcttggtttatttgatatgcccgtactggaatgtgtgctgttcctcatataaggacttctgtcatatgtcaagagatgcatatgagcaacacaactttctgtctggaatctgttctttcagtttccatgagttacttatttgcttggattttaccagccatttccttcatagcttttactattatatactcaatctgatgttctgcacaaaaaggtctagaaatgtttgcttgtgtccaaggatgggagtaatgtttactccaattgacaaaaaattacaatgggctgtaaagtttgcctgttacaacataacgattgatcttgctctgtttttgcgtgtcatgtaggttttgttggctatcaagagcctactgaagctttcatccactgaagccacagatttcgagtcctgtgacctcagcagtgtactgtacagattgggcgtgcagttggaggagttgccatcagaagagcaaaaagagtatgctggggaggtggatgacctccggagagaagtccaaattctgttccaagacaagctcaaagaggtaaacaaatcacctcgcgcagttgctactgtaattgaggtggtgcgattacctgagctaacgtagcttctcttctgttataacctgcagggcacaaagactgcattgtgatgatattaggacgaattaacgacggatgtagtatgcaatggaggcattaaatttttcaggagtatagttgatgtttggggccattcttgcagtgatcagaatcctcagaggatcaaatggagtcatggaatatttatctgtggatcttcggccaggtggtgacatagtgtctgtaggatttgatgtaatcgtaggttaggattattaactgtatggcttcttttcctgaagctacctatggttaattcatcattccctgcactatattttaaccactgcaatgaagcaaattttccccttaagtcacctgtgtggctgtgtcttcctcttgagaatgtatccacgt

SEQ ID NO: 69150 - DNA, 3530 bp, Oryza sativa
attgagatcctatacattcgaagttatcgtgtcttcagtcttcaccactaatgaaactaatccatccaccaactatctcttacaaagtaaacgtatatcaatgatactctctctcacaaagtaaacgaatatcaactggtttattttttttcgtgaaactagtttactcgagtttaaattctaaacttaacacggtgttcaaatttatggttaattatacttttagtgataggcaacatatcacttgtcccatcgacagcaagacgtccgtgattacttggtcaatctcaaaatatttaagtgtttataaggataatgacttcgctaatctcaagatataccaagtgctcataagggtggtggtttcatcaatctcaacatataaaactcagtctttcgaaagtgctcacagaggatagtgtacacattcataggggtgagtttacatgcgttgtgagtatctaggttttgtcatgtgtttctaacaaagaaaaccggataactttaatttcaaaaaatagttttaaaattttaaatcattaatataaaaatgttaagccctggttaccaaggtaaccgtcccgctatcctccgttccgttccacccatgtgccgcatgtgcactgcagcctctcgctttcgtcggctccatctcacagggttcatatcctctatcatgatgacaacaccattacatgtgggttccacctttatattattccatacatcaattactataatgatacaataagcacattgtaatattgtaatgtagggacattagagcaagtttaatagtatagccaactatcatctccaaatcatttatagccaatttaatagacaattcatataatagctgcttaatatactattaatacatggtctcacctgttaggccattcccaacccaacacactagacatagttttcataaactccacatcatcaagaaactagtactagacactactcttccaatgcaaacaccactattctacttaaatttaatgctacttatctcacatgatgttttggatgttgtgtagaaaccatgtctcatgcaatacatggtttccttctctttcctcatttatttacttgtcacatcactttttatcctagatggcaacttatttaatgctatggacatcatcctacttattgggttaggaatgaccttatacatatattacgttttatagtccgtgttacagctaactatggatagactgctgattatctctttcatcttttttatcttttttaaatatatgtttatagctggctattatagctgggatgctcgaggggtagatggttggctacctcgtcccctcccccgcacgctgcacgcatcccctctcctctccccctcgccatcctcaaatcccgctcctctcctcctcctcctcctcttcctccacccgctccccacccaccaccaccacctttcacctcgtcaccgatcaccgagcgcatttcgcatggaggcgctccggctgtcgggcccggcggcgccgcccttcgtccccgcggcgagggtggcggccgcgtggggcgcgcgtaggcggggggcgtcgaggtcgtcgtcgtccgtggtggcgaagatggaggggggcggaggcgggaagggggtgccgaccaccaactacgtggtgccgctcgacaaggccaccgggatgacgcgcccgctcgtcgagatcctccgggacctcaacaagcgcgtccccgacaagatcatcgaccccgacaccaacaccgtcccctggtcagtgctgctccccatccccccttcgatctcttctcctgcccgttccgctcttgcgctgcagaatgatccggctgatgttgcaataggatttaggcacagcgaagttatcgaattgatagggtgaatgaatgcgcgacatgaatcattttggggattttgctggagcaattgtcgcaattcaggaatttgggagtaaaggtggtgccattttttcacgtatcgcattggatggaagatttagctttgctttcaatagctaatgaattttccaccggcgcgaacaattcgatcggttttgccttgtgttaattacaaaatgttctacctctaccatccaagggccaaacagggggcacgtttcatcaactattgatgagtatgggtccactggatattaggatgattgtgagattcacctgttctgcagtttgcacctaccagaatggctgactttgtctgttacaaataaaaatgggctttaaggtagtaggctatgcgattaattggctaggctttatgattctttctgaaacaactaggctttatcatttttttcgaaacaactaggctttaatattcagatagttggtgttctacagccagcagtttatgctcttgctggctcgtttataggtttggaacatccatttgatgggagagttgcttgagtaacgtggtgttatcctgtttcgatctttgtttagaatatattatgaaaagtcaatggtcaaatgtttggtgtgtggatttgtttagttactcatttaatacaaggtcaaatggagacggttcttctagtctacaaagaggaaatggtctgttactttggaatatgggaattattagaacttcttagtatcatgccgtctttttttaaacgatgcacttatgtcggttcaatgaagctaaggcatttgtttcgttggtataaaaatgccatatctttgtgggatagaactttatgctttatgcataaatagttagtatttcctccgtttcacaatgtaagtcattttaacatttcctacattcatattgatgttaatgaatctagatagatatatatgtctagattcattaacatcaatatgaatatgaaaaatgctagaatgacttacattgtgaaacggagggagtagttaccttcgagctatttttttttttttaaaaaaaagcggaaactagagtgtcactaaaggatgaattacttgtgagacctaccctggtgttgggagagagtggtgcccctaggctctagctgtctgcagatctccttaaaactatgtgtaaaggaattatggaataactaatacttcttctgttcttttgataagaaatgttgttgctacatatgctggattaaactagcaatggaacagtataaattcaaagatattttcgtcactaacacacaagaataatcgatgatgctaaattgtactgacataactaagacttctgcaatgactactttcctatttttcaggtttgacatgaaagcgtttgcgtgtttcattgcttccttttgtgtaatgtaatcattgttaatatttgactctgcaggtaccatgccaatagaatgctgagcttttatgcaccaggtgaagtctctttaagattacaaactactttgtgctttctttcctttgattagaacattcttttctgctggttgctggttggttgtactatagtttggcgctcccagatatttctgtatgacactttagttccaaagtggatgtgtttttgttag

SEQ ID NO: 69151 - DNA, 3443 bp, Oryza sativa
ttgtagccctgcataaagattcgttagatagcaaacagaagctaggaactaccacattaggtatttaggtggtacataaattggaacatccactgcagaatgcactggagatgcaaagaaatgtgacgaaactattcttttttcaggttggtgtggagaagttcgcaatgttatttattctgacaatggaactgtaaccgtggtttatcgagtgattctgagaggaacagacggagaggtatttcatctttttacactgcagtattctacatactatgacatagttgatcataacacaacatacatgaaaagaacaacctactcgtactatcttgtttttgtagctgcccttatgtcaggtcagcataacccctgtatgtgtgtgagtgtaggcatacagagaggctactggcacggcaccagtgcacgagggccgtaacgacgatgctgttgcggctgcggaggaagcagcgttctgcaaagcctgcgcacggtttggtttcggcctctacctataccaccaggacgagatcccatagagatgaggatggctttgaggctcatttctgcagaggatctggtggtcacaaagtttgtaggaaaaccgcgatgaattttcgcaccttgctggtagcacaaggcgagcttttgctgatgcatatttacacaagaaaagctttaatttgttgctgcctcagttgttaaatgtattgagtccatgtcgtccagcatagtttgtcagataggaaaagaaacattaaaatcgtgccgttgcatagttgctgtgtttatacccgttttttgtatttgagtccacggatggatatttttgttgtcatgataatgaagttgcttcgacaattgactacgactcgctgtttcttgtatctcttcgcacaaacttgatcctcgaattttggtgacacaaaagctttattaattgtttttccgtatggctgattaaacgattatcaagctctgtgactaaatcatttgctatttgggttagaatcttatcaaaatttggtagagatttgagagtggaaagctccagaagttgtgttggtaatggtgttttaccctatcaaactttaattgtgctactaaaatttagtaaaattaaaaattgaccataaacacgcccagaatagcagtaaagaggctttgttcgaatcaatacatggctcaattgattattaactatatttaacacgaaaataaactaatttaaattatataattttatttcaaaacacgtcatcaagtagtttgagaaaatgctcgcgagggaatagactagcctgataagagcaaggtcaataatatagccagcagctagcttcacttacctttatattttatagctaatactaaagccaactagtacaatagattagctcttatatatagactgcacctcagtgatcaaataattaattatgtgtgccaagataaatgtgtatgatcaaaactaaactatatctgtgtagccatctgtatgatgtgaacttgtgatatcaacaagaattcgtaaaaaaatgattagtctttagataattactgctagtgaagtgttgatggaaagatccaaatcttatcacaattgcatcgctcctaaaaaaatcatctactttgtgtaaataaacaacaggtatatatcgagagaagatgtaaaaagaaacagaaaaaaagatccccaaatccactgacacaacagaactcagaaccacttcttctagctgcttgtttgctcaatcaacagaacagccacaaggcggcatgagatatggcatggcaacaacggcttcttcttcttcataaggacaacatcgatctagcgcgcagcaaccatcgatctgatggttcagcatgagaggaacatgatatatgaggtgcgtgggctttgatttggcaacagtggcggagcttcgcggcgtacgtggtttccaacggcggtggaaattgactccgaatctctgatgaacggcggtggggctcatgtggagtaggagtaggcgatttgtgcggacggaaaaagtgatctagagcaggagaggtgagagctgatgtagggaaaaaagtcacacgggatcgatggggttcggtgtggcccaattttttatcgcggaatcgtgtgtatcggcgggcgatagaagtcgcccgtttcagtgagctataggcttactataaagttaggtggaggagagaggtagtgaaaaattaggaattttggctctcatgcaagagttatttatcacaaattccaagacaaatacattaaatgtataagtgagagatagagtgaggagaaaaaaattgtagcaaaccttatagctaatctattactatatatatgttttggctttaagatgggctaatagtaggaagtgtgctatattattatccttgctctcattctctctctttgattctctctcatgaatttaatgatataaattttttttaagcctgctaagtagaactattgtacctgctcaagaactcacccttctagcttctgttcggcccatctggaacacactggacaacccgaaccgaaccatcaaccaaccgtccacgcaaaccaactcgccacgtagacttctataaaacccacgagcccgaatgcgcccgcgctcgaacccacccaaaaccggccatacataggcacgtagccgcatcgaaccggatccgatccgatccgacccaaccgcgaataccttctcgtcgaagaagcatcgaatcgatcgagagagaccgcgtgaccatccgcggagttcgtcgtcgtcttcgccttcgtcttctccatccaccaccgcgctcggcgaggcgatccaccggcggcgaggagaggcgcgcgggagcggccggagatggcggagaacccgcagctgttcgggaacgggatgctggtgcccttctacggcgagatgttcgtcctcgcccgcgacggcgtcgagttccacgtcgacaagatcccctcgtacgtcccctccctcctcctcctcctccgcgtgtcctttccggtttctgccgcggcgaggcgaattgaattgagatgctggggcttcgatggcgatcgggcgagggatcgtggtgtcttagatggggggaattaggggattaggttaggcacagcgggtgtgatattggcgcgccgaaattgagcattgggctgtatgatttttgtccgggtggaactcaacgctgaaattgagcttcgcatcgagtctaattggcggttactttgttgatctgtacgggttgataggttacaaaccgggacgcttaatcttgctttggttggaaaattacaaaatgttatctccttactgaagtacagcaactatggaaacagttagggatttagtgtcacaataatgagcattattcaccatctcattaccacgaggaatgcattttttttcattacattcaagtgt

SEQ ID NO: 69152 - DNA, 2954 bp, Oryza sativa
gagccggtaagtacttgagcatcacgggaacacatggatatataatttgacatatttggtgcggcactgaccttggaggttataatgcaggttgtaccagagaaccagaacagggccctgtactcgacccacactttcaagatcttgttcaaggagggtggctgtggtacctttgttcctctcttcctaaacctggttgcatctgtgcgacgctacaatcagtttgaggcccagtctgccgcaagtatggcgccacgtgtggacccgctacaagctgttcagactcctgttgatgatatgatgcgtcatgcgtgagtgctcaacctatctagtttcctggtgtgccatctgtttagcttttgccctgctagaaaactcacatgatctactatctacaggtatgttgatccgaacgatcctacaaagattttccttcagcagcctgcgccagagtcacagctgaggaggagaaactaccacggacgggctgacaatgcgtactagtgttcttacctgattgcaaagaacccatatgttcgagcctatgaacatatggatttcggcctctagtcgcgtatcatgctattacgtgggtgtgaaatgaaagcttcatgttgcccagaaacctattgtatatcttttatgccatattcagttgcatatctcaataatggtgtacatattccgtagtcctctggacttggtgcaaaaaatggtttatttgatcccatggtgtatggaattatcattgctcgtgccagcttgtaaatcacagaaacaatacgattattgcttgtgttagggattcttttttctttggtcacaggggagactgaaaacagatgagtaatgttggtaagttaggttgggtgtttctgaattacttgcttttttttccttcctgactttcatgttccttgcaagactctgaagagcaatggcttctgtcaaggtgcaataaataaccaagctaaccttgttctgttagcttttgctttgggggatgtggcagcatggcatgtgaaaaattcttagggaagatctcactgtctgtataaaatgtgttttttaagcagagttacaggcattcaggaatccaaatcagcaggtcttcaggatctgaatatgtaataatctgggttcttatagttatatcgatttcgtcaacaggactgttgtgtactcctctaaattttgctttcaataaaagcaaggaaaatgtcgtctgtaaatatatacagacaaggttccatgacaactttgattgataaacaccacaaataatgtatacgtgattaattcaattcacattggtccacttgtggcattatgtgctaccaaaagtggattgccaccagctgccagagactcaacatggaaaatgtcaggcttgcagcttaaagctgcaaacgtggggctgacactggaatttctgaaaacaacaagagcaaatgataaacaccaggcctttgatggtaatctatcttcttgacaagttcctgaacacatggcgatactgaagtttcttttggcattctgattccttccatccatttgcttgcttgcacattgtcaggctgcacggatagcagcaatatgactggtacaaaggaaaacagacagccgcaagcagcagcatccagaccatcaagtccttgtcgagacgaatttagatgcctatttcttcttttcttttcaagggaaaaaaacactgaccgtttctaaggaatgttgtgaacttgacaagtgatctcggtgttagtgtgtcattgtctcattgactatcttactttcacattcagttcgctgaagcgggtagcatttgcatcattcagcttcagaagctcagaaccatcatataattacaagaagtttctttgtaccataaccaggtttttcacatgtgtagtggtagatgaatgaatgcatctactacttacaatggaaccatcttaccttcagttctgcctgctccatgacttcatgtaatgaggttcttatagatgatcatgaatgaatgaagctggtagttgagaggctgtatgaaggagacagctcttctgctcgcaacagcaccaatcatccatggagcaaatactgagtagcaggagaaaaacacagcaccacttcagttcagttgacaacctctcgagacaaaacaacagtatcagacaattttgtctgcaagaaaaaagaggcatcttcttttttcctttttctttttctttatcagacaattttgtctgcaagaaaagccgacttgagagtatctctatgtatgacggatacagctcatgattggctgaaagcttttctttttttttttggcagaatgaggaaaagaacagctctctatgaaaaggacattcagagtgcaagacgaaacctcagctgttttagtttttttaaaaaaaaacaacccgcatgaggtagtgcgaggtttcatattaacatagcggaaaaaattacaagattaccgtccgaaagctataacctgggaaaagaaagacacactaccacgtgatagcgactccttacatatcccaggagaagcactagcaccaagtcggccgccgctatacgagatcgatcgcgctagtcctacacaggatatttttagcaattttgatattgtcaataagtcagttccatctctgtgtttgctgtcacaactagtttcagttttggttttgctagcttgagcggtttgctgccatatgaacagaggaaagtttttttcagatgcatcacgagtgatcgatcgatgatgcagcaaaggatggacccggttttctataacgcgtcgcaatgcaacttgctcttgtgggcagttcagcagctggttgtttggagtcccactcaacaagatagattgatagatgcatatagatcaagaaggagaattgtataggcacccctactttccaatctactccctccgtttcaaaatgttt

SEQ ID NO: 69153 - DNA, 8297 bp, Oryza sativa
aaaatgtgaaatatgtaaaactatatgtgtacatgaaagtatatttaacaatgaatcaaatgatatgaaaagaataaataattacttaaattttttttgaataagacgaatggtcaaacacgtactaaaaagtcaacggtgtcaaacatttcgaaacggagggagtattaatttctttttcgattaaacgtggcgaatgcatcccttaactatcgaccacccatgcattgcactccatatgtaacttggaatcggcaaatgcatccctcaacagtttgaaacagactcaaatagacgaaggtatgaataattctgtaaacttcgcaagaatctataaaatttggttaaaaaaacactatcctaatcaccaactaattcttatcaattttcaaggaataaaaaaacaaaagggcactagaatctaaagtttttaagtttcaccctttctccgtggagatttcaaacaaaaaccacacaagattctacgacttcatttaaaaaaccatgccaatcaccaactgattcttatctattttatcaagtcaaggcacaaaaagaataaaaaggacactagaatccttaagttttcaaatgccatattttccctgtaaagaattcgcatataaaccacacaagatcctactataattttgttagaaaaaaatatgcgccaatcaccaactaagtattactctattcgttatactatagtattatactataggccgttttaacttttcttctaatcaatttttaaaatttgatcaagtttatataaaatatagtaatattttcaacacaaaacaagcatactattaaaatatattcaatgttacttctaataaaacttatttagtgttgtagatgttactaaggtttctataaatccaaagaaatttaactcgagaaaaagtcaaagcgacttataatatgaaacggaattagtatctattttctcaagaataaaagaaactaaataaaaagcactcttagaatccttaacgtttcaaatttcatccttccccgtaaagaattcgtattcagaatcagggacttaatttgcaattagtaatttaaaacagggttggatcgtataataaaaaagtactccacccccacccccgtatttgatcctagtcagccacccctgcttccttcttcttcccaagttctcatcgagggttttcctctctctctctcgcatcgcatccatcccctcgtgtcgccgccggcggaggctgcggcgagccttcaccccccacccgcccaccgccggcgagccacggcgtgggcgacctcctctcctctcccgatcccctctcgcccttaggtaggggcttctccccagtccccaccacacgcgcgtgcgtggccgacgagcaccccaggttcggatcggatggaaggtatgatgatgatttgttctcgtctcggtgatctccctcctcgtcgtccttctccggcgcgtcgctttcgtgagtagatcggagatccgttcgggggttgggggtttgatttggggtttagtgaacaccctccccaatcccacgtagccgcatcgttaggtccgcctcccagtgattatctagattgagatttcgatcttgcagtttatggtgtacagtatttagagtgacaggtcgaggtgaaaggaaattgaatctcccttgctgctgtcgtgagatttaacttgcgtgtggacaggtctaggtgaagggaattcaacttcacctgctgatattataagatctagctttgggtattgctgctttataagaattattagctttttattttttttcatatcaatcaattcgaagtccttcactggtaaagattcttaactcttgagtagtgcttgtgatctggcttatgcgagtagtttgcatcaagcaatgaataaattattctatagcctctgataagctcctctttgtctgcccaattacctttttcagaccagaagaaaaatgcaaaaccagaggggtcttctggctcgcaaaggggagctcccccggcacctgatgcaggccttcccaatccttttgatttttctcagtttagcaacttgctcaatgtaagttcttttttttttcgcgcagctaaaagcatgatatgtgctctctttttgtgcatcacttatgtttaactgtactattcttacgtacacaactgtaatgtgatgtgcaggatccatctataaaggagatggcagagcagattgcaagcgaccctgtgttcacccagatggcagagcagctgcagaagagtgctcatgtgaccggggaacagggtggccctgcattggatcctcagcagtacatggaaacaatgacacaagtcatgcaaaaccctcaattcatgtcaatggcagaacgtcttgggaatactcttatgcaggtatcatgttatgtttccagagtcatcaccagaaaaaattttcagaatgtttcttcgcttcaagttttctgctacgcatgacaggatcctggaatgtccagtatgctcgagagtttgactagtccttctcataaggagctgcttgaagagcggatgtcccgtattaaagaagatccctctttgaaggggattcttgatgagatagagagtggtggtccatctgctatggtgaagtaggtgttgtatgctagtatttagatataactgtggcttttaaatttgctgagatggtttgcctcacttatttcaggtactggaatgaccctgaagttcttcaaaagattggtcaggctatgtcaattaattttccaggagatgctgctacttccactacattgtctggacctgaagaaactgaagaggatggtggagatgatgatgagtccattgtccatcatactgccagtgttggcgatgcggaggtaatgaagttcgataataactataggacgtgacttctgtttttactttgctctgagttgatctgaaacttgtgctggtatctatccgtattagtcttcacgactatgtgtagctatgctgcccatcaatgtagcaggttgtttacccgacctatcactatacaacaaagcttgcttctccaactaagcatatgactaaaccatgcttttcctagatagttctataacataacctggcttcttgttcttaaagctttgtggaccacctgcttattgtgtttattatccatacaccgtttgcctttatttggtgccaattctacacaaatgctacgtagaaaaatgacttctgtttgttgaatctgatatacgcggggtttaaatcagggcaggtttctcatttggctgccctttttcgttcttaatgttcctgatctttgcactagatatggtcgctcttgatgtcaatctcttatttatgtttgagcctgaggaaatatattaaatcattgtactactcatttgctgcaagtacttctttatacaacataatgactcaacagggtctgaagaaagctttagaggatggagcagacatggatgaagaagacgctgagggaagaagggccttacattttgcgtgtggttacggtgaggtatgtggaactgctgaatggtttagaatagaaatgaatcacgtaacacagattaaatacggatgtttgtagcaataaccaattgggtgaacttgtctgttttcagttgaaatgcgcagagatccttctggaggcaggtgctgctgtaaacgcactggataagaacaagaacaccccactgcattacgctgctggatatggtcggaaagaatgtgtggatcttctgctgaagcatggcgctgctgtgtaagtttaaaccagctatttcatctaaaaccgagtcgatttgatgccctgctagtttgtgcctaacttgatgaaaattgatgaccccagcacgccccagaatctggacgggaagacccccatcgaggtggccaagctgaacaaccaggatgaggtcctcaaggtgctcgagatggacgctttcctataaagaaaccaatgccaaatctcacgctcatcatcaccggctcgtcgctttacagttcagatttttactgcatacccaaatcatcatcgactcttttagctttggttttggtgtggtggtggtacattcgttgaatcgttgctatgtttggtgctccgatttgtaatctgtttcacttccccgttacactgcatcactccgtttcatcctttgtattcctatgttgctgagtctggtgttgcagacgttgctcctgtttttctcagcgttttcgtgtcagattggtagtttatatagataagagatgcactgccccggtgtacatgtgtctcaccgtcgctggtgccgtgtttgaacggtgagaggccgatcaatgcacgcgatcaagtgggcaatgcgacctcgggtaggtgacaaaacatggtgatctggagagtgcgggaagcgagcgcttcggtggtgtttgtttttaccctagacgaagctacacgaaaaatggaaaaaaaactaatattgcatgattaattgaatattactaactgttacaaatttagaaaatagatttatctgatattttaaagtaattctatataggaagaatttacacgaaatgtgtaatttagagtttgaaaacatgctaattaaaaactgagataaaatggagtatatcttaattacaaacgatcatgggccttcgtcgtcggattggagttcttctatccacttctattttcttccatgttgccattttgggcggatgcaactgttgctcaaaacgagcttatccatatgttgaattgttgactgagattggccggggagagccgtacaagttttagggagcaggagaacgacaagtaaaagaaacactttcatgcgtacgtggacgccgcagctgccgagctaggccttgaatgcttcgaacgcttcatctcactcactggcaggtgggtcccacctcagggattaaaccacacgtcagcatcttcccctcttaaagacgaatataccccacggattccctaccatacctactagttcgcgcacggtctcagtgtcactgacactgggcccccatccctgtggcccacatgtcatcgacacaaagaatgttttactagccacgtgccgaagccgtcgatggccgcggggggcaaaacggcgaggcgacagccgccgtccgatgagaatccgacggccagggtgccgccgtcagctgcctccacccgccgcgagcgatttgaccgtgcggtgacggtggtgaggccgccagccacgtcggcggcggcggcgaccggcggctcacttcgagaagcgtctcgcctcctcctcctcctcctcaccattaatacccccccacccacgccgcgcgcgcgcctcgccctcgtgctccatgcgcgccacgctgcgagggcgaggccaccgtcgccatggccgtgctgggagtgggcgccgccgtcaggctgcggctccgcgtgctcggccgccacctccgcctccgcgggcgcaggcgcacgcggcggcggcggggaggtggtggggtggaggatgaggaggaaggagggagggaggcggtggtgctggtgtccgggatgggcgggtcggtgctgcacgcgcggcggcggtcgaaccccaggttcgacctccgcgtctgggtgcgcatcctccgcgccgacgccgacttcaggaagtacctctggtcgctctacaaccccgacaccggtgggtcgcgcgcgcgcgctcgtagtgttcgacgaaacgtttgtgtgtgagttggggtgcgcggtttgtttgaacgagagtgattcggtttgctgttgtgcgcagggtacgtggagccgttggacgacgatgtggagatcgtggtgccggaggacgaccacggcctgttcgccatcgacattctcgatccttcctgggtgagctagcttctgggtgttagttcagtgaagaacactagaaagagggtttgtcttttcttgctttgtaagaatggtatatttgcgagggtattagttcttccgcctttacttgagcgacggtcattcgttttttttttaaattgttaaccacgccacatttggtgtgtaatactgataattggtgtcactggtgccgtatcaaaagtacatataggttaagtgaagccgtagtaagtactaacagctagaccgtgcgaaaatatttagtaagtggtagcatgcccccgtatcatgcctatgggtatattcatgagcactagcaattggtgatttgatgctgctgcttcgtgatttctttttgtactcatttcttatgttgacattgaagtggaggagcgtgtgcttttaagaaaaagccattgatatttgcttctcagatttcatgggatagatagaatctaaaaagcagatatttgtctgtgtagtgcaacaatactgatgtgttaaatcaccttccttcttcaactagtcacactcaaagaccataatgtttctgatttgatttttcctctatcttctgtaaactcagtttgtggagattctccatctgtctatggtgtatcactttcatgatatgattgatatgcttgttgactgtggatacaagaaaggaaccacactttttggatatggttatgattttcgccaaagtaacaggtacgatctatgtgggcttatttgcatagtctcgagtcttgactcaatagcatcaaaaaataaattagtttgaacattttactgctgagcaaacacaaggtgctgtaattatgggtttatctggcaggatagacaaagtgatggttggtttgcgagcaaaacttgagacagcttataaggcttctggtgggaaaaaggttaatataatatcgcattctatgggtggactgctagtgagctgcttcatgtctatgaaccgtgatgtgagttttcatgattagaacagtctgttgcttactaacaatcgtattctgtattcaatatgttttctcttttctccatttttctagatatttgcgaaatatgtgaacaaatggatttgtattgcatgtccatttcaaggtaatatatattttgacattctgcacttatagttgctctattcttgcgttgatgacctttgataaaatctgtgttctatgttttttggttttacatcttggcaggtgccccaggatgcatcaatgattctctgctaactgggctacaatttgtttatgggtttgaaagcttcttttttgtttctagatgggtgatgcatcaactggtaaattcttgactatttcatattctgctagctgagtttgtgtatgcttactactgtaaatcttgttattacattctatataaaaacaaccaccgtgtgcttttcatctcctacctacagtaggggggtccctattggaaatatattttaacaaaaaaaatgcatgtatattcacatatattcaaaggatgaggaatggagctctagaataactaaactgctaatgaagggctacacaatgatggtcctctgcaagcctgcaaggattttttttattgtgttggttaagttatttgtttggtagcataatgctattactcctgctcttggttgctaatgtttagtcattattttacactgaccaaaatcaaaatcaactatcattttgaagttttcattcactcaagcatgtccatatagcttcttacagttctcgaaatgaattatgtttacccttctaagttggtctgtcacgtgtgcagcttgttgaatgcccatccatctacgaaatgctgccaaatccacatttcaagtggaagaaagcaccagttgttcaggtttggagaaagaaacctgaaaaggatggaatagcggagttagttctgtatgaagctaccgattgtttatctctgtttcaagaagctttaaggaacaatgaggtagtcactctctgcttctaatttgtaaatacttttaaagcataagaaattagcaccgcactaagcgttactatcaaaagttgaaaaatcttttacatacagatgagaactactttgcgcactaactggaactaaatcatcacaccatcctttagttgagagggaaatacccagatagtatgcagaaggcaaaagcacgttggcagttggtattactcatgaaaaacatagtaatgctgtctactccattgatttgacaatgttaaaatggtttatagattggtggctcacttcgaacaattggagataatgtttactgcatgtgaacctttttttatgcggaactgcctatgtattaacattctgtgtgtacccacatctgggagaacttttgtcctgcccataaaaccattagtcgata

SEQ ID NO: 69154 - DNA, 811 bp, Oryza sativa
ttaatctataacagatttattccgatttgacttatctagctttggctttgctgtaattatgttctttctgatttgcagttacggctctgaaagctccccaattggagatctgtcagaagtgtgccacacaatggtgctgaacttaatcaattaaaaaatatcgtttttttagttgtgtgatattgcttttactaaaatattatgctggtccatcttattttcagccagtgtacacttatgtggatggagatggcacagttcctattgagtcaactatggtagtcgctcttttctgtcatataatagatttcagctgtctagtttcctttctgtaatgttattcaacaaaacccagttcacagtattactcttcattatgcatcgagaaattactcacttgttgcttaatgatttagtagggaagcagaacattacataatgcctttcataaactttggatgttaaacctagttggttatgactaaataaagtgccttaattttgtaaagcctagcaaacatacgatcacaagatcatcttcaatggcatatcaaacattcttttgaagacaaaaggcattgcactatgacccgcaatttagtggcactctttcggatttcttcagtactgcttgatcctcgagtgttttgaattcaagggcaactcgttcaatgctaagctttgccatttacagtttaggatacaccatacatacttttccttccccttaaactatagcatctgccatgttgcctcatgaaaacaatctgggacacaatatgtcattgtttttttgttgtcggcaggctga

SEQ ID NO: 69155 - DNA, 10776 bp, Oryza sativa
  unsure (1)..(10776): unsure at all n locations
caaaataaatcgatgtcttatgtgtaggttgtggccagaaaataatttattttaggatgaatgaagtacgtatcttgaggaattttacttcctttggaaaagtatcttgagatacctaaattttatactacattttttatacttttagatatttagtacttattagagataccaaatttaactaaaaaatatcgatctctaggtaccttcttaaggatggtaaaaaatttttgacgtaagttaaggatggtaaaattacacatgtatcttatgtgcatgttcagaaggaatggcagatgaagaatgaaggcttacttgtatgagtagatgacaaggccagctgccgtgccagcaaaagcaacgaaatacatccaatcaacctgcaaatgctcaaaatttgattaaacaagatcaatttgaattttaagatttagtattggcatgactgtatggggggaggaattgttgttcagagaccttctcatggtaagcgaagatacggattagaacagcccacatgtccgaggtcaaaagggagagattgagcatagttgcaccacatatctgaaattattggagtaaatttagtaacatgcaatattcagaaatgctgtgaattttcccacaatcatggcctgtaccttcaatataatcggtactgttgagtagaacaagaacattgctaccgcaaatccaatgaaaggtagaatctgaagaaaaaaaaagggtcnctatgaatacgaacgcatggcttaacttgacttactgcctacgctcacgaccaacaaccnanttantntncntntncnantnctncntntnanntntcangnnactngctnggngcctttcaacaccccaaccccaaccccaaccacgcgcaacacctctaagacgacaacttagaacctcccataagagaaaacccgtgggacaaaaccaaacccattaaacaaacttttttttttaaacttttcccacaatctgagaaaagaattgactctgtgcgccaccccattactcaaatgtgnncctcgagtaccatgtatgaaagggaggagatcgacttaccgcaccagcattccattcggttgaccgaagttcttgtcgttcaagtatgcttctgtagcagtgttaaggaaatgggatatagaagcatattttcttgctatgccaaatataaatcaggtaatacaaagtacaaaatagttacagatgggttggtagaaacatgtcccagtttcactggttcattgttttggtctcgttgctattcaagtaatttcccttgttttaacttctagtaacatggagaggcattcttataatattcttagtttaatcaaactacagtggaaacaagtcatcacttaactaatccaaaggatacatttgtataccacttataactgctccaaaaacgcccagcattgccatcacctcaattctgctgcttttcttgacaaagtactcctgaaatgttgtaggcaaaacatgcaaggttcttcatgtgcattacctaatttagttttatgcttaatccgatgggctgtcaaggctaatatttgaagtggtaattatcatatctcaaagaacatgttttttgccgggtcggccgaaagatttggtcgaccaatttcattaaaatctcaaagaacatgtgaaaaatctagaactgggagttctcccctgtgttctgaaaagaaatggaaaataaatagtaataaacgaactatagatttgctattacctcggtaacattactgacagcataaagcatggccccagcaatgacaaacaaatcacctttcaaggggttgggtccttctgcaagacactccattgtgtaaggtcaacatgatttacttgttattcttttactgacaagtgcaaaatactgtattttctttataatctatttgccacatttcagaagagctttgtgcctttgtgctgagaatcaagtacacattgcaaagactacatgaaacagagcaatgcagcaccaaaataaaacgcagaaactgaacagataacggcatgccaagcagatgtatataagtgtataattgtgtgagttgagtaaactttcattggaatcatgttcttacttgctctatcagaggcatggacatcagaaaatactaccaatataatgccagccacacaaatcacaacaccgatgaacttcctcaatccatactttgtcttcaagaagacccaagtgaggagaatgacacacgggatcgcccagcaatcgatgagcatcacactcgttaaggatgtatactgataagccttcacaactgtgtgaacaaatacaagtcaagtttagaatcttcacatgaagttactaactaaaaagaagctccaatctcagtaagaaattcagattacatcattttcactaatggtagacatttaccaatatagttagcttctacatcaacgatgccaaggatcaagaagtagtaccatttaatctgcagaaacaaaatgcagaaaacatttcaagctccatgctgataaaaatattcagattgctgcattgcaatataataccgtggtgacaacgaaacagcctcagaaacttttttttttagagaagggtattttttacccggcctctacaaccaatcggatatatgcagcctttttaaattaggaacttagcctatcaaacagcctcagcaacttgcgaagaacataatcagaataagcataaatatgtttggtaacaaagtgacttgtcattggtcctggcttggggataagatacgctaaatacgcaacgtacatgcatcaatcatacgaaaaaaagaggaacagcacaactcaaaataatggtcctagggaataataatctgaaggtcaggccagggcacaggacatgtgttgttaaacaccataatagcttattgacctttggtttcaccatttccagtctccagatatcaaaatcataaccgaattttgatctaaaaaatagccaaaattgcatccaaacatttcttttcagggcaaaacgcagcaggcagacataccgtcaggtgttgccttctgtagatcagtatcccaccataaacaagcgcaagaaggacgtaattcagcagagactgcgaagttggcgcgttgacgcctgaaaacaatgcgcaggattcaatctcataatcagaacttcgtaacccaccattcacaactgtctatatctgaacatggcatggtttgtaacaacataataattttcaaagattatgaaattcgaaacatggtcattcatctaccaagaaaatgaaaaaaaaaagaaccaaaatgaccacgtataatacaagccaattgcacgaatacattctgaaccaaaagctcatcaaaactgaaactgcaactcatcaagaacccaactattttcagagttcagattgcatgaatacattctgaaccaaaagctcatcaaaactaaaactgcaactcatcaagaacccaactattttcagatttcagattgcatgaatacattctgaaccaaaagctcatcaaaactgaaactgcaactcatcaagaacccagctattttcagagttcagatttcagatagatcgataccatcataccaacatccagttgttagtttcaaacaaaagccctatcgagcgaatacgcgaacatcatgcggcggcggcggcaagccgtacctcggcgggcgagctcggaggaggagaagccggtggaggtgatgagcagcgagacgaactgccccagcgcgagccccacgaacacctcccgccgcagccacctcgccgccgccggcgccattgctccctctccctctcctcccctcggagacttctcctcgccgtggacagtggacaccaacgtcgccgtcgtcctctccactggactcacgccaagccaacaagctaatgactttccaaaacaaaaatgcttaactacttggcctatatatacggcgcttcgttgccgtcgttgcagtgtgggccccgccgccgctaagccggccggtgtaggctaattgctcattttaattactgttccttctatgacggcattaacttttttaattaccattcgtcttattaaaaaattatgtaataatatcatttattttattttaacttgatttatcatcaaatattctttaagcaatggtataaatatttttatatttaaaaaaaatttaaataacacaaatgatcaaacgttatagtaaaaaaaaaataacatcgtcgtacattttttttaaatggagggagtatctttttcgctgcccccttgcattgtgcagctgtgtaaactgtaaagcaagatatttttccatgcatttgatttgagccaaagacatactatatttattttttaatgtataacgttgttgattttttaatcaacatttgactatttatcttattcaaaatccttgtgcaaatataaaaatatttaaatcatgcttaaaaaatatttgataataaattaagtcacaataaaaataaataatagttactttcttttgaataaggcgaatgatcgaacgtatctcaaaaggtcaatgacgtcatacattaaaaaataaatgaagtatcaaatatgaaccgaatttgaagtgaattcaaactttttttcgcatttcagaaacaggctgatcatgtcatgccagcgctcaggtttaagctttgaacggggtggattgggttttggcagaagactctctagctctcaccatcaacctggattgggtttttttcttaattaaattgatatcaaattctcctttttatatcttacagtattttaaaactttcttatagcattgtcacaactcacaagatatagatttatatgctataatgggaagctattgctatctaaagtgagatcatggcatcatctacatgtttaattaggcccttaattaaggtgatattgttatgcacgtatgctcttgtgtaccgtgtgattatccaaggaggaaataatcttcagccacagaagatttttgagaaagaaaaattgtaagttagtatatctatttcaaggaaccaaatagttgactttgtgctagttgtgcattatttattacaacatttctatggacatttgcttgttcttgcaagtcaacaaattaaaaaggagcaaaaaagaaatggacattgcaatcagttcgttgtatcttggaataggactagtgcatgacggccactctcatgtgacatcacactcatgtatatatgtgttcagtcaacttgtgataatatcatttccgaaaagataagatgtgattataatttataacctctcttaagtctctagaacatagctgtaaacaagaacatccttttttctagtttgcactagttaaagtaattataaagtttgtccattcagagtttttaaatctctaggtcgtttattagaattttaaaacatttccccctatttttagggagaagagagaagtagtagatcccaattgcttagctcatttgaaaagaaaaaaaaacatgtagagaacaaatgacatctcaactagagtagttatttttacagtgaaattagtccatccaggttcgagtctccaactctacagttaattattttgtaatggtagtccttacccgtaaacaaaacgttgaagtgatttcgtcaatttcatgtattacctcggtaacaaaaaaaatataatagattacatgtatttatactttattttcttaaaaaaatccctgtaaaattacctaccgatttttatctattttatttacatgggcctaaattggacatggtccaacgcgtataacgtaaaggaataagttcatctgatgtctcttaacttgtcaatgaatccgattttcgtccatcaaccgaaaaccaaatgcaacgggtccctcatctatcaaaaccagtgcagatgaggtccctcagcggtttagatggcggttttagctgacgtggcgcttacgtggctaatttgactcggtcttcatctgacgtagcattgatgtgacgcttacgtggcaattcgatccgaaaaataataaatcttatgggacccacatgtcagtttgaatgaattaaaaaatgatgggtaacattctcacccctcctctctccccatctctcccctctcctctctctagcgccacggggtcacggggaggtctggcggcggcggccgacgacgcgggggaagggtggggcgtcagtggcgggagtgttgggggacgcgccgtagcctaccacggtgacgctgtggttgacgtcggcggacggcggtgcacggccccgtgtagacaccgctgccgtagagctagaacatgaagttgccggcgtcgacggtgacggacaccggctgcgccgccacagccctcgccaagtcgggctcgctgctggtgtcacgttctggtagcccgcgatgctgaccgcgctctggttcagtttcgccgcctggcacgcgccgttcgcggcgtggtacggctagctcgcctccgtggtgactagtgaggccgtggttgccgacgatgaactcgaacagctcatgtacccaccgccgcaccccacagcctcgtcgttgcagtctacgagctcctgctctgacagcgacaccagctcgccgttcttgttgatcccctctatcaccgccacggcggagaacgcccagcaagaacctgcatccacacaacacccagatttccatcgattaatctccaacatttttacaggtttgaatctttctttaccatgctattgctcacacaccacaatcttcttggtactccacttccaccactgctcctttcttcctccaatctacgctcttcggcagaatatcatcactgctctctccaggcattgctttgaggaattgcgacatgaggtctgaaccccagcatcttggctctgaactcctcgttcgtcaggtcggcgaacgtacttcttgtcagccagcttgtagccattgcacatggagttgaacttctcaaataactcaacgttgctcctgtacacctcgaacctcctctgcttctcttcggcagtcgtgcagctcccggcaccacgctcgcacgagctccagctcgtcggagacgggcggcgccgcggccccgatctcctccacgagcccacgcgcggggtccgcgccgacgccgtgagcgaagacctagcgctcccgccgccgacgccctgcccactacccttctcccgcgtcgccggctgccgccgccggacctccccgtggccccgtggcgcctggagggaggagaggggagagatggtgagagaggaggaagaagaggaggggtgacaatgatatgtggggccatgtgggccccaccattttttaattcattctttcggtgaaactgacatgtgggtcccatgagttttattatttttcggatcgaattgtcacgtaagcgccacgtcaatgctacgtcagatgaagaccgagtcaaattagccacgtaagcgccacgtcaaccaaaaccgccatccaaaccgccgagggacctcatctgcactagttttgatagttgagggacccgttgtatctggtttttcggttgaaggacgaaaatagaattcgttgacaagttaagggaccttaaatgaacttattcctaacgtaaagtcctcttctttaatgcttatattaggcctggcccatattagcccattgagagcccagatgactcatgggctcgtggcccgtgcagcgcggtcgccgccgcaaggtttatctcctccgcgaggccgcgacctgacgccgccgccgccggcggccgccgcctcgtcgtcgatgagctcgccatggcgccctgccgaaccctatctacgccgccgcggtagcagggttcaggtttggcggcaggctacccccttctcactgtcgcacgacgacagacgactcctccctcctccccacctcgccgtcgtcgtcgtcgacgactttgctcttcctccgtctaaccaaatcccagattctgcagggccgcaggcgcggactaggcgaagaagggccgtcccccgttcatggcactgccgcgcgagcgtcccattccccactttctcgccggtcgcgatgagcagtaggccagagtctgaaatgtgttcgtctcagccggctcaatcgttcggcgggcgctgacggtatgctcttaccatgatcccctctcatttgttctagggatgcaagtgggtgatctcactacccgcataaaaattcactcgctagttcatttcttacatgatagtataaatttcggaaggaaaaatgaactagaagtgagataagcgggcaaaataatctcgcttgcccgccccacttgcatcactaatttgtttattgtggcctccgcgagactctgtggtgactgattgattggtgttgttattagtaatctagctgcattgtggctattatctgaaattaggggatctaacactgagcattacttttctcattgatatccccattgcattgcgtttatccatgtgtggatgcatccaattattgctatctgtaggaaactagaaatggttcttcatctctggggtttattcctttgattcaatgtatttggatatattagcctttcttccattcattatactttaaatcaggccctggcacctgtatctagaaatgttatggtatatatggttttgtatgccatataaatgagtttcaacttggttttttgtgaccctttagaaaaaaagaatgagaaaaaaatgtccacaattagatgctgcgagtaaaaagaattcagatttgcatatatgtatgtgctaatttgtgttcattttaaagtagagaacaccaactgttgcactattcctcataattactgatatgaacatcagcattaataggtgactatgaagatattggacttctaatttatttcatacaatacaagtcaattactagactacttgattgtcaactgctatatatatgctgttaactgcgttttgtgcattatgttttgtaatcttgaatgatgttgcatccagccttcaacttggtccctgaaacctattaacaaagaatagaaaaaaagaattagtaaatgatggcttttctcctaaaaacagcatgcctagtttgttattgttttggtgtctaggtcttggcttcttgcatatatgaataggggggataaacatgccatctttgtaatctaatgtattgtttgtttcttttgaaacaccggaagtgtatatagtgagtagaataattgttcagcattaaaaaggatgcgagaaggcttatttctgttgacaaaattgccatggtaattaaaactacatatgtgcacttatgtcatggaaagcttgctcattatcatgaacagggtaaagtaagcgcacccgtgtcctaaaaaggtactaagctaggaacttaagttgatattctactctgaattcactattctgggaagaaacgtgtattactaataaacctattttgtatcttccagatatatgcaatgagctttagcgatcctcagaatcttttctctagagcatctttggaaatcttatgcttgtgttagagtagatgccacgtctaagtctatgaattttcaatcaaaaatgtcatggttatgttttgagagggggtgtatgagtctatctggctcctgtgatttcatgactaccaatatatgaatatttattgttttagtctctctttaagtaaaatattaaatttgttcctaccttctgccaccaacaccactctccttctggcagttgaagtataatgcagcaacaggtggtccaagattgtaaaatgcagagaaatctctgacgttgaaattttgccgccatcctggagcataaactgtttgtggtgcttcctgtttgaatagcacaanaacaagccgatgaattccagccggtggccgtggagcttcgtacggaactatttcattgcctgaaacagtgtgtattctttattagatttgttttgttgtggttcatattatcaaggtgaatgttagctttcaccacatcactctacagactacatgttccttgatagtgtggtatagattgtcctatagttcagtcattcagtgacattactgcccacccttcagtcctgtgccacttgctgccaattaaagcaaataaacaataccctgtggtacatgttgtttcacgaaatatcattatggttagaagtattgcaaccaattgcacatcctgaatatctgtcatggcttccacatgaaaataaatattaaagttgaaatcccactagtgaaaatgcatatataaaaaaaagaggtgaaccatttttattatgtgaccattaagtgtgagtgtgtgactaataaaaaatagtaaatgcctgagttctagtatattatgtgacttacatttatttttttcaatattcataaaactagatttgatgtttaaataatcacttgcaatcttgataatttagcagaaaagagtgtgcctctctgatatccttgggatgagccagatgagaggatcaggcgtgcttcatgtatgcactaccgaaggtatgcttataagttataactccagcattgcagcttggctccaaagaagtctgtaatttgtaatgctactagtgttttttgtgggaaaacagtagtgctgtttttgaactattattattttcagttgctcacatgattattcctagttggcagcttctttagggagggacagagggcatgtgataactttacaccttggttttccttgaacctccagaaa

SEQ ID NO: 69156 - DNA, 8971 bp, Oryza sativa
agggctctgagtgagaattgtcaccaccggttgagcctagtgatgaattggtgcaaggagcaatgctgtcatctcccttattttgtatgtccacagtaatattcccagatgaagaaatggagttgttgctgtcatcttttgtcgtcaggctactgataaaatgagagaaatttccaggttcagaacgacaggtacttgaggggatgaacacttccttcttcaagctatcaagtaacattgatggagtggaattcagatcaacaacaagatcaagtccctcatctgacatgacaaaaaattcaaacgaagactttgcattttctgagatcttatgagatgagccactaccaatatctgtaactgtttcaacaacattaggtgcctggtagcttgtttccggagaaatttcatcatctaccttagcagttgaatcaagatgaattggatgctcttgagttcccaagttctttccaataccatcagcactttgtgaatgtacattagaagcaatcacttgacgaggaggtgagtggctaaagcagtctacttttccattgttgattgaaactggtgtagaactcactctggttccagagtcctgcttcaagatacatcaatagaattaggaaatgcatttgcattatatacagacctaaaagcaccaagggctccatgcatatgaggaatgctgccgtgaatgccagaggaaaataaactagagtaatttttttatataaatactagaatggaaaactgacccctgtaggatttctaaccaagcaacccgactacagcagtatatttgtcatggagagcgtaaaagagaggattttgagtggcaccatttgatcaggtgaaatacaacatgtcatgaatgtggcaatttatacaaattaagaataccatcgccagctggtctatactgaaggaattccttatattattaaaaactaaagagcttatatccagcagcctggaattagagaaatactagggaaaaatcacagattcttacattttttttcaatgtttcatctgttggtgtttgaggtcctttgtgatgttttacatgcagaagaggtctatcaccatcatctctttcactttgcggacctcttttatggctaccttggcaacctgcagttgtttcggtttcattagatacacacaccatatattcatgtcacgtctctgtgagagccataaaccattgagtaaaaattggcaatcttagaaactatgccaatatcagaaagttcctatacatacgggtggatacttctttggcatttgataacaaggagggcaaggcaacaagggatgctgctgctttcttttcaggcgatggatttattcttcccttctgagaaacaaagatggtacagattattaatttatcctctgaagagaaatgtaatgatacactcttccgaccaaattagatgcagataccaaacttaaaacagacaatatagcttacctcaagaaacaaggcaagcgagcttgctagctgagagtgactcttgtttgcaggaagattatactgtttgcacaaagattggagctcatggtaattaaggccaaggagatgcttttggctttcctccaaccccatcagattgactgtggaagcacatcaaagacaacaacaacattagtccctcgtcagccatagacaagaaggaagtgaacacgccatatatatgtatatatcataaacgaagcgaggcaggcctatcgaaacatgacaatcagaggaagctgagctcaccgcataactcaaactaaaataaagggaaagcactagtcactactactactcgctagtacacatgcgaacgaaaatggcatccgccatttgtccaccggtatctgctcatcgcgtccgctagcgcacaaacaagcctgggcccatatgccaccccctcgtcgaacatggagggaatccacgatttcgaaattcccccaacggatccgaacgaaaaccgagggaaaccagatctaacccagacggcgaacccccggcggcggcggcgattagcagatcaatcctactcctactcctaccctaccctaccctaccccccgccgccggaacgccgcaaccaacaggagaaaccactcgaaacataccgaaacgccaccagccagctcacgccgaccgccccagcgaacaaacacgcgcgcgacgcggacgccccgacctcgccgcgcgtggcggcgccgaaatcgaaaaacgagcgagcacggagagagagagagagagagagagagagagagagagagaggagcgcgcgagctttgcttaccagcgtcggcggaagcggaagcaggagaaggagaggtcggcggcgggcggcgggcggcgggcggcggaggtggaggcggattcgccggcgcctcgcgtgattttggggaggcggcggatttgggggggaatgagacacagcacgcgcggcggcgcccgggggcaaagctgatgatttccttctagaggatttttgctttgccgccttgggggcttggggcttttgtctactctgcaccgtcaccgcgcggcgggaggccacctcaccttcacctcacctgtcaggtcacgcgcgcaacgctacccacgctgctgcttttgccgggaccgcggggggtggggggtgatggacccacctgacagtgtcacgtgtcaggtaggggctagccatccgccccgtcgctttcggttctccgctcgctggcgggtgggcccgcgtggcgtggcgtgtgggccccgccgcaccggacggctcgggtcgggacgggggtggggggatcagcgcgtggacttctggcgataggtctgtggatggatgatgatgacgtaagttcgaatttgaatttttggctcgctacctgtcaaaatttgcgtgtcaaattttcgtcatttggctggttgcaatctcaaagggagttttcgggaggacggttgggaaatgggaacctctcctctttggcgagcaaaacgaatcatgcattagtgtagtcttaattaagtattagctattttctttttaaaaaaatatgatttttaaaaaaattatagaatttaaaaaaacacaaacaccgtttagcaaattacaaagtatgcacggaaaacgataaagttaaagttagaaacattgacttgtgatgtgttcggaaggaggggttgagaacccctcactccggcacgctaaaagaagcatatattagcatatgattaattaagtattagttgaataatttttaaaaatatattaatatgattttagaaagcaactttcctatagataaattttgcaaaaaaaaatcatttaggctgagttctttccctaggttcccaactctcctctctcgtttttcgcgcgcacgtttttcaaactgctaaactgtacgttttttgcaaaaaaaaaatctatacgaaagttactttaaaaaatcaaattaatccatttttgaaaaaaaaatactaatacttaaataatcatgcgctaatggatcgctccgtttttcgtgcatgggacatgggtttccaaccggaactagcgaacacagccttagtcatttggaagacatgcgcgcacaaaacgaaagaggcaaggatggaaactcagggtatcaaacataacattatctatcttcaacttcccttcccttatatttattcttttcattagactttgtcacttttgcttattggtttattggtgatagaagaagcgcccgttacactttaatagaggaatttgttgtgaatgggaggttatgatgattgtgttggtgtttgttagatgggagttcatggaatgtggcctctaggctctagggattgtgtttctcttaatttcttttcagtttccaatcaacaaaacataagatcataaattactatcccaaactagtgtgaatcccctaaaatttcgaacatgtatttttctatgaaacaacttatagtgtatatttataagagtttgtgtctcattgatctaaaattacccctcttattcctatcgttgtcaagttgccataggaagcaattttttagaccacttaatcaagttgtactttgtatttgtttctcacatttacatgaagtagcatgtttggtttattgaccaaactaccataaaataaccaaatccaaacattgagcctaacttgctagtattttggtttgttatgttgtggaaccaagccatctgtcatcaaaccgtcctccctaaccacaccatacaactctttcttgtgactatatatggggagagaggctattattagccaaactccaacctcataatcaatatttacctagctttaggaacacttatgaagctaaggtcctaagtctagcctcagggattcgtcaccattgttcatgttcaccattaggttccaagagctcgataatctcatttcacactaactataagtctagaacaaggggattacaggaacgagaagagaaatcaagttgtatcaaaccttatattgagaactgaaaaggtagggggtatcatcgatcaagaccttctagatgagagagacgacatttatgacaagggaaagagaggcgatacttctctgcagtacctccacaccgccatgaggagcgtgcctccgttttgcacagtcatgcatgtctttacagttttgtgcatgctattttgtgatttgatagaatacgtgaactgaattgagtggagcatgtccatcttttgcacatgtttgtgaacattggaaggtcttacacgtgacaacaaaggaatatggagaacaaacgaatatctagcgtgtctcgtaaatagggaatatcttgatagaacatataaagatagtatgcccactgatagatgaattacaggcgtgctaatcgtgaatgggaatggtggtgcctatgatgggtaagtatagtagtgatgtggttccaaaaatcacaatagcgtgacaccccacatctcacatagaagggagcataatagaaaaatggtccaaccatccaagactaccgtggcagcttctcagcccaaggctagccaacactgaagtgaagcattggtagccaccggatcatgtcacggcctcataagcatatatacactagagaacgactactctagttacagtaatatttaccaaaccaatacaatctgtacaatcttaacttatgaaaatgttactcgtacaaaaattctctaagatttaacatccaaaaccatactccctccgttttacaatgtaagtcattttatcatttctcatattcatatgataactagattcattagcatcaatatgaatgtggaaaatgatagaatgacttacattgtgaaacggagggagttgtcacttaactactctctccgtccgatagaactcaactggacacacagtcacagacagtgggccctgcataagtttcgtacgcaatcaggtagggcccactcatcagcgacagaggtgcacttcccccttcaccctccaccatctctccctctctctctccattccccctctcctcctcagatctcccacctcgaaccctagccatggcgatcgcggcgcgcgccctgcgccgcatccccctccacctcgccccctccctctcgcgggccttctgcgcgctctcgccggccgcccccgccccggccgctgcctccgccaaggtcgccgaccgcatcgtgcgcctcctcgccatcgacccggacggcgcgcgccgcgaggtggtcggcctgtccggccagaccgtcctccgcgcgctcgccaacgcgggcctcatcgagccggagtcccaccgcctcgaggagatcgacgcctgctccgccgagtgcgaggtccacatcgcgcaggagtggctcgacaagctcccccctccttcctacgaggagcgctacgtcctcacccgcgcgtcccggaaccgggagctcaacaagcacgcgcggctcgggtgccaggtcgtgctcacaccggagctccaggggatggtcgtcgccgttccggagcccaagccatgggacatcccgtaattgcgagccgccgctgcgatggtgatgtgagacttcctttcccccaccgtctccctcggcgggtgcgttcgtgccgcgccaacgctttttttatgttatggattcgatgaaagaataatgatttgatgggcaaaactttagtgctgatgtttaaacttttgtttactttgaatgtggtaacatgtggatgatgtaatgtggaatcccttgaaattgcctcggttcagttcaattgatgaatggtgttggagccagagttaagattcatcctgtgcatttccatttgatttttactgctagtatatgactgcatgttgttactgattataatcaacttgctagaagggtaatcatgtctttaatttagttacttgtaatgtgaagaatgccttttggctgttgcaactcaatgctaactactccctccgtttcacaatgtaagtcatgtttagcatttcccacattcatattgatgctaatgtatagctagattcattagcatcaatatgaatgtgggaaatgctaaaatgacttacattgtgaaacggaggaagtaagtagtagatggagagtttgacacagtggcagagcgccttgttttttttgtttaattttggatttgggaggatggagtatataaggtgaatgggttgtttctgtttcatctaggatttgggaggatggagtatataggtgaatggattataggagtgctgatgttttgaggtatcaaatcataggaaaaagaagaagcttgctggcgcatcaactggtactgaagtaacataagcatgctatcgtgaataattatttcactgttggtatgctcccatgtttcttatgttcatgaattggttgtttatttgcaaaattagaatataacctagaagaaggctagctgtaatggtcagaattctgtcactgaccttggtgctgtactgctgttgcatttgtgatgataatgctactggtatacttgatgggaacacgagtaaagaagtttgagaaagagttgatcttccgttgagtgactcagaaatcaaaattttgcagcaactgaggtagaatcgttcctattgagtattaacaacaatcatggagtattaacaacaatcatggatcacacgttgggcactttccagaatttatcgtagcagctaatcccagatgatccacatttgcctgacaatatttataccagcctccttagacttgtttatttttcacgtggtttggccaggttattgcttgcctgggggaagcataagcagttcactcatatactgaaaattcggagttagtgctacacagtatttttcatacttcagaactttcagatatctgaaatggaatttggaattgctgcacaatactgatcagacttttagaacttcaaatagttggaatgctacaagcttatgtaacttttcaggctcagaactacagatgaacatgttgcagtttgtcttgctctggtgcaaaacagtcgtattatcgtttttcacacggcactgttgactgtctgaaaggtgaagaaggcataggaaatgtggcagttagtgtcagatttacaagatgacaagagatggtttacgttaatgctttatgtgcgctggttccttgatcatttttcacgtaatgcaacctaaggtctggtttactcttggcacattaacgtccagattcttcatggttgatagtccaaacaatgccaatcactgctaaagacgtttgcaactaagcgccacactaccaaaatcaatgcagaagatagaacaaagcagctctaccaaaatcaatagttcaatacatgcttctggaacaaagcaacagagcaactccaccgaaatcaagtactactacaaaagatgggaacaaggcaaatctaccgaaaccaatgtcaataatagagaagagaagatggaacaggaaaaccacaaaaagaaggggtcaacacagaggatggaaccataatcaaacaggtgatggaacaacacagctctaccaaaatcaatacagaagatgaagcaggaaaaccaaaccaaaagaaagatcagtacagaagatggaaaaagaaagccaaaaggtggaacaggaaaaccgaaagaagcaagctgagccaggaccaggagggtcaatagctcaaggtggataaccaaacaaaacttccaaataacactatagattggatatttaacgaaaaacatgacaccaataacaaaactagataactgcggacaaagcctacagcaaaaccatgaggcagaaacagacatgttcaccaagatctattgtttaaaatgactacaaaattcacactgcacctgcagcgtcacataatttgcgaccgaagaattattaaaaaagcaacagctacagtttgaatgacaagagtaaccaatgtaaggtaaaatgtctaaatgaaggtgatgtctttcagaaagttcagtgctgagttgcagctttgcagctacctgccgtctaccaattttcaggtgtttacttcagtaatcttgcgtcaggtgtgctccctgttggcatcggccttcttaagaagctcagccagcaggttggcagctgcagactcccgtgcatcacgagggtttgtctttggatcgccaaatgtcatttggctgaactccaggcatgcaatatgtacattggccacgtacatgcctgacaagataggaaaaccttgtaaaagaagtgcttgacatgatgtgcaatgcaacggcttaagaacaataaagatagggagggagagagaggttgacagttgggcaaacagccatttctgatcatcgctaactggagactagaaaattattaccaagtgattgcaaggctaaataactgatctacaatacggatcacgacatcaacagaatgtgcaatatcgtaacaaatgcaaggaaaaagttcagtttttgggttga

SEQ ID NO: 69157 - DNA, 1560 bp, Oryza sativa
atatgtattcagcccgtcaatctgtataaaagagctttatggctgaacgcctctttagttgacatgtgctacctaaattatttacaaattttggatagggctgttgaaaagaatttctccaagaaagctatttgtttcttccgtttcttcttgagattgtacctccaatctaacaaattgatgttaaccaagtcccgcagcaatgcgcggggcatcctctagttgtaaagagggctgaggccaaaatttatgctagaacaatactccctcattcccaaattgatcatataagagaattcaacattcaccccgttcctattttaacactttaatagcacccaaagttcaccttgttcccatttttaacacttccgtcaattctcggttatttttcgtccgccttaatcgctattgacccagccacgtacactatatgatgtttctacccctcacaagtacaagtaggatgcatgataatgaggggtagaaacgtcatattatgtgcgtggctgggtaaatagcgatcaaggtgtacggaaaagatcgagaattaacggaagtgttaaaaatgggaatgtggtgaattttgggtaatattaaagtgaaccggtatctttcggtgctataaaacaaaaaaaatgtgaacttttgatactatataaccaattttgcctaaatattagtggtaggggtggtgcggcatattggataccaccaccactaagactgagttctttccccaactttcgcaactcacctcttttgttttctgtgaacacgcttttcaaactgctaaatggtgtgtttttttaaaaaagtttctatatgttagttgctttagaaaaatcatattaatctattttttaaaaaataataagtacttaattaatcataagaaaatgcattgctccattttacttgcacaggagatgagttctcaacatcacctcccgaacacagcctaacattttaaatatgtagtgaagtctttaaaaatatctaggttaaaaaatggtcatatgatatttatctccgtcatcagagtaaaacttttatactcatatagttgaatatgaatttgggagtaaaaagttattcacggtgactttataggcgtttaataaatattgtctgcaatatatttgttctagaataagtttatttttaaagtaatcattgcattagagtttgtgaaagtagaagaaattgtgttggacaaagataaagtgagaaataattatattgtgattcgataaggtatgagtgttttttttattgggacgtgtgggatgtgtgaaaaacgaaaattttttgggacagatgtaatactactagtgggttgttcaattcgttgaaatgacgaaacttgaatgctttacactagctcgtcgatgaaacggctgtacgctaaaatcacggcaaataagatttggaaacgagtttggatgggaagagagacatatggcatggctttcttccccaatccaaaaaaagttccaaactcaacaaaccgggaaacaaaacgaaacaaaaggggtacagtacaccctgctgcccacg

SEQ ID NO: 69158 - DNA, 1692 bp, Oryza sativa
ttgtttcgactgtttcttccattagtagtgggcatttttttttgatagtagagcttggtcgtcttcactaattgattttattaatgccgctactgttctcaactctcaatccagcatttgcttgctggctagtatgaactatggtctgttctatctgttattctatcagtacaatttgcactgtcagtgcttgagagttgagtaaaaattgttgcttattgattggacggggttacaagtttttattaaaagtaaacacaacctttcttgaaggtttcgaactgctaactttgcaaccaatcttctgacttgtaatgttgtctcagtactcatcttttgtgctttgaagaatacatcagggttttacactttgttccttggaattggaaaaaaggtgaatccttttgctttgcaatgtactaactgaccaacatgctagttcttcagtttgcggaatgttcctagggagtgtgtttggcatgtcatggaatgtgagctatttacaactcgtgtaatccacattaggcatcatttacgttaagctgcctttacatgatgttagctctgtctgtgtgcatgttctcctttctacaatgtttgcacacatgttctgtatattaacttttgacctcatatgtggtgttgagatgtaatattcaagcatacagctgttaacaatatatcagacatatttaaactttgaagagatttatctagcaaatgcacaaaaggtgttttaccatttcccatagtcttgattgctgaatataattattgcaccatatatagtaacacgattattttattttgtatttgttctatgctaaatattttttcgttacattcaacctcagaattcaggtggctttggtaggcatattgcagattcatcaacgaatcatcagaagttaaatcaagcaaggaattgtacagcacaacctttttctcctggaagttacagaagctcagttggggtatgtttgtatatattcttatctgctgtgatccatattcttatctgctgtgatcctcttggctgctttaatattttggtttgtgggcatataacaaaatcttatggtactatatggtaatgtgtgttagtaggggtaagattttctatcttgtgattctgttgcgtttttcattacacatgtttgtgtctgatggagaagttttgggagtgtaacagtatgctttatcaagacaagtcattgagtagcctagcagtctaagctaatgcttctcgactaaaaataatcatgaatgattgatagtaattaaataatacatttgtgcatcgttttgtctgctcattctttatttagataaacagaagtatgaatttatttgctaggaaaaagaaagaacaatgaagtcagtcccatagtattttgcctgctgtctattgtagataacttgaaacttctctatatttcttgatgcaactaaatatgtttcccagatgtaacaaccagcacaacaagcacattctcaaaagaatgtttcttttttcttgtattttacaggattccagtataaatcaagcgatcagtccagctcgctctttggatatcaagggtagattcaggggggctgattataaccttaagacatcaacagaactcttgaaggttctaaatcgaatctggagcctggaagaacaacatacagctgatatgtcagcgatta

SEQ ID NO: 69159 - DNA, 3094 bp, Oryza sativa
tatttcgtcaaaaaatatgattgatggctgattcttctgagcttcctcaaacagtagcttgagctgcctttcagcctctccaacccacttactaagaacatcagctccttttctcatataaaagctaaccttctgaccagctttagaggcagcacacgctaaggcacgagcaatcaatgtcttccctgtaccaggagggccacagagaagaacacccctaggaggagtaatgtgatagtttgcaaaaaaatctggataaagcaaagggaagaaaaccatttccttcaatgcatcaatgtaatcggacagcccccctatatcattaaaactcacactcccgtcaacctggagaggctgaatatcagctcctcccttggaacttggtccagcagtttggatccctggcataagtgaagaagtactcactgtgttgtcaccctgatgaccccaaccggatgctccaacattcagaccccatgctcctggacaatgcatatccaatccacctaaaaaccacggcatacctcctctcccaccacgcatccatggcatggatggaccttcatctggctcatccacaagaagagaatcatctgaatcatctggcaatgagaatcgagggcgcttatgcatgcgtgaaccaccctttttcaaatatttgctgttctttggaccaattccatgtactagtactctacggggtgattgtgttctgtgcttcccttccttccgtggggagggtctacgaacttctgaacgatccctgagatcatatctcctcctcccttcttgttcttcctcaccatcttcatcatctccatccgcttcagcttcatcacctccatcaacttcctcctcattgccatcctcttcgatatcattaccattttccctcctatcttgtgcaggctgttcttcagagctttcctggtcatcctcagattcttggtatggatgaagtctttgtcctcggatagatcttctaggccgtaaaccctcacggcgaggaatggagctagagttggacagcttcttgcgctttggcctagctgacacttcgtcatccactttattctttgaagatcgatatctgggcctctgaaaatttcaagagaagaggtgagcaggtaaaaacaataataagcaaactttgcatgtactgtgcactagtctctgaaactccacaaactcaccataagatcatcatcttccatactagaactatcggtgtcatagtcctccagatttacagacattcttcgctttcgtgttgaacgacgtagatttgctgcaatagactacaaaaagaactattataataaagccatatgagaataaacaaaggaactcttacgaaggaaaggcaatacagttaaaatttgcaggaaatagatttttcataaaggagcatgatttgtatcaacttgaaaccgagcaataacaatctaacaagggtcaaagctccatatttaagcaatcatgctttctggttctccaaatattcaacggaaatctatggtcatggatacaaggatgggtgcagcattcataaaagaaaataatgttctgtagataaaggtgctagatgagttatataaatatcaaccattgccttaccaactgtcatttgttaaatgcttggtaagaaaaggctcctgtaagaacatttttaaacttagagcgtctactaaatctacagcaacaaaaaatacataacccactttagaactttgctgtaacattacaatgatggaaatgtggtcacctctttgattgaacaatgaaattactattttctaaaagtagcaacagctaatgctcttagtaaaaatgttgttttataaaaagggctgaagcagaacaagaaatttgattaggaaggaagttaattcaagtaggccatgcaaatgcgcaagctatccagtttatttcagaggcaatattgaattgaacttgaacatccatatagttatatacagataaatgaacaaaaaatatagcaaagataggacgattttgaccaaatacagcaacggcccaacaaattcaaccaagttactaacataacaccatcaaagtcaacagtaatgctgaactaagcacaacagcctccgtactttatatcacaaatatttaacagttacaaaatggaagtctgatttacttacaccaaacactaacaataataccaagcaaatccaatatcactctatcaaccctctcaattatctcaagtgcactcttcaatgcaatgaaagaccaagaccaccactacctccatcagcttgacaacaaattaaataaagtggcatgaacacacacataatatggaaacaaagttcacaggctcattaaacaaagaatgacaagcatgcttacatcagcaggcggtgccctggcagctgacttgcgaagcagcttcttggcaatctgtgatgcagccgctctcttcttagacttcatcttcttgcgtatggctggattgtagtacatataattgcgaccgaagtacttgggccgcttacgcagccggtcactagtcctcactggtgtcaccgatgcatcccccttcccttccatccccaccatcgctcccacctcacgtcctcatccacaccacgccggccattgctccctaagtcaatacaggtacaccaatagcccgtcaattttagtaaaatccccaaaccctagcccccaaatccaccaagttcaacaatcacggataagatgtaacgatggcaaatttcgcactcgcacattgcgaaatggaacccgctcctcattccccacacattaaatccccagaaaatgggttgaaaatgacaaaacgatggaagaaaaaaaatccgaatccacgccgccaagcaccgatcagacagccacgacccctcgaaacccacccaccacgaacgaaaccacacacccccactccacaaaacccgaactaaaaccctccgaaatggacggaagcgaagcgcgggggagccccggaaaacccggggggagggcggccgcgggggtttctaacctcgaaggattcgatcggcggggagcggggagcccgcgcctagcccccgcccggattcggcga

SEQ ID NO: 69160 - DNA, 2839 bp, Oryza sativa
cctcgtgtaccgttggagaaaacaggtagtacgtcgtttcttgtctctctgaaacctagcactctctggaattcaaaaagaaggcattatcttcgaacaaaagtcattctctaagacccttctatgaaaaggcagaacattttttccttttaaaaacaagatgagaaaaaaattaattgtcgctatcgatattcctacctttatatttttaatcctataaaataaatgtgaattgtaacggtcaccatctcgacccattcacaactatatctaatagagaaaaagagttttgtaagtatataccttcaggtgattctgaaactaatccttcaattccgttatataagacgcaaatgctttggacacaaagaccaataaaagtttgtgtgactaccattctacgcgcaactggtttgcttttcctaacgacgtctcacttcgccagtgtgacacacgtgtgcaacgcttaccacatccacgtgcttcgttcgcccttgcatgttgagttctatagacattgataggccatgcagccatgcgcacatcccttgaatggatgcggaatgagaattatatgattgcttaccacctattatgttgggacttttgaaaaaaaaatattacatcttgtataataggatatatggagtaacagaagaaaaggaaagaggatttttcatctcaaaagtttgttcaaatcgaattaagaaattattaaccttacaatataaatcaactataggccatgcttacggaattggggattcaagcagaagttgatgaccagtagtttattatattggtagttatgagttttagaatctttagtaaaaatttaactgttttaaggggtagagattatagaaatagttaccattgtttgatgctatcgagcaacgcacagtcgttatgaatataacttagaagcatatgccatctatattttaacggagcacggcatcttccaccatgataactttacaacgtactaatcgttgtttcttttaaggacacaagagtactattccacgcccaaaatccacccaacaatattttatagccagtactaattattactccatccattccgttttaagatgtttgacgtacgtcgtaaaaaaatagtattttttttgacacaatactattccacacccagaaatattttttgcacgctttcatgccctatataaccgcccaaattatgcttttgacacaatactattccacagccagaaatatttattttttgcacgctttcacgccctatataacagcccaaattccgcgagtgacgagtgcgcaatgtgacaaggcggctgaggccagacaggacaaccaccaaactgccccggttgttgtacgattgtccttgttccctccgaaaccggcactgcgttccagtttcttttggtctttggaaacatcctagttcactggggagctagagaacaagtagcaacagacacagaggtacaagagttttttgtcctgtaactctacatatagaagcataaatgacacagaaagttgcaaatgtgcagcatgctggattggtagggataaacagagtcggttgcagaaattgacacattgatctctcatgtttccaggcccaaaattgacttaatatttcagcgatttagattttggtggatcagctatacatgtatgccgaaaccatgaaaagtactagagcactagtttctgatgattgttgcttgagagtgtgaaggtgatacaatgattgacagcaatttgtgttaatcatcatagagacaggaaagcacatgggtgcaatttaagtcttgttctgctaactaggcatccatgccacttggtgctttgggttgaatcagtcatcattgttttggtcattttcgtcatgatgattgtcaccatagtcaacccacgggagcagtgattccaggaaaaccaacgcaggattgcgccctgcaacttcacggggggcacggggtctgacctcaatccccagttcttgttcagctggcggcatctcatgtgccattccaggagcaaccatgaatggccgcaattcttcaggggggagtgatggtgttgtgtcggagaagtctgaaacaagaagatgagagtacctgcaaaataagaaacaacttctcaaaactcaaaaacatgttataactccaaagattaacagataccaaaaattgggatataactacaggcgtaggtggattttgcttagtgtcatgtataaatatttaagtccaccaaagcaatatgtgaaataaactgcatatctgtagtgtttgtactccctcttgttttttttgtttgacgttggttagttcattttttatctaaccaacatcatatataaaaggaaagaggtaatattatatatcactatcgtacatgctaagactacagatccaacattgccaacaaattaagaatggagtcagtaaggtagacggctaaaccatatattgttatgtgaacgttcagaccaagataaaatttacaactcaaattgcaacaaagaaaaggtattggtagtcagtggaaagcaatatcataactaaataagccttcagttctgggcaacaaaaatcatattgaagtgctctccttaaaataaaaagggaagatgtaatcgaagagcagacagaacattgacactacgcaaaaaaatttggagcaacttactcattcttatctgaagagaatgcttcttttctaacacatgcccagtcctgggcctctctgttatcctgttttagtgattcaatcaccaaaagagcagcatctttgagtaaattctgcagttctgggaacctccacatgatgtaatggc

SEQ ID NO: 69161 - DNA, 967 bp, Oryza sativa
ctggcggcgacacggggaggggaggcctcctcctcctcctcccgctcgacctctgcggcggcggcggcggcggcagggtcctgcggggcggtctcccgctcctggagcactcgccggagcagcctggcggacatggcggcggcggcggagcacgccggcgaggacgagatggcgcgagggttagggtttgggcgggttgcggtgcggtgcggtgcgacgcgatgcgatgggatgggatgcgggctgcgaggcgtgaccgagtgagacgattttgagatggagagttggagtcggagacgaggacgatgacgatgactcgatgaggaggagaatttttttgcctttcccggattcgggactcgggaggggttgaaatgtgattttacgtaaaaggagaggatgcgttcggaaatttcgcgaagatgttttacagcatcatcggaattcagagccacccaaaaattggatcccctaattttcttcttgggagtatgtaaacagtaaagtaattaggatgtagtagtacaagtacctttcttgtatcctaccccctccatttcataatgtaggattttctagcattacttatatttttatatactccatccgtttcgaaatgtttgacaccgttgacttttttaaacatgtttgaccgttcgtcttattcaaaaaatttaagtaattattaattattttcctatcatttgattcattattaaatatatttttatgtaggcagtatctttcttgtatcttaccccctccatttcataatgtaggattttctagcattacttatatttttatatactccctccgtttcgaaatgtttgacaccgttgattttttagcgcatgtttgaccgttcgtcttattcaaaaacttttgtgaaatatgtaaaattatatgcctacataaaaatatatttaataataaatcaaatgataggaaaataattaataattac

SEQ ID NO: 69162 - DNA, 1232 bp, Oryza sativa
ccatccctcttgtttatagacctcgacttttgatgtgcggtggtgtgagtgttggactggtagggcccctcatcctcttttacatagatatatcaccattttgtgtcctttcatatcattaatgtattttacgcttagcaggatcatgttgggccagctgttttgcacgaacttgagaaattttctgttcactccttggggttgccgtctcttctgtctgatccaagtgcaaagacacctgaagaagctcttgtgcacatttttggggaagctaggagaacaaccccgtcaatactgtacttgcctcagtttcatctttggtgggatacggttagtaagctccaagctgtatataatttagtgttgaaatgattgttggtaaatattgaataattgattatattcttcatctttgatgtaacaggcacatgaacagcttagggctgtgctattgactttgttgaatgagctgccatccaaccttccagttttgttgctaggaacctcgtcagtggcctttggtgaccttgaagaagagtgtgcttccatattttcttctcgtaatgtgtaagttcctggtcagatgctgttttgcttgacttggttcttctcaattgccaaggtctaaattatcctccaatattggtcttgtctttcattgagaaaatctgtttgtttgatagatatgaagtggatcaaccaagtgatgatgatagaatgagatacctgcatgcactgtttgagtcattgctctcatttcaaatggaagagtctaggagtaagtctaaagaccagaagtcttctgttgatcttcccaaagcaccaaaggaagtggatggtcccaaactttcagagctaaaagcgaaggcagaagccgaacaacatgctgttcgacggatgagaatgtgtcttcgagatatttgtaaccggtctgcaattcactcctttgttgagttccatatatgttcaaattttgtttctctgttctcaccattcattgctgttagcactgtggttagtttttacagttctgctaaagaacagtatagtttcatttatattctacaaaaacaccgcctagtttacacccatgaccatttttagcctatgcctatctatgctattcccgtctcagctccatatttattcagttgaaggaatgttccagatggggatttggttgcgttctaaaaatcaggagtatgcatttgcttgataaagcttgcatgcct

SEQ ID NO: 69163 - DNA, 1063 bp, Oryza sativa
  unsure (1)..(1063): unsure at all n locations
atgattatgttgggaaaactttaaaaaccttatgtggtgatcaaactgggatatatagagtactgagaaatttatttggaatattgtctagattcgtatagataggatgtgttgattttatttacttttttcaaccatgtatatatttttatactgtactccctccatccacaaaagttacgcatattatttttgtcaccaagacctaggagaaattaaattattttggatgttacaaaatcaaggagtgaatgcaagcatgcaaccaatgaatatttagatgactctttgggttctcgtcaaacatttaatttatctcttcatttaagtcttaaatgcataaagactacgaatagcaataatttatttagaaaaacttaaatgtaaaatatgtctaacttttatggatggatggagtatgatagtttgatagagctatacatgtataagagaaagtataatatacgcttgtactgcctcttgtataagaggagtacgagcgagtatatattttagtttgtttgaatcttcaacattttagttgcacgtaaaataagataagtcattgacataaataattgagtatttgtcattacaaaatttagaaatgagtttattcaatttttgaaagaaacttttatataaaaagctttttagaaaaacatactctctctccgtccgaaaataagtacgtacactgtccaaaaataagcaccaaaactttggggcgaagagagagtatcatcatttaatactttaaaaaacataacgaggaaaatatttttttcagttgaaaaaagaacgcagacttattagctatggcattctgtttctgtctgttagggaaaaaaaaaaagaagaagaaatgaaaacagggcaactggcaaaaattcagggactaaagagcaaatccgacgctctacaacttgtacaggggcctaacagcaaaaatcgcacanaaacgaaaaaacaaaggaagccgtttgaaagaatcaacgacccgcgcacacggcggcgcggcgcataatccccacaccaaaagaatactaccttcacccatcgc

SEQ ID NO: 69164 - DNA, 4038 bp, Oryza sativa
  unsure (1)..(4038): unsure at all n locations
tatctctaatctgattcctacgttttttctgtagtccaatcaaacggttattgctgtgtttttttctgtgttttacaatacttagatttgaacatgtattatatcacctatgtatttcctattcctcggtcttttttcattcccgctattcaaggaaccctaaagttgctgtcagcccgtgacatccctgtgatttccaggatgtgcatttttccgatgcaaataactcgtctttgatagttagcttgatagattatcatccacacatccaaaacttaaattcccagacgttactttattttagagagttatttttggtgtttactcattgtatgttattttctggattgacttttaaatcactactgatattaagttttctggtaacttttctggattgacttttaaatcattactgatattaaatttttagaaaaaaatatttatttataagtgtttaggtggtatggatggaaggaacgagaccctaaccaaatgcaatactgtacagtttgttgttgggagatcctcgtgagttctaggatccacttttccgtcgtatttttcttcttcctgacgcgaattataacaacacgagagtacagtcgcccatattcatcccatcgctaccgtccgagagctttctcgctcggctgacggcgaccgccggcgccggtgtcgccacgcgccggcgcctccgcccgcttgctcgcacgcgggccggtcaagaggcccacgccgcgtaggcctagctagctagctgtatcccgccgccagcgcgcgcgcgagagagagaatagctaatacctcgctccccaatactattttgatcaacgatatctataaaactaagatgttttaaataaaaaagagctatatattatgatatattatttaataataaatctggtagcattaattttatattattgatctttttattttcttatgctattaatagtcaaagttacaaatatttgacttgacactatactaaaaatatatattttttttggacggaggggtagtaattaagaacatactccctccatcatataaaaaacgaatctagaaccgaatgtgacgtattctttagtatgtctagattcgtagtatatgtcaaatctaacagtgaagcaagcaaaaaaaaatgtgtataaacatgacctgtgttacaactagagaaacaaaaattaaatgaaaatcatgcagcacctgtgcagtgaaaaaaattgttatttttttcttcataaatagattgaatttagacttatatacaacacacacacatactcgccatagatatacaaaatactttccgggttggaaaacactcccctagaccacggaagcttcaaccccacccccacctcgcgcgagacgtcagcgacgacgtccgccgcgcgccgctaccgctacgtcctagcgctagcgcggcagctcgtgtcgcggtggaaaacgcccacttcgccaccgctcgcgcgcgcacgcccacgccgctcctcccctcccctcccccgcctccgtataaagccgcgcccgcgccgcgcacgccggccggccaccgaggacgagctagagcgcgcgcgccgccgcgaaacattagctatagctagctagatatagccggccggcgatcgaggagatcgatcgatcgaacgccgccgcgcgcgcgcggtcatgacgccggcgagggtggtgttcatctgctgcgttgttctgctcgccgccgccgccgcggcggcgtcgtcgtcgacggcggcggggatcaccagggccgacttcccgccggagttcatcttcggcgccggctcctccgcttatcaggtagacacgttttttttcccttttttagcgcgaactcaaccaccaagcaaacctgatcactgccgatgcatgcacagtgcacacacatctatctcttgctctacaaatcatgcaaaaaagaaggaaaaaacaaaactgtaactagatacaaatcggatggagttgaatctgttgcacaaattaattcgaaacattaattatatttctcgcatcatcgatttgctcgttagaatatcagagagtacaaaattttactgtcaacgcctgtccaagactgcaacctgttcgtcggtatgtccaaccgccacactatctcgttcgctattcctgtccatgtgttccccctgactaacacgaaccatacaaaataacaatataaaattcgtcgattcaacgagcacattcgttgtgccctttgttcaattcttggataaaaacagacggatgaaattcagagtgacttttttgttaacctctcgctttcctactgaactttaatcacagaagtaggctttgcttctttcttcgtttaacctttgtgctaaccagtgtcactctctttatgacttgttgtttcacgttagtactctggtaatatgcaatatatgtcggtatgcaagaaattcattgcatcgacgcaacatttcagtacttgttccgtctgtggttaactgttcagctgttctttagctttgttttgtacttaagagagtacaaattgtgaactggtgatacactgatactaaaactcctaaaagtcccggttttgcttgcttatgtcatggctagtccaaattcagccatcataataaccttttgcacaaagcaagggcataactccacaagagtcagtgtgcctgacgagccgattaattatacctggtacaatttatattcaagtattgttcgataggaaatatgtacttattaggcactgcaaattggtaggagaattattgaaagctgtaagatattgtcttctacaccaacttggctccgagaaacataagaaaagccggcgctgcataagtcaatttccccaagtactagtccatgcatctggcttagtttaatctgctagccgacaccttgttcttattgtttttctcgaaaaaagaattgctagctcttctggaatcggtgccctattttccatttttactgatttcatgttgcgaattgtgatgattccttggtcctttggtcaccgctaacctgcaagcagaaacaatcaaacaacgctcaccgaatacgactctcggcgattggtggcctctagtgcacaatcttgctttgtttctgacgaagatgtgtttgtttccatcgtcttccactaggaacaaaaaaccatacatgtcgttttctttccggtgtcacttgaatggtcttttctgcatcttccgtttggcatcttgcctttagagagagtgcataagtgtatcttgctaagtacaagtcgcagtggaggcctgacatttggcagattcagagaaatgcatggcctgaaacctatgttgttagaacagggaaaagttgtggtgaggtgagatcagtagatgttactatcgttgctttcagctgagttggtggtaaggaattggggaaaatgcattttgccaaataagtcagatgtgtactttgatttgattctctgagggaaaattagtaatcgcactgcattagtagtcatgcagcaatttcagtatattggttacaggtagaaaataattagcatcatagtaccctcattgataaggttgtgaacggttcaaaatggtgcatcataagaagttatgctactcgacatgttgatcaagatttggagtgttgtatagcatattgtactgacctgaacattcacaaaattgcttaggttgaaggtgcatttgcagaggatggaagaaagcctagtatctgggacacgttttcgcactcaggttagtttggtctaagatttacttgtgaaaattgagtctgtgtctacgataaatttcaaattcttaaaattaacgagaactttctaattctattttccacaggctattctgttgatggagcaaccggtgatgtaactgcagatcagtatcataagtacaaggcaagttcttgggacagttctggttaaggttttttttttcagattacgagcatgtcaatttctgaannnnnnnnnnnnnnnnnnnnnnnnnnnnnnnnnnnnnnnnnnnnnnn

SEQ ID NO: 69165 - DNA, 33053 bp, Oryza sativa
  unsure (1)..(33053): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaatctctcatttcatccaactatacaagttcaagagtttacaagagacccagacgatcaagatgtcgtgcggtggaagttgcaactgcggttcctgcggatgcggcggtggctgcgggtacgttcgatcttcagctattgattctgaatatgtttgctatgtatttgtcaacataaactgtcataagctttgatgattttgatgtactttccatcatagaagaatactatgttagccccaatagttctgcttacaattgatttgaagttatattcagttgaagccatccataagacaaaaaaaaagttgtcatttctagttactgaattttgcgttctgttttttgttttcttggttcagaaagatgtaccctgacctggctgagaagatcaccaccaccaccactactgcaaccactgtcctaggtgttgcacctgagaaggggtatgatatctctgaatcttttcactgataaaaaacttcactgaagtaaaaaaaatcctacctgagattcagacatgaacaatatgctgtgatctacatctttccatgcctgaaactgttcgtttctgaatttgccttgttgatttgcaggcactctgagggggttggcaaggcagctgaatctggcgaggctgcccatggctgcagctgtggctccagctgcaggtgcaacccctgcaactgctaaggccaaggcgatctatgactgaattgccaatgcaccagcctgtctacatgatgaataaataaagagtccatccagtgtgatggctcatgcctgtgtgagtgtgactgaatccatcagtgtgtgtgtgtgtttgtgtcaaccatgtgtgaatcaggtgtcaaaaatcgtggctggaaatccatgtggtttctagctttatgtaaatgttgtttgtgaaatataaatattgttttgtgtatgtgaattttactctctcatttttctcttgcactcaccattctattatagtaatttttttaagactgtccatatatttgtcgataaatgtttgtttgatgtaaatataatacagtctgtttattccattatctaaaaaagaaaataatacagtcatattgtaattatattgtaactagcatgtaactataatataatttatatgcaacttttaaaaatcccacaattatatacagtaatacactattccacgaagtggaggtcatatgaccaaatcgcttcagctatatgcatgccatgatcttttttcttcctcgctcgcacaaatcatgaagcaaatcaaacgatttaatatcatacgaaagttacaaccaagttacattgtagttaaatgtaagctacaattatactacatttacatttgacaaaatttttagaagaaaatttgtcaacaaatatatactagaatcgttttttttatctgcaagaattcattcgagttgtacacaaacttgtgggattccatcccaaatgggcctcacacttctcatactgggcttaatttcgaagcccatgtggcccggcccaattaaaacaagcccattacatcaataaaaagaaaataaaaaggaatttcccgaggttttagatctcgcttcctctcctctcttcctccaaaaccctagccttcctcctcctctcccggcggcggcggcggcgatggacaagagcatgctcggcgacctcgacggtctcccggaggaggacaagatgcgcatggcggccatggtcgaccagctccagatccgcgataggtccacccgcgccccctcactacatgttaattaacgaatgaattctttcgattgcggctgctctgcttgcatgtgggattcgttcggcggtgcctccttagtttttttttgcggcctcgatggatgggagtgatcgggatggccgatttgcggctactttcttgtgcgcgcgattatactatacggtgcgaggtgaggtttgtgttgtgcgtgcggaaaattctgacagatttgtgtgatcttggtgaacttacacactccaaatccacggggatttagttttaggattctacaatttttcagctgtgcggttagagattgattgtagtgaggattatgtatgttggttattactgtagtgcggctgaaagatgcatccttgtgtgttcggtcccagttttcttgcttgggtttggtatttgcccgtctgattgtagtatcagctaaggatgcttttcatttacttgcatatttctcaaattagccatggtgatcataatctctaataggaaagtatggagtattatatactgatgcctagttgctgttgtgaccaagtgtattctgcgagtagaagcactttattttgggctggtttggcagtattcatttgatggctagttctacacctatgtctcttctgatagctaagttctgttcatggtctgtatgctgtggccagaaatgtaaatgtagatgttatttttcaatgttttgttgttgttgcagagcttgcgaaatctatgttgaagtctattgatgggatggttccattaagttcatgtacatgataactaaccacataggttggaacttggaatattgtctttttagctggtttgtcaccatgcatgacataggcaaaaccaatggagtcaataaacaggatggttctgaagatagagtacaataaaatagctcagtaaaacaatcttctttagtatgtttcatgtgttctttgatgctttttcaatcagctacctcatcactgtgcaatcttaccgttgctttctcccgtgttcatgaaagttatgtcattcattcaatcattcttgatgtgtaaattctgatcaactctttgatttgcctttcacttgtcaaattacaactgaaagatgctgacttttttgggttgtcaacgcacagtttgagaatgtacaactccctcgtggaacgatgcttcacagactgcgtggacactttccgccggaagaccctcgacaagcaagaggaatcctgcgtccgccgctgcgctgagaagttcctgaagcactccatgagggttggcatgagatttgctgagcttaaccagggtgttgccacacctgactaatcaattgggtttggtttctaacgttggcaattttgtcagcataaaatctgtaatccttaaatatttgagtacttgaggatacgagagacatcatgttttcctcttaaaccgatgggcgactgctgggtatcaagttgaataaatttatattaaattcccatattggtagctattgagaagagccatatttctgaatatttttatggtatatcgtgtaatctaattctgttatgtctaatttcatatcctgaggttacaggaaccttaagtacatttttttaccattgctgtgttcaatggtcttgattcacatataatagtatccaccatctgtaaaggcaccttttcccttgccctctctctagacatctgctttgattgagagcaaagaatataggaccatgcacatgaactcatcatgccatcagcaccaccaaactgcaagatctctcactgttctttctctacaaattattgatgtatcagctatcatgtcatgtcctttttcatcagtattacaatattggctagtgaattgctgcacatgtaacctccttgtagagcacaaccgctttgccaccatacttgcaatcctccatcaaccctcttcaccttgtcaatgaacttagacctgcttcagtatagtactaaccacaacacagttgaaacgcttctgatcgtcagatcgcgaaatcgacgtcccagattgagctacccaaccctaatcattggatgcttccaatgtgtttggacatgatcaccttctccctttggcatctcatggtttggagcattggtcattggcagtgtgcacgccagtgttggcaggttggtcaccttctgcccactacctgctgtttcttctccaatctggttgtgcaattgttctacatgtgatggcattgtgtggtgatgaagtagcaaagacagattggaattttgtggcattgtcggtggcatgacattgtgagcctgcttgctctgaaatgtgtggttttttcacaagtgtcatcaatgcatacatcattgtgtaagtagttagtaatgtttggcatcaagattggagtgatgcttcctggcccttttgagcttgcctgtctgaactttctgtacttcggattactgatttggttcttgatctgttcttttttcctctgccttttggatggacaggttgtcattcttgatgcttggatctgtgtttccaaagcatcaatggccctcactgctggactccagcttttgtttagatgagctgtgtatttcttttttttcgccgagctggcaaaacttgccggccaaagtatattaagaaagaaagcgagaatgtacattatttcctaacgccccaggaacagaactccaggagcagaaaagcagagaaaaagctactaaaacccctccttaaacagggccgccccaaccacagatcactctattggaatcaaccccgcagctgtccaggtctcccattcatccatgatggtcacacaaatgttgccctggaatcgacagcaagaatgacagacttcgagttttcaaccttgcaaatcacataattcacattggtaaagcaattatttatagtgaccgtagaattagaatctcatggctgtaaagtacagctcaacttgaagcaattagagagttcagttcagttcggttcaattcaacatggatgctctccccacctaaagcatctctgttggaagattcaattcataatgcacaatcagctgagcacttctgagccatgattgcacataaatttgcaaaaatttgtgtcttgagccatggcttcccacataatacaaaatactacctccgtccagagggagtaaatcagattcaagaacagagctctgacaaaattatacagctcaaatacacaagtcatcacagcatgaaaactaaacaaaaaggagtcaaaatttaaaaaaaaatgcaaagatcagtttccagttttctacctgaaaacttctaaatttatcagcttattacaagctagtataattacttgacatctgctcatgccaatgcagcaattgacaaggcataatcaaaggaatttgctcaacatctcaaccaaaaaactcacatcaagaaatcaatcaattaattaattattacacaccaaaagaaaaagaaaaagaaaaataaaagctctattcacagttcgtcacaaaagcagccgaaatgcatcaatgcattaatgcacgacgcccaccggcgccgccgccgcggcgtcggcggcggcggcgacgtcgatgctcctctgccccggcagcgcgagcatggcggtgtggtccaggaagtccttgagcttggcgacggcctcgacgacggccctgagctcgtcggcgcgggcgaagccgcgggcgccggcggtgcgcgcggcgtagacgtagaaggtgacgcagcccttgcggaacttgaacctcgccatctccggcgcgccgggcgccgcgcggatgaggcgcctcccggcgtcgccgagcgggacgacctgcggccacgcggcgtcggcggcggccttcatggcggcggactcgaagacgaacaccgcggccttggagttcctggtgccgaggcccagcgtgagggtgtgccacgcgtggtgcgccaggatggcgaagttggtcgggatgtacgccgtcgtcgtcggcgcgaacgccagcggcgcctcccgctgcctctcgtcggcgacgcggaggaggtgcgggagctcgagcggcgcggcgcggcgcacggtgagcgcgcgggtgacgagctgggcgccgaaccggagccccttcacgtcgccgcacggcctgaacagcgcgtccagcgacgtcgccggcgccgccgccgcggcgttgttcgccttggccttgccgcctttcgacttcttggacgccgccgccgcgtcatggccatggccgccgctctttgacttggacttgctcttcgccgccttatgctccgccattgtcaacgctcgccaagctctagcttcttgctcttcgaagccacgcacacacactgacacaacagagagagagagagagagaggtttaagctgatggaaggagagaggaatcagaggaagaagaagaggcttcagaggagggagcttgaagaaggtgagggtgggtcactggtcagaggagttaaaagagagcaaaaaagaattaaattaatattttttttcttcttctccttttcttttatttatgtgatgtgaggtgacatatgatttatgatattctctttatccacatcttctttttgttataatgtctgccttttatagggaatcacatttgagtgtgcactgaaaaagtattgctgacaagagatttttcttcaaactttttggttttctgaagaatctgaacttgttctgtctgcatatcatatatatcctgcatcacacttaactaataaacttgtttttctgtctgagtgtatcctgcatcaaactaatgaacttgtctatttgctttggttttaaagttatcagcagttctagtttagcacagttcctaccctacctgatcaacctaattatcaaatccatgacattgcaactggaatgtatcatatcagagattacacctaagctgttgctgcagtctctgtctctttccttttgtttatcaccctgactcctgtccatctccatcaacattaacattacattagcatcaccaaactaaatcaatcagcatgtcctgcaactgcaactctgaactgaaaaaaaaaaaaaacctgcatggcctgaactgaacatacaaattcagttactgtacccagatctgggggtatgtagattgcagattcccagtatcaggacacacacaaaaaaaaagcacatttttttcttggttccttggaagaacaagtataatactaataaagattaacttcatgagtagtataggataccaatggctgcattgcgtcgagttcatcagttcggtttcatgtgcggcaagacctgtgtccatgtgctgctgcttgcctgtaaccatgactgcatgtgagctcccatgatagcttactactaactacaggtaggatggtcacagggtctcttattaggaacagttaattaactttgccataactaaatgtgatctcgtaatttgactgtcagtggaacagttaactttgccatgattttatcagtggttctcttttagaatgcaagaagaggacctgtcggattttttctttaaaagctttgcgtgtcaatatattaaccaaaacctgagaacaaattcaactataaacagcaacctgtgaaaagcaattgttcgttttaaaaggagattttcttaaaattgagagtgtaggttcagccgagaagagttggacaattcccttttctttctttttttcctttttctttgagatgaacaagaatagtgtaattattaagttggacatcttttctgtccgtataggaaggctaagaagcacctaattctgtcagaagcccaggaaagtatcaataaaggccggcccactgatggaaagcccactcagctccaagtattaacaaagttgatttgcctgacgtgtgaattgttcactttccttttactaggacttttgatttttgaactgaacaattgagaccaaattaattaaggtgcaatgaggagtaacctttaactgaagatacagggaactgcaactgtactgcaagtacgttatgttgccccaaatataaggtattcctagctgtatgtatatgtatgaagtactcgttaattaactccaagcaatttaatgtttgatgtagcttttagacctaaaattctactgccataatgccctaactatatggtatgtgcccattattcctactttcctaatgtaccaactatcgaactgtatgttgttcttggcttgaagacatctacgtcccacccgtttttaacatataattgagttgacttttaagcatatgtttcgtttggaatttgtcttattttgtaaaaatacgttattatcatatgttttagatttttttatcaataaaggtattcggtctgaattatattttttatatttgcacaaaataatacctatgaataacaaaaatggttaaatgtgtatttaaattcaacgacgtcatgcattaaaaatcaaaatcgaaaagagtatatattgtcatctttggcacaaattgaggtgtattcctccagccatgaaacaatgatgctttggatctattttttttaaagtctttaagatacaacttaatttgataattcaattgagacatgcacaaactataaataaaatacttaacattatgaaatattttgttataataaacgtgcatgagattatgtcatttttatgactagaacctttgtcccaaatattaattatagttaaaattagcgttcgtagtatactatttagttttcttattttaattaattattaagagaacattaagtgttttctgagaataattcaaaccaacgatcgatcgatcgatcaaattaaattaacctcggtgattgaaattaatttctcccgatttcaatcttgattgctctaaggcactgtttggatcaaggactaaaactttagtccctgttatatcggatgtttggacactaattaaaaatattaaacgtagactaatgacaaaacccattccatataactctggactaattcgcgagacaaatctattgagcctaattaatccatgattaacatatgtaacgctacagttaacatgtgctaattatggatgtaatgctaattaattaggcttaaaaatttgtctcgcgaattagctctcattaatgcaattagttttgtaattagtctatgtttaatactccaaattagcgtccaaacatccgatgtgacagggactaaactttagtccatggatccaaacacaacctaagtagcattaacatataattctgcaacaacttagtacaatatatctatcaacggttttctcagccatgcattgattcataattaatctaagccctagaaatatatggaatcctgagctagccatgagcactgtgcacgcacaacactagcaagaactagctagctagccagcagctacacgatgcgccaccaccgccttgctgtcccggccgccgccgtcctcctcctcttcctcatccacgtcgtcctcgtcgccggcgacgacggatacgcgggtgcaggaggcggcgtcgtccacgccgccgtgctgccgctgccgccgcggcagctgctgcaggaggtggcggcgccggacgatcagctcctcctccggccggcggtggtgggcggcagcctcgccaccaagccgccgccgccgcgcggcgccacggggtcgctcatccccgaccggccggcgtgcccgcgcggctgcgccgcccgtgggcgtggggcggacgcctacacccggccgtgcacgtatgccaacgggtgcatgaaggggcggcggccgtgatatggtatcgcgatgcggcggcgccgcccgccgccgccggccggccgggcgccgcacgcacgcacgcatgagatgacgagatcgaccaaacaaattaatcgaataatcgtgcaaattaagctgtagctgtacaactacgtactccatgttaaagcgtgatttgatcatcagtcgactgttatatatatatatatatatatacacacacacgcgtgtgtgtgtgtttcactgtgcttcgatcgggttaattctcacttctcactgcactttgatctctcgatgcctctcgatctaccatatatatgcatgcttttttttcccctaagaaatactcactccttccctaaatgtttgacgccgttgacttttctaaacatgtttgaccgttcatcttattcaaaaacttttgtgaaatatgtaaaattatatgtatacataaaagtatatttaacaatgaatcaaatgataggtaaataattaataattacttaaaatttttgaataagacgaacggtaaaacatgtttaaaaaaatcaacggcgtcagacatttaggaatggagggagtagtacagtgcaaaagttgacgctcacaacacttcgtatacttacccttataaacacacgtgcgtacaccttattcttatgagcacttatatccgagagattttgaaattgattaaattaccacgaccgcttatgctttgcttggcgttgtgtataataagctgaatgtgacttgggggaaattacccatttaatcccccttgagggacaacgacgatcttgtcgcttcttcaaataccatacaataattatgaaaagaaaatactcaaaacatctcataatattcatatactccctccgtcccaaaatgtttgaccgttcgttttattcaaaaaaatttaagtattttttaattcttttcctatcatttgattcattgttaaatatatttttatgtatacatatagttttatgtatttcgtaaaattttttgaataagacgaacggtcaaacatgtttaaaaaagtcaacgctgtcaaacattttgagacggagggagtagctggtgaccaaatagccgagcaaggtagccgctccatcatcttcctctcactttgccaccacacaccccgagccccctccaccactaattccttcttgccacatgtggtcgctgatatgttggtctcacttatcgcatcatctaaaattggacactatatatactatcctaagaccttaagtatattggttttgtaggttgagtgacgcgctatttctggtattgcgtatgaagggcgtaaattcaaactcggcgtcgagatgtgggccgagccgcacagttttgtgggccttgcgctaactaaattgtctgtgggctgctgggcctcttcttcgtgttgactgtgatccgagtatctgacgtgtgtccgttgcatgtgtcgtatgtgtacgtatggtgccacctggtgtagtagcggcgtttcggtgttttgcatcgtaactccatcgatcgtcgtgttgtggttgatcgatggcgatgagggatgaatcacgtcttcacgtgatcgttgtacgtatctgctggatatgtactacttttatattttaatatatgacaccgttaattttttattaacgttagactatttgtcttcttaaaaaaattatataactatcatttattttattatgacttgacttatcatcaaataatctttaagcatgatataaatatttttatatttacgtgaaaattttgaataaaaaaattatcaaatattatttaaaaattcaggcgtcatatatttagcgagtatattattcaattgcatgtctatatagataactcaatatatagttactacgtgtatagttctccgagttatatgtgtgatgatgacgacgacaacgatgcagtacggtgtattgccgctcttcgtcctcgtcgccggcgtactcattgtcgccgccggcgccgggacagctacggacgacgctgctggccgccgccactgccgcgtggtcggcgtcgacgacgacgtcgacgtggctgcggcgctgatggatcacgatcatcatccccagcggcggcggcggctggaggatgaggtggtggtggaaacggagctcccggtggtcgacggcggcggcggcggcctcgccgtccgagcaaggcgacactacggcggcggcggcggcttctcctacggctgcctcagccgggcgaggccggcgtgcccgcgcgccggcgggtgcgccgccagagggcggccctacacacggccgtgcacgtacggcaaccgctgcggccaccgccggccgtgatcgatcgatccggccgccgccgtatacgcgacacatcggtgatgatgacggtaaaccggcggtggtgcaaattaacgtatgtacttgcatttgctaatgcagtaattaattaatctactcctgttgtttaaagggcgtagtactagatctctctcccgtctaagaataaaaatcacgagttaatcttttttacggaggagggtgaaggtttaatattcagtgtggctctgcgagttctctgatcatttatgtgttaattcggtgttaattagaattgatggctaaatctatatggtttaagaccagttggtaataaagaggagttaaaggggtttgtcatattacctatcatctttttttatatgtcgaataaatttatgaatgtgtatcttagatagaaatcggagatgtaaaccatttctgagaatcaagggaactgtataattaaagcaaacattattattcgtacccactttatgcgtgatgcactgggagcaatgttctaaatctctggagagagtggatggggaggagaatagctaggatataccaattttgacgctacgatttatcggccgctaatagctacacttagctggagatagccgctataatagccgaagatagctgcacttagcggcagaaaaactgaaaaatagactcgcaaagttcagcctaaaaggccacaagcccagcccaaaactaaaccataaatcccccactccccatccatactcgtgttctcttctcccctagtccccgactcgcttccccagagtagcggtggcagtctttttggttgcgagatataaaagttgaatttaaacttgtatatttgtagagcgatatatcacatgttaatacatcttctcaatttttttaaatctttttcataactatttgagtgacatgtaaataacgaggggatatccccttgagggatcagaatagtttccgcactcactagcttttagccctaatatgctactgcactcaaggaccaaactacattcgtggcctgatggtcactaccaaagctctcctgtgtaccagtgggtggatccaaaaggcttaagatcaagcttgttaaagggagcatgtataagataatttacaatagagattctagcatgtattactattgaaagtatatgcacaattttttctagaacttatagtgacatttatttgttggtgtgtatggagtgtgcacgtgaaacttatgtgcacagcctatgttctcttctgaagataccctatggaaaaactgaagatatatgtatgagatcgtcggcctctaagaattaagataactaggtcagcttgacaacgatgacttgtgaggagtcacaatagctatgtcaatgcagtcttttttattcgctcttcgtatgggtttttatcggtttttagatgtaagatttttttatccaatttttcaagcccaagggactattcaactccctttttttttcttcttaatataaagtagaaaattccctccctcttgtggttttggaaaaaaagaagaagaagaagattgaggtaactatcgggtagccatgaatttgaagcaactatatgagtggttgatatttgtggcttagttttagcactaaagtgccatatgtgttaatgtactatagccctcaataaaatgggaggccattcctggtctcctatatatgtactagtagtagttgtgtccaaagcagcttgagagagagctttgttaataatggaagcgtgcgtatagcccatatataacagtggctagcttgtatgcgccaggcttgtatcatgcataagtcatccaaacagtaatccattcgtaacagggtagattaaactgtactccctccgtactcgtaaaagaagtcgtttaggacaatgtttaagtcaaaccttgggaatataaatcatgaatagctctcaagttgttgagtttgaaaatgtaaaaattatatgaatagatttgtcttgaaaaatactttcataaaagtatacatatatcacttttcaataaatatttttatataaataagaagtcaaagttgtgttttggagaccgtgtcgctgtcctaaataacttcctttatgagtacgaagggagtattgagtagacccggttctgtttaattaattaattaaaacctttgtgcaattttcagagtttcagtcttgctgtcgttcccctatctggagtccaagtaattgtaagtttgtaaccagtaaaaaattaatgttgcattttcttctaaaagagagcaggatttgtagaactggggttcggtaattttaatttaggtggaattgaaatatcaccaaaattggtgcaatcgtgggtaccacatgaccatattcaaggtgccaatcttatagttttcgtagaggctagtggctccggtagttcaagtgtagtaggacttgggatataatcatcatcgccacgaaatatttatcgtgcgctggcactgatgatcatgatcgattagcaccactgtacgttccagttgatcaaaacatatgctgatgcattgcttatactccctccgtccctaaacagaggcatgtacagattcgttgtactaggatgtatcatatcccatcaaaatcccttacatttaaggacggagagagtattaagcaaacacggtcacttgcaacggcgacataaagctaggataaagttttaaatttagcacgtgtgctcatatatatttagttaatacttcatccgtcttaaaacattgttacgtaccaaatccccgatgaaactctctgcctagactcgttggactagaaagtgtttcattggggactaagtgcacgtatagttgacgacgagatatatgtagtggctttgtcaatctaaatatatattggtccagttttcgaaggtgctcaacgtgtacgtgtgcatgtgttcattgtagcagtgcgtgcacgtgtataattaatatatgagcatatacgtctgtactgtgactgtgtttcatgaaaaaaaactgacaatatataacttcataaacttactcattaattagtagcactaactaattaccctattcgtttcaggttacaagacgttttgatttttgattttgatcaaggtcaaactatttcaaatttaatcaagttgtaaaaataataataatatttttaactcaacataaatttattatgaaaatatattcgattattgatttaataaaactaatttagtattataaatattattatatttgtgtttgtgtataaacttaattaaatttaaagtagtttgacctatgaccaaatcaaaacatctttgtaacctcaaacggagggagtaacattatgtgtgcgtatatatataagcacgcgcccaaagtgcccggagagaaactggatcgagcgccgccaggacgacgacgataatgctcgggagcgaccggcgaccggccggcctcgtggcgcagctgctcctcatcaccctcgccgcccttctcatcctcctcctcaccaccgtggccgcggcggcgccggcggccggcggcgggtacagcgccagggtggtcatcgtcgccgggaagaagagcagcggcagcggcgccaccgccaccgctcaccgccgcgtcgtcgtcgacgatctcgccggcatgatggcggcggcgctggggcggcaacgcctggaggacgtggtggcgccggaggaggagctcctcatcccgggcggtctcgtggttggtgcgggcggcggcgggggcggctacggcgccttggaggcgaaccagccggcgtgcccccgcggcggctgcgccggcaagcagccaggaggggcgtacacccggccgtgcacgtacggcaacacctgcttccggccaagctaagccatggctgcatttgcaaaagataattagcagctgcaagcacacatatctgcctggtgcctgctagctcgatttgtgataattgcatgcatgtattaattaattatttactccacatgcctgtattattatgtactccctctatttcaggtaataggccgtttttattttgatcaaagtcatattattttaagtttaagtttgatcaattaattttatcgaaaaaatagtaacgtttttaacttaagacaaatttattatgaaaatatatttaattattgattgatattgtaaatattactaaattactgataaactttgtctaggcacgttcttgatccctaggccgccattctgtttagccaccaagcagcgcacaacacactgcaagtatcttcgtcataaccataggaaagctgagtttttcgagcgtttctattgttcctttctgtagcgggactgttctgcgtaggacagtattttgggaatcggactgcattggtcgacattcggcgaatttcgttcattttggtgcagcttcagacaagtctattgacctcccactttcacccaccatatatatactttttataaaagagaatagctagtgatggtggtggttttgctaccaacattactaccaattcccaacttttaaaataaataaataaatgatatttagggctagagagtccatatgtcaactactttcatcagtttttaatttttgtgggaaggaaaaaacagtgtgagctaaaaatgtccacatatgagtaacaaatatctacaacaattaagatatgataataacatggtaatgttaattttcttcacggacaatatgctagtttttcttaatgcttattagaaatttggctcaaaggtagccatttttccctgaaatttctgaattttgccaattttgatggggcctttttttttattactatttctttgtgtttgatcgatgcaccgggaaagtgtttcaatttctttgagaagatatccccttatttcttgcatgcatgtcatctaaatagtaataaatttttttaaaaaaatgataagatagattaatataaaatatatcactccacaaatatgtaagttcaaatttagcttctacaagttggaacaaaaataacaaatataattgtgaagttaatttgttcttttttctgtgaaagttgaatttagtcttgcatgtttgtgtaatgatataatttctattaatccatattattaaattgcatcaaactttttttataactatttagatgatactccctccgtacccgtaaaggaaatcgtttaggacaatgtttaaatcaaaccttgaaaatataaatcatgaataaccctcaattgaaaatataaaaattatatgaatagatttgtctttgaaaaatactttcataaaagtatacatatatcacttttcaataaatatttttataaaaataaggagtcaaaattatgttttgaagactgtgtcgctgttctaaacaacttactttacgagtacggagagagtatagcagaaatgagggatgtccatccagggatgaaaatccaattcccaatgcacccaaatggagtatactgctagttagtcacggactcacatgtctgttgttggcacttggagacattttgtaagacagcaacaacttaacctccaataattgttctactccaagcgttcacagctactaccaccataagctcgctcgcgcaattagtatatcgatcggccagaggaggaaaaaatatataaagcgcgggtgcacgatgcgccgccgcgtcgtcccggcggcggcggccgtttccgcccagctggcagccgccctcctcctcctcctcctcctccacgccgtcaccgtcgtcgtcgtcgccggcggcggcggcagcgaagtggccgtcgacaggtacgcggctgcaggcgcgatgctgctgcttccgcggcggcggcggcagcagctggaggacgaggtggtgttcccggcggcgatggcggtcgtcggagctgagcagctgcagcagggcgggtccttcagcgggctcacggcgaacaagcaagtctgcctgcagggtcactcgtgcgccgcgttcgccatgccctacaccggccatggctgcatctacagaaataattgcaagcagtaagctagcttgctatagagctatcgatcttatcatgtagtatactataatattgtttatatagttgtttaattactcattataattgattgttgtaattgaatctcaatgtaccatggactgtactagtattactacttgtcatataacgctggtaccatggagcatctttatggtaccgttaggtaccaaaacacatttaaccgttaagtctgggatgggtaggatcgggagagaaaagatgagaaagggttcaagtcattgttcctagcgacgatagagttgacgtccaggcggcggtagcgcaagggtccagattgaagtcacggcgccggaggaggaacatggcggcgacgggagagggacacggcggcagctctccccttccactgaattatcccattcttcctctttctccacgcccccggctctccccttccacccgcacatggatcaggggcggcgtggcctatctaagctcgtcgttgttaccgcgccctccttcgttgtcgcgccaccaccatcgccattggctctccccttgcagttgtccccccccccccccccccacctcagcagatggagttgtagccaagagaatcagtggcctccctataaagtgcacccaacactgccgccctctccagcccggcctcaagcacccgcttacaccgtttgttgtcctcaggaaaatcaaggtcatatatcacaatatcacgtattgtttcgtgattgggtggtttgctcggttaatgcatttgatgcacgctcgaaattagagccgttgcttgacttgttttttatctttgttccgtaccattcccatgtatgtgtgccaggtgcgggagagccacgcaatcatagtgttttcttaagtagagttagattagattatatatgtgtatgcatgttaattaattagcaacagcaagttaggcatctcgatcgtctctatcatcttcatcgatcacactacaaatggccagctagccccacatatatatggagtaatgtgctatagctcgatctccttaattaagtatttaagtgtaataccccgtatattaaaagatatttagtttttttagtttgggttaacttgttaaaataaagatgttaacagaaataaataaaagaaaaatatctttagaagtgggccaacatgagaaggcccataaacccagcccattagttctccctaaaaccaagagagaggggaaccgactcccacctcccctcatagtgccgccacccctctccctggccggcgcctccttcctccccttctcctatgttcgcatctctcccctctacaacaaattgccctccctagatctccaccttcatagcttggatcaaaaagcgaaatagaaaaatggaacgaggaggaggagaggagtaaaaggagggattagatcagagtctcccctattgtctcctcacaagttctctaaagaaattataggtgaggtttttccccttgttatatcagttgttctagggtggttttagtggtttaatttgtggataaggaaggttagagaaggagttttgtttgttgtggttcgaattggctgttctgcatgttggcagatttacagtgtttcggttttttgaagtttcggagagctaaatgatattttctgcgaaagtgtataactagaaagttgtagataatatttatatctatcttctgaccgaagggcgcgattttatctcaagtggtttagacgatacgaatttttgagtataactgttgtttttatgccataatctggatagtagtagattgaactgtttttggatgggctaaacagtggaacagccaagactcctatagacaaagttgtagagatttttcttagctttccatattggtaaagtacactctgattgggcaagtagaactccagttatgattgttttagtgcggatagtctgaattttctggacagattgtgaagcctgctttcaagcgcaaattagaccattttaatggcataataaaaatataatttccacataagagttgtaggcattgttctgtagatttccaaaatatatttatttgcggtcatagccttttcatatttcaagatataaaggtttgaagcaacaatattgtttatagtgcaagcggcgttccttgttattgcgttttgataggatggggcagtaggttcacctttttcattgttttatatgcatgtttgaatgtgtttgctgaggttttatttgtgattaggtggtggtccttcagatcgtgtatgataccaacccttcattgaaggcaagtgcatgacgaactaagtgtgtgattgatggattgtttgctctatctatttatttccgatatatttctatgtgacatgtgaccgcttatattcatattgttattcgcgccatttaggttttcatgtttatcctatgtttacgatgttattcttgtttcaatattccggattctggttctgggtaaataattcaagttccctgtttgccatgaatgtgcaatatggtttcaatttggttctttgattccggtttcaattattcaagtaccatgcgtagtcatgggagtgcaatttggttctttattcaagttcctgtgggtaagcgttgatcacgcttactcggctttgccggcaaatgctaggatgtattcactattgtccgggatggaaactactattttaattcatgcctgcccgggatgggaactactatcttctttgacttggtgtttgaaaatgtgtttcctattaaagaaagaaagccttctgtttacgctttattgtcaataatgtgtatatgtgttttctagctccatattgtacttgttgagtatttttatactcactattgtgttttaattggttttaggtacatattgagaccgacatgcatgggcgggaagtagcacccttatatacacatttatctgtatactatcaaactatattgcttaggtccataatgatacttaaactatatcatggttcggtcttgtaataatcttttagatttttaatagtttcttccccatggattataaggatggatcgtattgtgggaatgatattgttattagtttaacttataattgcctgtcgtggatgtccatatttacaggggagactctgccaaaatttctaataattttgggagttagcggtttgagtgtatgtttggtgtggcactctaggtacgtggttacctggggtgttacattaagtcaagcaggttttcgcccggaacagtgagtccgattcaaccgcttggtataggatggtttcgccctcaatgaacaaacgtggtggagcgattggatacggatcgagtgtaggacaacgtacaagaatttctacaggaatacttgcgtatttttttaagtagactagaaaagatgtttgtgcgttgtaaggggtagggccaatttaatttatacatatatgtcagtagataaataatcatagctcattattttatttattcatgtgcttatccgaataagttattatcaaataaaagactatttatgtgcaaatcttttatatacatattcttagcgactcaaaagcaaatgctttaaaataaagtacaataagaaaaccaaaaattcaaattcaaaattaagttctaaaatttaaactttggcttataggaataagcataagccaaataacgagacttcaaacacgagctcgaattgtcgtccagctttacttcaaatcgggcaagaaatgatgatggacggaatcagcagcttcgatcatcctttatttcagttggcatattctttttgaaagtaaaattgattcttatggattatttgtaacggtatcctgataatatgtacgagcatgtgtggagactaacttgaaatcatgctaacatgtctaaggaatcgtgccatgtaatacgaatagaatcggatgatctatgcaaaacgacgtacgtgatatccgcacgaactctgcaagtttcattcgcttgtgacggagcgtggggctcctcaccgggagaccgcgcaggcccccctttgccggttcggccgggggcgctgagtgagattcttcaccctcgatctatggaacgttcgcgagagagcaaatgcacaagacacgggcgatgtatacaggttcgggccgctgagaagcgtaataccctactcctgtgttctggtggatctgtgtgtgaaggagttacagagcaaatggagagcaagagagttcaagctctagaatccctctttttccttctcctctggttctttttctccctcgatctccccctcttccttctcctctagttctttttctctctcccccctctttttttctcttcttaggtgggcaaagtcctccttttatatctcaaggggataccacatgcactacttctatctactcttcttttgggtggggacccaccctatcttgaccaaatattcactcgcgcctccgcctggaagctaaatcaccgcttgtccttgagtgatgcccagcgccgtcactcgtcggacacaggggatcaccctgtcatttcttcattaatgggaggagatctgcaatggccgctgtctgaatgaccctccgatgggatgggtcatacctacctccactccgccggaagcagatgcaacgcgggagcacggttgtctgccgatgacgtgaccggcatcagcccagtcacagaccggtcattcttctccaccacgcgtcagtttagcatgccgcacatctgcccttcttcatacagtgacttccttgcaatggttgcgatgaagcctggcatgaatcgagccgggactgacgtgctaactccaggagttaccacgccggctccagctagggacgagtgccaagaggctctcatcatttcgacgggacggggcgaggcgtgtgacaggccgcctgctgccacctaacccgcgatctgaccggtctgtgaccggtcacacactgcgaccggtcacggaccggatatgcgtgcgccgtgctgcattaaatgcggcgtggcgcgcttgtccattccgcaataaatgtggtttggtgagcgccgctgtgcccacctaacccacacacgtggcgccaataccacagggggtcggggcgccccagccctaggggccgaaacaggagcggcccgacccctcggggagacagaggagggggtgggcacgtctccctcgggcccgaccccccgagggggtcaggccacgtgggtgaccgcggctgcccaagcctctagtcatgatactcccggtcccatgtcaccgacagcttggtatccacatcgtacggtctctgtttcacagtttgctcgtgggtgcgactttgcaatgaatgttacgcgtgacgggaatcggatacggattacgtaccatagttttgacaaaaaaaacattcaatttttgaatcgctggcgagggcgacgcagtcccactcggacatgtggcaaggcaaattacactcacgagggcatcgcaggcccaatcggacatgttgaaaatcacgagagcgagggtgttgcgggtccaatcacagcggcgcacaaaggcgcgtgtggaaaacagactctgtcgcgagcccaatcactgcgtacggcaaggagcgtgtgaaaagatgctggcccaattaatttgcgcgcgtcatagcggcgtaagaaaaaaaggaaatgatttgacagaaacataaaattaaaaccgattcaaacacggatgacgtaccaaaattccgatgaaaatattttcaattttcataatagtagagatacattttaataaaccgtaccaataaacacatttttttcgcgaaggcgcaaaaagattacacgtcaatatatatgttagaaaaagagaacaaaatttgattacacaacgcacactgtcaaaaggccattgccaggggtcaagaaaaaaaaacagataaaaaaagataagataaagaaaaaaaaaactcctatcgtaagggagggtggggtagggtaccactacactccggcctgcctccggagcgaaacgatggaaccatattcaggaagctcgatcagcccttccatcgctatttataggagtgatatcacacgcagcaaagtcgcggcaggacagcagcaaaccagaacggaagctagctagtagcaagcaacgacgacgggccatcgaaattgctcatcgccggccggcgcgcgtgatgcggcggcttgacctgccatcgccgccgccgcgcgctgtcgtgatccttgcggcggccctcgccgccgccgtcgccaccggcggcgtggaggctgcaggcaacatgtacgcgtcgtctgcacgcgcgaccaccacctcatcatcttggggatcatacgccggcggcgccatgcacggcgccgaaatggcgctggcggcggcggcggcggtggaggacgaggtggcgccggagttcttcccggtgggcctcgtcgtcggcgacgggcacggctcgtatttcgacgggctgaagagggatcagcctttctgcccgccggacaagacgtgcgccgccaacggcggcacgccctacacccccggctgccttacgatctaccaatgcaacaatgggcggggctagaacagaatagtggagggtgccacttacttaatttactttactttatattgagtttaagctgatacgggtgtctaatttagggcctgtttggcacagctccagctccagctccacccctcctggagctgaagctcagccaaacaatttcagttccaccaaaactaggagtggagttgggtggagctctcacaaaatgtactagagttgtggagctgggtttagacaactccacaactcaactcctggagttatatttaggagttggaactgtaccaaacaggccatttgtattaagagtggtgcacacataataaaaataaattaggtacagctaaaaaattttcttaaccgagttcctgggcaccccctaatatatactctacctccacccctcacaatggcggaggttgagcccaaattcaagaggaggccagatactatagtgaaaactagcaaacctcaacattttaagtgctcagttggaaatctcccctttctccaaaaccgatcgtgatactgctgaggcatgacgagacttgcatgtggatcaaataaaatctgaaagaaaagttggttatatagattgtaatgctatgaatatatacaaacgtgcaagtcagagggtgtcttaatttctgctaaaactcttaaaaaacacttatattttgaaaaaaaaataaaaggagcatacggtccctttgaagacaccctctgaaaatcctgcatgtgcgttgtgcaggtctgtgagaactaagcagccattggaagcaactctatatagttccctttttattgagagaactctataaactatatagggtgtgtttacttcacattaaaattagaagtttggttgaaattggaacgatgtgacggaaaagttgaaagtttgtatgtgtaggaaagttttgatgtgataaaaaagttggaagtttgaagaaaaattttgcaactaaacacaacgatagttgatatatgtatatctttagccctaaagtaaatgctatttgctagtgcactaaagccctaagcaaaatggctaattgatgacaaggctggccactcctgctagatggtccaaaggagcttgagatcgagcttgttaatggaagccatgaagtcgatcgtactgtagccactagcttgtatgcgccagtcctgtgtcatgcataagtcagccaagtgcagtaatccttaacagagtcttaattatactccctcattccctaaatgtttaacaccgttgacttttttaaatatgtttgaccgttcgtcttattcaaaaacttttatgaaatgtgtaaaactatacgtatacataaaagtatgtttaacaataaatcaaataataggaaaaaataataattacttaaattttttaaataagacgaacggtcaaacatttttaaaaagtcaatggcgttaaatattttgggatggagggagtagattggaagattaattaaactggatttggcagaggcggttcctgtttaacttcagtatttctttttttctagaccaagtcacactggaggggagtttaatttcagcagttcagcataagaccccatgcagttttcagagtttcagtttcgatcggtgtttgatgttgttccaatgttcttgtctggaatccaagtaataattgactatagctcgattaaggttcaaaaactaagtaaaatacattaagtggaaatcaatcaccaagattaatttggtccaatcgtttgttggtaccacacacattccatatgcacaaggggcatgccagtcttatattaacttttgtagaagctagacagctagtggctccggtagttcaagtgtagcactcgcaaatatgatcatcatcatcgccacaaaattatttatcgtgcgctgccactggtgatcagggcatgatcgaagcatggggcatggattttaaacgccccacgggatgtctctttgctctttacgtgttatttaaatagttataagaaaaattagtagtatagattaatatgtgatatatcactctataatcatacaagctaaaagtcgacttctacaatttacaataaaaagataaattaaattataactagttaacgtatatttgtagttaaatttgtttctttttgcaacttgtataatttaatttgatttttttatgtttgtagagttatctattatatagtattaatttatgttgttaattttttttgaaaaaatatataaccatttgaaaacaatccccaagaatagtttctcttgacgcatgcttatgcattgcttaggtaattaagcaagctgcaccggcaagaagcatggggaggcctacacccagtcgtgcgcgtacaggagcggcattgacgccaagctcatgcaggggcagagctataataaaatggaggggttccagtcgtttgctttactctcgtttaaatcaaatttagcttaatacgagtgaagtttaaactaacagggtatatatggtaaaaatagataaactatagttaatatttttttaaccaggttcctggacacccccagctatacatagctccgcccctgtgctcatgctcacttcacgtgtactcccttcgtaaaaaaaaatgtccaacctagattaagatgatataacctaatacaatgaatctgaacaaccatctgttcacattcattgtatatatcatatcttatttaagttaggttttttttgacagagggagtaagcacgtgccatcatacgtgtgccaatgtaataaatgagagtgatgttcatgtcaactctggtcaagtgtctaaattgttttagaaactagatgatgtcccgcgctttgctgcgggatatatgttatataatggagaaatgatgaaatgatttggattgaaatattatgaaaatgatttgcgaatggtgatttagcatgtgtatgtttagttttacaatgaaataaattgctgatatgattactatatgcttacatgttgagctttatgtatttaatagattgatgtggcatccttgcatgtaggttttaggaatgctaataaatactatgcttgcatgttgagctttatgtgcttagtggtcattagggcatgtacaacggtctttattagtagtctctctctattgccatacaagtaaatttgatgacatggaagaaagagaaatgagtatagttgttatgcatgacaacagctcagagtcgactcttagcatttattagagcaaattttattgcatggtggtgaaaggaaggaaagaagagtaagaaaaaatatttgaatacattaatgattagagaccatactgtctctaactgttgtaggatgctagtctttagataacgtagagcttatatctgactctaactttgtacatggccttagctttatagaaagaatagatgttatgatatttggtaaaatatcttgagttatctaaatttataatagaaatatttagatatctaatatttaaggtatgaaatgttgtattataacatacatggatcgtaaaattacctaaagtgatatccttagattgtctcaacttcatcctcgtgtattctcgggccctgttcaatcgtttcctttcaaggcatggtcgaatggttatattgctaggatactccaatacagtcggtagcatcgtgaaacaatatagatgttgttagttcgtccacaaatagaagtaccatatacaattttattatgcaagttccgtatacaccaactaacatggcgggtttcactaaaactttgagagaatattttgcacgtactttcaatttcaataatattacatctatctataaagtataatttcaatttcattatattttagcaagataaaattctaatagatatgttactttttttatggctaaaacataacaaatatgaagttggtacttaatttatatgtgtatgcaatactattgaaaatacatgtatattgtttatataattttttatgatatatattatctggtgggtacatagtgtgtaaatttatgtgtatatacgatacattcccccacaaatataagcatttatatgagctttagcagagaataatgtttagcatttactagtaggggaaaatcccactcgaaatgtagcatttataataaaatgtaagaaacaatggcatatgatttgattctgttttgttttgtcagttgattttctctcaatgtatctatcttctttcacttccctcggatgcttggctattattttttatactctttggtgctttcatgtccacgagcctccctaatttcaccaccatcatctttaatttatatgccttatctcgcctcacctatcccccctgtatctggcagctcatgtgccacacgtctactagccactccgatgaatcgtctccgtctccaacatcgactcaacgcactcctctatccccatggcaatgttgggctatagtggcaccgctggtgcatagctgcccaccgcttgctagccactccgacgaatcacctctgtctccaacattgatccaacgcactcctccagccccatggtattggtgggttctggcggcaccgctagtgcatcgccatccactgctagtcgtcccttaaatccccaccccctccccgaaattcaatggctaatgtaattgactgatgttttttacaattaactgctgaacaacaaaggtaaaaatttaaacgctataaatcttatattgctggatgaagggagcaatatataataataaataaatatgagaaaattcgattggtagcataggtattgtccgagtaaaataatagcacaagaaacttgtttcttcgcctgaaagcacagctctgttagagatttctaaaatttagcacttccgtccactaaaaagaccaaaaagaaaacccttaggtcaatttcttcttcctcctccttccagtccctcactgcatacctcttcccctgttcatcgcttgcctcttgtctcttatgcatgaccgagacaccacgcataggcaaggtccaatttgtaaaatttaagtttttatcttacatgtgtatggtggttattgaagttgaaattgattagtttttaaggagtatatggtccttgcaatttttggtcatgctcacatcttcacctagcaataagccctagcagccgttgcaagcaagtcggccactgccagcgttgagctcgacggcttaaacaagctgctagctactcgtattccctaaccctcagccagtcgccatcttcaagcaaccaccagccatcgttgtcaacaacattgaaatagcagttgcggcgcatggtcgcgcaagcctgccgtcgtcgctattttcatggcgtgcgcagcctctagtccaagtgctctagcgcaagtgcccaacctagtcatgtgtaaatgcagagaataatatggacaaattgatctttctctgtccctactcatggcgaaaaactttgattagacctgtagttgtgacggaaatacaacggataaaataaaaacaagtggaatatacttctgatcgaaggtgggaattttgtgtgctattttttggataccgacatgttttctatgttatagatcgaattttctcaataaaaatataatacaagaggaagggtaatggaccaagtattgagaaataatttttctaataacatgaaaactacccatacgacgtatgtatcctcgagctacagatacgctggtccttggaattttttttaaaaaagaaatccaaacatttcagtaaaattcatctaaaatttcttccaaacacatcactccggcgccccctgatttctccgttcgctcgcgccgccttccgccggagtaagctctccgccgccgtgaactcgccgttcttcccgccgccgtcctcctccgcttcctcctcccctacagtggactggcgtggggtggagatcccccctatccatcccgaccgactcctttcccccggtgaggaagccctagctcgctccgaatccgctctcccaatcctcttcttcgcggtgaggtaatccaaacccgaattgctctgcggtgaacaggaatccggcgccctcgctggcggcggcggcggcggagttggaggcgatggacatctacaatgtcgaggccgccgagatcctcgccaacgaggcccaggtgagctctcccccctccccccgattcgcctcgcttcgcgaccgagttcacttgagctgggttgcactgacgagctcaccacggtgttgcgcgcttgcgctccgctccgctccttccttgtctccagctgctcccaatcggcgaggccgctcccatctacgagaagctgctgtcaactttccccactgccgtgagtccagttcgatttcgactcgatgttttgcttgctttggggttgcatcgtatatctatatataggttcgtctggttcatctagtgatgccatttcacttggcttcacctgctatatgtgtatgtgcaggcgaagtactggaagcagtatgtcgaagcttacatgtccgcgaaggatgatgaggccaccaagcagatattcagcagatgcttgctcagttgccttcagattaatctctggtgagtggaggccatatttggagattgtacattaggcacacgttgtagtatgcatatgtgggatgtgttgaataaattgctttactgtcattatgtgaattatcattgttatcgctggttgtgtcactgaactatattcctaccgtgatatgtgtggtttgggattgaacttctgtgtcaaatcatgcatgtaaatcatcaaattcctaagcagtctctgctcatttaacctgatggtctcattagccactagttccctgttatgtgatctcatttgtgattgtctgccttgtttttgttgctcttagttttgcctattcccttggatctagtattagtatgttttcaagtgcatcattaacatttccctatttgtctgggtgtaatttgcaggcgttgttacatcaactttatcaggagagtgaacgataaaaggggttctgatggtttggaagagaccaaaaaggcttttgatttcatgctgaactatgttggtaagtaggcacttaattatatctagtgcctggtgatgatgtgacttcctaagtacatttttttaacataattttgctaaaaaaaatatggcgtcacatatttggcttgatttcagtcacttttttttcactgcattattgataactaccctttatattacatgtaactatacttgtatttctcatctctctttcttattgacttttgtgtttgtccttctacttatgtgttaatttgcactagtacctttttcaatgattcaaatagatgatcaacctttttcgtagttctcttatatagggaatgataaaaatatagagtgtaagatttgaaaattacactgtaaatatatgaaaattacattgcaagatatggaatttacagtgtaaatactggctgaaaggtttgactgttttttggtgaaaaatgtggtgccataagtatagataatccctctttgttttttctttaacttggacacttaaactttccaggcaatgatgttgcttctggccctgtttggatggattatattgctttcttgaagtcaatgccggtttgttttcttccttcttgtttcctgtccttccccatgttaacattcatcccttctattattctgtgtaaatatttctttgcatactcttcaggttgtgacaccgcaggaagaatcacatcgtatgactactgtacggaaagtatatcagaaggcaattttagttccaactaatcatgtggagcagctatggaaggattatgagaattttgagaattctgttagccgcaccttggtaattgtagtttccatttgaatctttgatctttgtgaaaattagctagcaaacgactctaatcgctgtctggtaaaacatatggtgctgtagttcttcatgaacatgacacttgcagattcagtgcatcctcattgtatcaatagttctagtatttctgttagcaggtttcatcttttactttgttttcaaaattaatattatcaaatctaaaacaatgtaactgggttacatttgattcatatggagttgttgattatcaatctgtattccaggcaaaaggtttgttatcggagtatcagccaaagtttaacagtgccaaagcagtatatagagagcgtaagaaatacattgatgatattgattggaacatgctggcagttccccccacaggctcctacaaggtaatcagtaagtgaggttctaacattgctttacaccaggcattgatcgaacctacatatgttaactccacagtttttttttttggggggtgggggggggggggtg

SEQ ID NO: 69166 - DNA, 1060 bp, Oryza sativa
gcatatgagtttttcaccagctttcaggccctaggaattcttgtttcatgcttaatttctaacttgcctatagctcagaaagaccgaaactatcccatcaaattcaaaatatgttccattgcagggggaaccctcagaggattgatgctacaactgctaataggcgtgttacctttacatttgaacaagtaagccattttcttcctgtatgcttagatccacagtgatttttggctttgtaactatgctttgcacaatattatttataattctagttgcacactcctatcctttgtgattgtgtactaagtttatgatattccgtgtaagtgccactatgttttggagatgaaactgtttggttgctttgtttttattttcagtgtttgatgtatctataccatcatcctgatatatggtatgattatgccatgtggcatgccaagaatggttctgtggattctgcaattaaaatatttcaacgtgctgtaaaggcactccctggtaataaatattcctgtatccccctccaattgtaacttttgttttggagtaagtctctggcaatatggttgccataagcccataggagtcaacattttatgcctagcatgtaaccttgtctcttttttcccctcatatttgctagtcactcgatgtatgagtatgtgacacaattatcctatgtaaatttcaatcatattgagcatgcaccaatattcaatggtaataaaatgataaggttgttagtagggggtgttgattgcataaaaatgaatcggacggttttgtacaaatcaaataatctgagtatggttttcagataaaatggaaaatcaagacatttagatttttttttcatcacatactctggatatgaatgcaagatgaacgtacaatccagataaaaattgacattttagtattctacatgctaggccttgttgcacttgtttgtgaaatctacaatagcattttctaatctggacttcaacttaattcttccacattttttcttcatagattcaggagtactaaagtatgcctttgctgaactgga

SEQ ID NO: 69167 - DNA, 20312 bp, Oryza sativa
cttctcaagtatcaaatctccaagaggaggaacctgaaaaattcaatgtgttgtatatatatcatgcaaaacacggggatcagtgaaaatggtctgtaaaatgaaaacattagccaagtttaatagggtaatatggaaatacaatcttgacttagcaaaaccatgtatgttgttagaagctatatatctacaatacaatacttcctaaggtattatacaaacagaacctcgatatacaaaatatatgcttgttcttagttttataactatcgcacattcagaaaggttggatctcatagctccagggcttgctaaatgcaaaggatctttacagtttaaactattaaaaggtaccattaagaaatagacataccgaagacatagttataggtttagaactcgtgctctgctgatcatcgtgtacataagcttttctactgagattcagattgcttgtattcaaaagatggacaagaacagcctgaagaaagcatgtctgaatgagacaaaaactcgagatagactgagatagataaatcaaaatgtttagtaccttcctgaaatcatgtggatgactaattccagttatctttatgtcatcactagaaggctttcggacaccaatgttctcaaatctgattgaatatataccaaaaagtgattggagataacctacagatatcacatgagtacagtagataactaagcatattgcaccaagagtgtcactcatttatttaaaaaaaacaagaacaaacttcttaacaagttaacatagcttttcacaaccaaggaaagaactggatttgcactaactcaacaaaaagatggaaaatgaaaatatatatatatctctcataaccaagtcctagcaaaagcgctttaatagtttagtaacaagtcacaaacagtctttttaaatgaatcgtcacgaacaagtttgttctgcattattttcagcttaccttgttcgacaacaatatcagaaactgaatgaaggacaacatgcttctcattcctcaaaacaccaaaacaaggaaaagtggcaggcctagttacctggattatgagcaggggtgttagatatattagtaagaacctaagagagaaaacaaatagagtttccatctcctatccaacatgcagataccttatagacaatagcatgtggagtcaaacacaacttccttgagcggaagtccttccggcacacatatatccaaattggcaagtaaagcagcatgaggagtcctactccccaagctaagatcaacaatactgacagcagaatccaccaagtaatctgatacttgacaaacttgtcttcagttgcctcaaatgatgcatcatagaggatctcatcctcacttattcccttataatcatccggtgataaaccagccaacaagtgcctttctaacacatctacttgtactatttcatctgtaaatcccatctgtgattgtacaaatcataactaatgttccaactgaaaataccttaactgggagcaattaatgggaggttgagaaataaaacaaccaacaagtaaaattaaaatttccttaatctgaccgtgcaaaaatttaaagctagcagacactctgaaacccttctttttttcttttattgaacgaacagtcaaacccaaatgattccaaactgtacttcggcaataacgagttgtctactagttgtttgaatttaatggctagggggaaaaaacccacacatttagcagcaagcaacagattgcgcaggctaggtcaattgcaggacacgaacacactgctactgctaataacttccaaaaatagacgcatcaaacgagttgaagcctgaaaatcacagcacaagatttcctagcacgaaggagggcacatcgaatcatcgccatagctaagcagaattccgggagcggttaagcacgccgccgactgcgacagcgcagccgattacgttccgccggcaaagtcggcagccggtagctcgaatcgagcaggaaccggcgcacctaaggtgcccgagcgagccggagttactacgagaccgatcgaatctcttaccactggggggagcaggcgagatcgcggcggaattcggcgccggcggcgatggcgacaacggtggcggtcggaaggttcgagaagagggagggaagcgcaaatttgggggaaaacagaaaagcttccgccgcgtgaatacgtaaaccaccaaagtacgctttcagaagggagacacgtaaaaatagagcttggcgcagcggagcacgacccgtttgtttggacgtgggccgtgggccgttatccggatgggccaaatatatctagcacgttgcacgtatagcctgttaggttaattaggcctgacaatccagagaaatggtgcaaaaatgtccaaaagtttgtgtacaaacctttagagttagagatggtcaaatggatccataaatttgatcgatcgatcgatcgtgtgagtacacacacgttcaggatcgattgattaaaccatagttgctcgcaaaaagaaaaggacagaattgctaattatttgttgactcggaaatttcactgctaaatcttgcactctttttaccattgaggatgttgtttgagattggccccgagattcgtgagcgacaggggaacaacaaataacatatgtgcatgcagtggccgataccactgagcaaaccacatttttcttattgttacataccagttatatcctacttatattatgattatatactgatcacattgaaattatactattactatattatatttatatttgacagtttttttacgatgttattttttgtcaaatattatatatacagtaaaaacgaggtcaatttaaccgtagacaaatatattcgctttgaagtactccctccgtatttgaatgtatgacaccgttgacttttcgaccaacgtttgaccattcgttttattcaaaatttttgtgcaaatataaaaatatttatttcatgctaaagaacatttgatgacgaatcaagtcataataaaataaatgataattacataaaatttttgaataagacgaatggttaaacgttagacaaaaagtcaacggtgtcatacattaaaatatggaggtagtactcatcttgcatggagggattcaactatttgccaatctaagaaacatccgctcttcaaatgtcacttctagaatcgttcttatggttttttcctaggggatgcttgtttcagtctgtcaaactttttacagctaagatgtggcatgccacacttgatgtggctgagaaatccttaaccacaagttaggcaagctttggcaaagagatgtgcctatggcttgtggggacacaaaacaaaaaagtgtggcatgacaatcatgtggtaatcaaacaaaacactaggttaagttggtcaaagttgtgacaaagtgtggtcaccatccaaacacctcatacttcttaagtttttgtgtagcgtggcttgacctatggatgtccagcgtggaatgcaaaggcggaatctccattttgcacctagtggatcccacaagtcatcctctctatttcgtcctcaaccactgtacatagggccttaggataaggagcgcttgctgctagggctagggaaaggatgagcattaagtcccaatgaccgcttgccgaccggtagtgggccacggcagaccgacggtggccgaaggggatctagcggcaatgcatattgtggtcgatttggccatggattttttctcgccaacagtcatggaatcgttgatgctcgaggataaggcaatgcgacttgagatcctagaggtaagtaacgaagaatgtaggagggaggaggaggctcgggggatcgagaaggcggcaacagcgagttgccttcctcaactgctggagagggtagctcgaggtggtgacaaccattgttacaacggtcagtggacatgcctcttccctgtcgatctccacaaccattatcgtcgcctatgcatgctaggtctggagaggttggtggcgtggtggctttgtctaggaccagaccttctgcagcgatacatcatcgatgccaccggcgccgtctctcgtagtcatcctacctagcatccatcacgatttcactttgcttcctcaatgaattttttttctaccacttgggagtgggaagggaaggtcgagtgcgtcatgtgcgtgtgttgttgggtcgggcttgagtcgacgtggcaaagtcggtggtattgcggtggcgatggtttgtgccagacttggagagggagaaaatgaaaattacttatcactcggccatacagattgtcctagttgtcatgccacatcagcagaaatgtaaagaaaaatatcaagaaaatttctcccactgatgtcaaatttctaaagataaatataaaagtggcatttagagaaacacaaattatagaagtgacaaataattaaattcacaagttacacggaccttcggttccactgaactcaagctctagcattccgctactttacatcgctttgattgattgcctgatgcgtctgggtattttggaaatgcggtggaattcgcatgggcaaataagtgcagtgcagtcgtgcaggtactgtgtactatagcctctctctctctctttgccctgtgtagctagtgtggttggacgtcgtcctgctcctgcctgcctcgtctgctgcatgcagatgccgcagggcaacgcagcctttgtctgcccgcgcgcccgaatcgcccacacacgcatcacgcacgccacgccacgtcgtgtctgatccgtttcacccaaaccgggcctctctagtctctagcccctgcacgggcacaactgcaccgtgcgcgttgcacgtacgtaatatatgctgtgccgcgtgcgttggacttggacatcgagtgcgcgcgaacgcctaacatatttttgtgatcattaaaccgtgtgtgcttctgctctgaaattcttatagcatttttttgttactaaaaagtataaacatatatcttttgttagtaatactagtagtaatattctcactttgttgtagggtagatcaacttggttaccacttgtcacttcctcaaaaaggaaaataggcgttaggatacagggtagagactattcgtgacaacttgactacttcatttattgtattcctttcaaagaaaaatgtgcgtcggcatgcaatcgtgtaattatacttccatttaattgttaagttacacaatactatacctagttgaaacaaagaaaataaaatgtgatccacatgtattatatacttattattcaataagtaagctacacgactataccttcataaaacaatagaagagaaaatacatgctaatatagtaactgccgactagcttatcacaattctcaaaataaaaaatgtcacaaactacaattttcatcatttaatagtgaatgcaatatttcagtactcactaaattacaaacaattttaaggaagacatgtaacggctgaaactaaactaggagtactgtagacatgaagagcagaaagtgacaaataggggatgcatcatcgtcgtcatcctccacctcaacctcatccgtacgcgccatcccaacctcctcctcaccttcacaacccccaagaacgatacgcatgggacccaccccacaacccccaacccacctcccacacgcaccaatccatcacccaacccccactgacacctaggccccacccctccagccccaccacccggccccatacgtcagccacatcacccaaaccaaccccacgtaagcaaagcaaacaaacccccctccccttctgctccgtggcagcgggctgtcccctctgcctctgacaacgcgcagcgccacaagagacaaggagggtgctcgttggccccacctgccagcgacacagcggaggagggttgggcccacctggcagtgactcatcggggatttcaaacgcgggtggggggttgggtttggttttggcgttcccgtgtccgccatgatcaccgctgcgagcctagcttgcccgaaacggcaaagctacaaaacttttttctctcgagagagaggggatgcaaaagctgattccttgcagcggcaggagtgggtagtcgcagcggatcagacacacgaacagagagaggacgagagagaggggtggagcagacagcgagtacttcgcttttgtttggtttgtctccttcttccccgtggtgagttggtggaggaggaggagaggagtatttgagattggagaggaggaggaggaggaggttggtgcagtgctgggtgcggttcggggagaagctagcgcggatgggagaggtgaggcggccgcgtccagcgatcgatcgaggggatggtttttcgcttgagagagcatttggtttgatgttgattcggtttggggggttttggttgcgttgtttctccgattcgtctgatttatttttttttgaggggaagattcgtctgattttggttgggtttttcgaggattttcgctgggatccgtgtggttttggccttttctgggagtttcgttttgtttcctcggagctctcgcgagcatggcgtacgttgcctctgttgctcgccgaggcgacgagaggggggaggaaatggtgctccaattctggtggtttcgtcgtgagatgttagggtttgacgaatcctcgtgaattaaacttgccgttatgtatattgcgatgatgacggtttgtttatccctgcctctctcttttttttttcgcttgtgctttttgcgttttgtgcgggtttgggaaaatttgtgactggcttgcggatgctttgatcgtgcggtttgatttctggattttggattgattttgcctcatttgacaaggatttttgaccctttcccgtgcaaagtaggggaatgcttcatcatttttttttctttttcagaacttccattcggatttgtccgatgcacaagtcatccatgcgtactgctaatatgcgtcgtccagtgttttggagcttctggaacttggattgaccagtgctagggttttaggtgctgttcgttgatggctcatggcttcatgccttattttcctctttttttttcgtggagatttgggtttttgtgatgatgtgcattcgtgtgtattccacctatttgtggtgccacgattcgaccaatttcagcgggcgtgcgaaatttcagcgcgtttttgaaaagtttttgtggtttcatactgtttcgtttgttttttttgctgcgagcctgcgattcgacgtgtgttttgttttttcccacgttttttttttttgcaatccgagcgagattccaagttcctcctcgtatcgagcaaaccttccttgctggtgtttccccatcttccgtagcttcgtttcaatctcgggcgtcttgtcacacgtcacgacgtgtcattcgtttctgtctgcgacatcatgtgattctctgagctttcgattcgattccccgtgattttacgagggcttttgtctttggaagcgaaaggaaattgcaatggcgctcatcaaattttggtccctttcctgcttgttttcttgcaccttgtcgtgcctgcttaaaagccgaggcgactgatggattcgtggaattccattcttgtgtatctgtctgcagtttcagtcccatctcctgcttcttccgcttgctgcttttgtttgaaaatgtttagcgtacagtgcggcgatggctcgagtttcgtgggtttctttcggtacagagatgatatttagtttgttgatttcgtttatatgtgcctatgaattttcggttgatgcaaacttgagcgaaatttatttatgtgttcgttgtgttcatctgtgtttgaagagttcgttttgtggtttgattttgtcagggcgcgagtgaagagaccgggagcatggatcgcgccaaggcagcggcgcgcgaggacaaggcggcggcggcggcgacggggaaggagaccgccgtgtcccgcgccgtcgcggaggacgacaccgcgctgctgctcgcggcggtgggaagcttcaggaaggaggcgatgggccgtctccggaagggctccgacgcgtcgcggatgctggaccaggagatgtccacgaggctgctccacctcgcctgcaagcacgacgccgtgcagtgcgccaggctcctcctcgagggagggcacggcatcacggcgtcgcccgtggacgccagggaccagctcacgcggacgccgctccaggtcgccgccgaggcgcactcggcccggtgcatcgagctgctgctctccaagaacgcgcgcaccgacctcaagctggtcgatggccgccctcttgtcgcgctcgagatcgctctcttaagcagaaggtgatggtgaccactgagctcacttctcaagttctctccatgcaatggctgtttttctgactgatgttcttatccagagctcaagttaaatggtcactggacaactccattgaagatcttctgtcatctctgcaagaaaaggtttgtatggttactagtactactaatgttcattcactgtctcataattggtccatagatcttctcacacaaaaatgtcaccttgttccatgtgtaggatctgaatgcagtgaggctcctggcagagaaaaccagagaggttggggaggtggcctacagatatgccatggaaggtcgtgttactgtgttggcaatgctgcttctggtggctgaagagaagatatcggcaccagtcagtgtagttatagagggcgtcaggacaaagaaatcaatctactactctattgtggatgaggctctgtccattggggatgctccagcccgggacagcaatgagaggagaaaggccctgctcagtgagattcagctacttaaccaatttggggcagcgttatggagagatcgcaacattgacaagagaagcttgccccctctgcttaaagctgccaaggtacctctgttcatattgctgttcttgttgacagttcacagagctatttcagaatttccttgcttgacactttatatggtatgcatactgatgagttacaattaataccatgtaagctgagcttttgagtcattttcatgccctgcccaatttcaaaactgatttttctccaattatggtccatgcaagaatgcttaaaatgtgctatgcttaaggtaaagtttttagtgctacaactgtatatacaccagaagactttcttctgactgacctttctactgtaggttggagatgtaaatgtcacaaagatgctcctgatgggggatgttgatgtcaatgaagccgatcctgaagggaacacggcacttcactggtgccttagtggtagctcaagcacacaggagccaaggtatgctattagaattttgttctatcaactgttaaaatacaacatactagttcttactgctatttgcattctctttacttagttgtcttctgtatttgtgcaggattgtgtggctcctgctgaagaatggtgccagagttttccaggggaacaaacttggtcttacaccagtacacagcgctgcagctaagggaaattataaagctcttcaggtagccttttgtaacttctactcacacgatggcattttttgagcttataactaattgatagtatgtttgtttgctctgtaagtcacttctgcttcatgctcaagattgtgttgatactccttccaagaccaaagaaaccccattgttcttagcagtgaagaatggttctttggactgtgtaaagcttctcctgcgttctggggctagcaccaaagtccagaacctaaggtgggtaatatttggatttaagaagaatatgcttctgtttgacgacttgatgcacttaccatcctttgatcctttgacattaaacagaaagcaaagaccaatagacgtggcaacgtcccaagatatgcgtttcattcttacctctgcaaatgtggctccatgtaagatattttctgacatttaaagatatttatcaactgaaatcacaaaaatatttgtagtagtgcatacaattagcagtgttcgattcaatgaaaaagatttcaagattggtttcctgttggttttactgcataacgatcaatacgcggcaaataccttttcaactgaaatatattctgtttgtagggaaccgtagctcacatccaaaaaaaagtgtgacgaataaggaaagctgcaaagagttcctggaagattttggtgattatgacagtgatgatttaaatgaaaggtatgtccggtgcatactgcatgatttatattagatcttccattcttttgcatactagaacctttgcttctcatcctacgtttcaaactaatatatttattttgataatgtggcagctttactgggcttaaaacatcagcaagccatcgggatttccggtctagtaatggttctgcccaagggggcaagagtaagaaccattgtgctcccaagcaaggttccaagtttgtgcctcgggtaaacaaacatactctgcctatattaaccattccctttttcttcacatggtctgcctcttataagattttcttttagcctaatcattggccgaagcacgactacactcggaaaatttttgttgggggcctcccaccttctgtgggcgctggtaaacttcagaatcctgaactacttgtacttaataaagttagaactaatgtgtttctaagttctaacacttaccttgttttgttcttcctggcagagtacctcactgagttcttcactgctgaatttggacctgtggaggaagcagtagtcattgggataaggatgggtgatcgggtgcaatctcgaggatttggttttgtaaagttcaaaagagaagaggatgtgataagtgcaaaggaaactcatcatgtgtacatgcttgggaagagagtggaggtaaaggatgctgttgctagaggatccttgcctgcagaaatccagaaaattgctccattcaggcaccacagccaggaggttccaaaggtaactcaccatctgttggatggtgagctaaaggaggaacattacattaggaagcgccggcccttgccagagaagtgtcttccatcttggttctttatattcaggaagtggttgccaggatttcttgcagatgctaccgaacgacttggagataggtacccattgagctccctgaagggtgatttcagagcaatttgcagaatggagcttgatcatggcacacttggttatcctaagctcagtgatttcatgcgttcccttcctggtatctgcagaatgtgtgtagtccctgtaggaagtggtcctgccacacacatggtcctccttccaccggtctcgcgaccgaagtatgtacccttgctggaaccattctcttttgatcatgatgagctcccagaatcagtgtcagatcatcagtccccgaggtctccacttaccactaatatcaccgaggactcccctcataacacagacagtcagcagggtgatacttgcagtgagagcaatgtgcagagccatcagggcgatgagtgctgcgggagcaacactgaaagccagcaggatagtgcttccactgacaatggtagcttactgggtgaagttactgtcagtaccccaaagcctgattccattgagtccatacctacaggaaagtctgatttgattgagcttgtacctacaagaaaacctcatctgattgacacagtcactacaagaaaacctgatttgattgtgactgaacctacaagaaaaccaattgtgattgagcctgtgcctacaagaaaaccaagtgtgattgagcccgtgcctacaagaaaaccaatggcaattgagcctgttgtgcctacaagaaaaccaattgtgattgagcctgttcctacaaggaaaccaattgtgattgagcctgtgcctacaagaaaaccaattgtgactgagcctttgcctacaagaaaaccaactgtcattgagcctgcatctcttactcagaagattgtttctgagcctatgaggaagactgatttgtttgaatctggacttgcaaggaggattggtttgattggttccagaccaacaacatgcttcgttgactgtccagttgaaaggccagcagtaactccaagcaactgtgaggctgatatgagattctctttcttccaatcacaatgggacaggttcctggtaagtgatcttgtgagatttacattgcttagttgcttggactgagaactatgcctaacttggttctttctactttaggctccatatcccaagagtgattactgcatcatctgtcgatcctatgatgctgtgatgcagcttgtcccatgccttcataagatttgtgttgcctgcatgatgagatgcaatgtcagggcatgcatgacctgtggcactgctgtaagtggagtcaagtcttcccctgcacaggatgcaagataccaatatgtggtaataattatctccaaacagtggaatttcttctgatgttcccttttgaaaaattgtttgatatatatttatctactgtgtttcaatgggatattttttcagactgttagaaactagcaaaggatcaggatgcttactgctgtttttacttgaccagagtttatgattgaatgtgtctgatgtctgatcgatcatctgatatgcagggagtcatggagcgtgcatcagatcaaaggtgccagctgatggtggtctgccgtggagctgaggcgattgtcagatgttccccctgtatgcacagcatcgcatgtcgaggatgcttcctggcttcagtaacattactcaagggctgcaccacttgtggctgcatgattgagcacttcaagttttgttgagtaggcttacttccctgatacagtaataccagaacttacattactatatagaataaagcaaacagtcccacaatctgaaggagagatcagttcactctccttcgattttgctgcgctcgtgggatgagctaacaggctactcggttaggtgcgctcactcctgcaagcttgaggagtgctctttttgcttagaaatatgttctctcgaatgcttgatggacatgcttctgtaagcttgtgatgaggagtgtgttccctcccattttggcaagcttacactatatatgccatgtaatgtccactatctatctataatggcactcttttttgtaaattcagtactatttaagtaagatggattctgtttagctttatctctgggtgtttctgtggtttagatgtttaagcatgtctttttgttgttttaatctgctaccgctggagcgtgctgctctttcttgtgggtaaaattcaattgaagtttgtcgttggatgatctgttgtaatgttttgtgttgcatctttccagaacacactcagttccaggcgttcatgaatttttttaatgtgttcaggaaattaggatcagaaccgttctgcttgcttgatctatcattccaggatgatgtgacttggtttcagacagggagcattccatgtatatcttgcaattgttcatagattgaaggtgtaaggcatgctaagtccgttgggtgatttctttgcatttcagttgtgtatgtcagattcctcttgaaggtcaaagttgaattttgttagaatgtttaaaaagaagatttgtgtatgcatattcattggtatcagctaggtggaacttttcaatccttgaaaagagcaggtagtatactctactttcggctggagcatggatttgtattctttttccccttgaatttgattctgataaacccgaatttaataaaaaagaatactaaatatttgatttgtaaactgtcttggcaagattagtgtggaacagcaatattacctcacatgccttttttttttcctttttagaaaccatacaaagtcttcttgatctcttcagctagtcaactgcagccaaaattcatacaaaatgtttgaatcgtttcccaaagaaggaaatattgacaggaagtagcagccagcagcaagttttgaagttcatatataccctaactaacccctcttcccaatttctttcagcatccggtctcacacacattcttgattccttatgcgaaatgaaaagctttccaaattctctttgatgattatactcaatataagtagtgcatttggcgacggtctttctcaccgtagggaaacgaagcgtcgccgtcgttgcgccgccgcggcatcctccgggccgaccggcggggacgaggccggcctcctccgcctccgcgcagcgggatgaggccggtgccttcgccctcgtcgacgctcggcccccgccgtcaccggggcggcggcgctgtcgtcgccgaagaggccctcgccctcggcctcgccggcccaggagcgcccaatgccgccgcctccgcctcccgtccggcgtggctgtggaggggcgccgccgtgggtggatctccggcgcgcggccaacgtccgtaccgttggtgctagatccaacggtcatatttttcaccccattcgggagttttacaaggtaaaaataacacttcccaaaatttcgacaaattatcaacattgttaagtttccgtaagataggctagggttatcaaaatttaatagacattaccaatattcggcaacaaactaaatacaaccacataattattattttttatttaataatggtatgatttgtaatgacatgaatataagtatttggataggcccaaaaattgctctgttttgaattgaaatcctcttaaactttctttttgaactacatcgatttgtttccaaacaaaaaattctaaaattctctaccatttcagtttcatcctcctctctgcctacaaaatcaaaccaaaaaaaaaaaatcgagcaacgcatcattcactgcgtgtcgaagtaggcatcccaccggtggtcgtcgtcgtcgtcgcctccgggagggagcccttgcttgatcctcctgaccctctcgatgacgccgtcgacggcgacgtcgattgcgtccgtgaacccgcgggccgacggcgcccgggggtccctgtacacgacggtgggtatcatcctgatcacctgctccctcatcgccgccaccctcgccgcgctcacccgccggagcacgtcctccagcctcaccgtgccgttgcgcacgccgtcctccgggacgaacaccgagtaggcggcgtggtcccgcggcaggtgccaccggtactgggtgtaggcggagcccgggtggaagaacaccggcacgcagccggcgaggatggcgtcgaacaccgaccgccgcgtgtacgagtccccccgcggctggaggcagaaggcagcgctcttgaacagccgcatcacgttccccgggtcgtagcagtcgtcgcgcctcccgcgcgccccgcaccggagcagcccgcaccgccgcgaccgcgcgcactgggcgatgacgcggtcgcgcacgacgccgccgccgtggtgtcggtcgtggtcgtcgccgttgccacgcccggcgccggcgaacgcgaacagccacgggcggcgcgcgcggcgcgcgtcgcgctgccaggacgacacgtcggaggggcgccacgggtggaagtaggtcgggtacggcacggcgacgtcggtgcggcggtgccacgggctcgcctcgatgacgagcgccgtcatgttcatcgcctccgggaggaggaggaggcggctcccccactggctcccctcgccgccgccgtcctcgcggcggaagtcccacgcgatgcggccgccgacgaggaagtggtcgcgcccgccgtgcgccgcccacgccggcgtcccgcggagccactcggcgaggtcctcggcgagcaggtcgcggacgccgttgctgaacccccacaggtagcggccgacgtcgaggcccgggtagtagggcacgtacaccgcggcggcgcgcgacgcgtcggcggtgaggcagccgtaccgcctcatccgcgcgtggaagatcacctcgagggtgaactggttggtgtcgtaccacccggtcgccgggagcacgccgccgcgcgccgccggcggcagccgcggcccgatcccgccgttggcgacgtggcggcacatgtccgtccactccgacagcgtccggcagtcgcggaggaggtcggagttgaaccggctcggcagctcgtgcatgtacacgtacctcccggcgcacctgtccctcctcgccggacgccctcgacgcggcggcggcggcggcggcgacgtcgacggtggtggaggtgacgcgtcaatgatcggcggcggtggcggcgtgtcgccggcgcgttgcaccggcaatgtgacggccgggaggaagccgtcgcggcggacggcgacgtccggcgacggcgaggggaagaagaagagcacccacacgacgcaggacgccgggatgatcagcggcgcgaggcaccgccccgtcgcccggagcgccgccgccgatccatgcgagccatccatggcggcggcgggaaccgccctcgccggccgccgatcacgcatgcgtcgccggcgttgccggcgagccgctcatcgtacgtgttagctgttcgacaaactgatcgaattcaacgcgatttcttctttctaattgcagatcatcctccatcaatttccattttggattaaatctttttttccgtacatgatttcgtataggcgtttcatggtaaacacgtggttactggttagccacccaattttgattttatttttttattttcgaatggtcatgccgttgctgacgttttatatatataaaaagaagatatcccattttaagaagaaaatatgatcagaccttacacagttaatttattttattttattgatataatcgttgcagtttggagtgcttttctaaggtttgagacgcatgcaagcgtacgaattggcagtgctaattatgggatcattatgcatgatggttgggtgcaggttaggcatgtttcttgaaaccatttttgtgtttggattgcgttttggttatgaattcattcgttgtgacttgaatgatctatagtttgttattcagaatttacagggttttttttttcgatttggtctgtacgtcaaccgtcaactgctatataaaacttgtaagttaggttttaattaaaatttaaaattttggagattggttattgttccatggaaaagatgtgaagattattgcagtcataaaagtcagttgatatcttcagcaaagagatcatgaagagaccttgtttttattttagttttccaagtggaaatggtcagtaaaccaagcaattaaccaacatagtgtgtttgtaacgccacgtggcacagtagcagcaatatccgtgaattagaatgctcagattgagaatgtgaaatatgatatgcttgattcaaatccgttttgatgaattgacatggaaagcaactgatggttttaagatgaaattgaaagaaacatgcatggattcaatttgtccctgcaaaagtgtatacaggggtagtagtaatcagcatatgcatgcatggatagatgacgattacccccaatctgaaaaaaatgaaattactgtcaaactcaaaccaaagggttcaggttttaagctaacacattcaaacaagcactacagggagggatacagggattattggagtacattgctccatcataaccatatccagcaaatatatatatatagatatgtcaagttatcaactggtactcatatttcagcatagtagatcaaatagtcgcagctccaactttttcacatatcacattagtaagccgcaaaatgcatagaacaagcagtaatattaaaatgcagctttagctagcagctgatcattgctaagcatcactgaatgacagaagtgaaacaaaattaggggtgcaggattagtagtataactccgtactaattaagccatcaatagcatgtttagatttcttccaagttccaacaccatcatcacatgacccaaaagaaaagttcagatttttagagtgatgatcaaccatgaactcttaactactgatgcactgatcaactaagccatatcaccatacttaattagggttcttccagcatcacaaacagattcagactccacactgaaaccatccaatagatgagcaagtagtagcaactactaataacatgtatgtatctagagcttcctggacagcagatttcttcatcagtcagaggcagaatccgtgtaaaaagcaaaaaagaaatagagatgggaaacaaaggtgtcggtggcgaaaagcggcgacgctctcgcgcatgcggagcgtgataccgagggcggtctcgcgcgtgcgtaccgcgataccgagcctactgtcgcgccctcgatgcactcgctctcgcgcacgcgtagagcgagaccgcaagcggtctcgcgccctcaaagcgcgacagcgctgccccacctcgctcctcgctctcgcgcacgcgtatagcgacaccgtgttcggtctcgcgctcccaaagcgcgacgccgcgggcccactgccctcccccaggctttctctctcgcgcgcatgccgcgtcagcagtctcgcacacgcaaagcgcgataccgcgtgcccacgtcttccccgtcgcgtcataactggtctcgcggtttcatattacgaaaccggcctcggtctcgcgcaacgaaagtgcgagagcgatggctccgcccgaggtagtcgtggggatttctccacgtggcgctctcactcgtgggaaaagcgataccgctgcggtctcgcgtctcgcttgcgcgagagcgccagctcaacttcgctatcgctctgtcagatcgcgatttcgccacgctatcgcactttcaacgagcgaacatcggtatcgctattccaaaaagcgatactaatggtttatttccgcaaatcgttcgctatccggtatatttttgcacaatcaattgataaacagtataatttcaaaaaattttcgtccaagttgagcgctaacagtcacaacgaccctctgatcagggtagaataattcaggcatcaatgttgctggaaactgctgttcttcaggccatcaactacaaacacttacttaacatcaaagcactcagacattaactataggtctcatgtaaatacatactatagcatgtaatgagctgggtgcacaagcagtacagtggtcataagccacaacttggttttacaaaacacaaaatagatgtactagtagtagtagtagtagtagttcatagttttccatccgttgcttcatacgatcaggttcttcaggattcctacttcctagtcatgacatttttacaaaagacataagcaagctaagacttccattcttgctcaggaacttcatggattagtcctacactgcccccaaaactcagccctcaccacctgcaaaaacaacaatatggcgaaatgagctcaacgtataaatattcttaaaaatataaatgcatatacattgacaataacatgttcttgagaactgatttgtgggaactaaaatgaacatcaaggcaaaggtactggagagtgtgggtactccaatagcataagttgaagaatgagcagtcccatttctagttactaccagaaaaagtgagagtcaaggattttattcgtagaaagaaaaaggtagtaaaattcacaacatcacgcagtaagaaattgaagtgaagtttacaagttcattcttgcaatatacccttgtgttgttgtggtgccaccagcaggtcaacttcccctgcagtcacacaagcatttttccttataagattttatgggggtgaaggaaagtgtttcatataggctgcaatgtttgacgtagcattcactcgtcgaacacttgatggtaaaagaatggcggtaggtttcagcttctaaggtgactaaacataatcaaagcgagctaaaggcctaaaactaaaaaaaaaacatgaaagtaccattatgctaattttcaaaaattaaaacttccatctgctagttgtaaaatgtaaaactgccatctacttgtgaatttctgatcagtgctagaaagattgttgaccaccctgatgagtgatgatacaatcagttaaccaccagtagcaatgattttgtatcccacattttgttactataaaaacaattgctaccgaagcagtaaatatatgagatcaatcagcaattataatccatggacattgtacctgcgagacttcctgcgcttggtcactgtgagttgcttcacttgattgcaaacgtactcaacacactcacgcagggtggccttcctcccatccttgtagttccacagctcata

SEQ ID NO: 69168 - DNA, 2505 bp, Oryza sativa
ccgccacgatgagtatagttcatacgatgcctcaccaactggttctggaggtagcttagcaagacatgcaatctggaacaccttctcattcaactgtcccatttcctttatcccaagtttccgtccaccgttatcaatgtcaaggaatccctgaaacaccaacatgcatatagcatcacctctaatgccacactttaatttgaccatacaagaatttaggcagtatctataagtatcatcagagaaattctaggagtatgaatcaaccttgatcaactcttctctaactgcctccaggtcatcatctttgctcaccagagcacctgaggcttccccagcattcgggtcactcagatgcccttccattaactgaagctcaccaggatcacctggaagtccttgagataaatgtttttgtttctgcaccgatcttttcttgacctgctttcatatcgatacttctataagcaatatagtagcccagcaagaaaaaaacaatgaacataaactgactgcaatgacaaataattagcttatagatttggtaggcacataatgaaaatatcaagaattgagaatccatattctaaacaaaatgttccatacatcaggagttctcatcgattccaagcaacgtggagattggacattgatttgactcgtatactcttggtcatcagcctcacagcccgaaggtccttgcaatggccttttgcgtttttgcatcgatcttgtttgcacctgctccaagcaaaaaaaaaatgctagttattactttattagtacaaaaagtatgctaaggcatgatgtgaaaaatatagacatttgtgaggtgttaagttacatggctaaataggaagaattaaaataagttgaaaacataatgtggttagtcaatgccatgaagaaattatgaataatttgggggcaggaactatagattattacccctcttggttgcataagctcaaccacaatgccgctctgctgctcagcctgaatatttctcgcttcactctcttgaagctgtttctttacagactctagctcattgttctttcgagagatttcctcttttgctgcttcgagctcgttgtttgctgccacaagctcctccttcattgcttccagaagtgcgtcatttcctgccataaccatttcaagttacatatgacacctttactaaataatagttcaacattggaatcgacgaagcacaacattattcgtgagaaggccacgaaccacgctgttcaagctggaacctctccctctcctctgctatttcagcaaccacatttttcatgtccatgtactcaaccaacacatccttgagataatatatcttcgagtccaccttagaagccaatgccgcaaggcgcccacccacgcctctggtctctgccatgtttcctgcaggttcaataggcaacagaatatgacttgacagtcacttgaattttgcccaacttatgtgcatcaaagtaatgaaaaatgtgcatcaaattcaacttatgtgcatgattaaacttatttgcccaactttatgtgcattatactgctagtgtctaagtggaagcaaacccaggagactcaatcccacaaccataagcaccaagaaacagcccacacacagtccaacaaaattggtgagcaacatgaaattgttgcagatgacattaaaaagtaaaaccctcaccttaccaacagccagttatcaccaccagtcctgaagcccacctgtaaagattaaacaatgcagtaggaattagtaaactggaagggaaatcaacagcacataaaacaaaataatatagttgaaaaaaaccgcaggagtcacatcgaaggattcacaagaacagaagtgaaagaacatgcataaagcgagttccatcgaaccaaagaaacctacaagaagcaaagcagtggaatcgatggttgcaaagaaacgcagagatccgaccgagaatgcaagatccgcacttgctcttcagagagcagcaagaaaacaaaaaaatccgcaactcgttgcagatgagcattccaaaaagaaaatcaagtttgcaaacaaagattttctttctaaccaccaaaactgagaaaaaattgaacaagtgaaggggaaaagacgagtattttcttccgcagacagagaagcaaagggcaaaggctcaaacacacacaaaactcgcttcatccatgtgaagaacaaagatcaaatcaaatcaaccaaaagatccaagaatcatatgaacccctccgatctactacctagcgcaaaataaataaataaatcaagaactgctctacaaagaaatcgattcatctgatggtctgaatgtctgatcatccccaaccaagaaggcaagaacagtcgcccacaaaacaaacaagatgagagagagagagagatagaggttccgatcaccttccatccaaatcacacaaagaacccaaaaactcgctggaataacaaaagcgattgatgcggtgctcaaaggttgg

SEQ ID NO: 69169 - DNA, 12137 bp, Oryza sativa
ttcttgcacaggagaaagagagaggagagagatgcacttacaccgactcctagtgctctgatggagtgaaactgtgaaagaaaggtttccagtcccagtgccatctcatggactatacacagctgtccaaaattgggacccacatgtcctggactgtatgtgggccccacacatcacgggctcatgcagaagttacctgcagtgaagctctgggggggaggctttcagtttcagtacagacagtttcagtcaggaggttcagtcactgatttggtggggtcagagtgttggtgggcccaacagccagtgacagtaaaagggaagcggttggttctgatgtggaactagcctgtgggtcccagttgtcatacgtggatgaactgcaattatccacatatgacttctgctttttgctcatcagaaagttcaacaccgttcagcatacggttgtcgtgatctgcaactcatacagtcatactactacctgtggcctacaagtgtcctgcacaatcatagtcgtagcaagcatgaatccaatatgttattgagggcattgaaatgtttgttttcgaagatagtagcaaacaaaaagagaagacaatgacattttatacattgggtacagattaatacccaattaataccaccaatgctactctaatagggcaatgtatagggcaacgtatcctatccacacgctacctctaatgcacttatgcactcagtcattgtaggccctccgattccaatccaacggatacaaactgaggttggcatatttttgcacgaaaccgcccacacccctccacctaaatttagaggtaacacctcacttggctttcctcttctcttattcaacatttttcccaaatcgatcaccaatctccaccatgctgtaggaatggatgccggcggcatctcgaatcacccacacagaggcacgcagggcctcgccggtggtgcctgcgtcatggacaccggcgaatgcgtgtctatccaggcacagttggatgttgatctagccaagctcaattaggcatcacggcctggctggcctccaagcagcgaccttgccgaggagcaaggcagtttccaatcgattaaaaaacgagaagagacatcgagagattgaccaggccacaattcatttccagtatcgtctagagcgttagcatcatctgaataataccaatatattttacacccgatgctattggcatccgagaaaaaaacaaagtgcattcagttaaaagcaaaggtaaaaacacaagtcatggattcatcctagttaatcatccttgacacaatcaaacactgtgtgctaagttgctaacgacctggaaagcaataccctgagcgtgtggcatgccgtcagcgtgaccctcgccgttgtgaagacgatcaccacaagagtcctatagatggcaaaaccagcccgcgagccgataacaaccagcagctgcgagagatagcgtctggaaagggcacagaacggccattgcttgcccgctcgcctcctacaacaggaggtagtgcgtgccctccggcgtgggctgcatctccagatgctcgtcgcgccccccttcctacatcatgctgaggattggggatcgatttaggaagaaggttgaacaagagaaggtgagagccaagtgaggggttacatgtaaatttaggtggagggacatgggttgttttctgcaaaaatgcaccatctcgatttgtatccgtcggattggaatcagatggtctagggtggcggagtgcattagaggtagtgtgtgcataggatacgttgcccaaattatagttgtgcaaagacagactcttctagcatgagatgtgcacctacttcagctcaaaacattttgctgaaactgatttctcaaaaggtctggccgctaataatagttcatgacaagattcatccatgtatagtttaattacctatcttagagtgccatctagttcctcctaccaccacgtcctcttttcctgcatatacacaggcatatttctttaaaagaaaaattgtgaaaaatctacgcttcaacattggggaatcaggggttttctctctttattcaacaatgatgagagagagaaagagagtgagtttgtgtcctgctttttttaatatatatatatatatatatatatatatatatatatatatatatatatatatatatatatatatatatatatatgaaagttgttttaaaaaattatattaatttatttattaaaatttaaataattaatactttttctctccatttaatattataagtcgtttgtcagtggccacgctgatatgtgggtctcatgctgactcatccgccacgtcagataaaaccggggtcaaaaccaccgaatgatctaaagtgaacggttttattagttgagggacacccggtatttctgtggttaggggacgattttgtaactcgatgataagttgagggaccttcagtatactttttcctttattctcttctcaaaccagtgtacacaccagtgtacgctgtgcagcccaaacatatgggccgcaaggaggaggaggagggaatcccactccgggccaaccgtaatggcccacaattacgacggagccccaactacatgggcctcaaagaggcccatgtaatcgaaagcccataaggcccacccacttctctattactatctccctcgcgtccggccgcggagacctcccgcatccccccaccgatttcgtcccctccggcggcggcggcggcggcggcgcacggcttctccgggagctctacgcggtaactctcgccgcgctctcgctctctctctccaccccatcctctattcacgcttgttcccgtgcgtgttcgtgtggtggtcatgcggtttccgcttgtcgccgcaaaccctagattcagaggtggctcggatgggtcgcatgattggctcgcgttgattcgggtagcttgacctaattggttatttagtggtaaatatgtgaattgactgaattcctttggtttggggatgctggttggtggttatttattcgtacgcacaggtttaagggttagatttatatataacttagatgtggagaacgtatagcttcgtttgttgacgttctgtacgtgggttagttttggagtgcatgagaaacttgcgttagagatttccgttgggaggggaatattttttttatctaatatatcgatcattctcttactcctagatatattgtattgttttttcctatggataaagtagtacgggaatgtcatggcatgaaaatcgtgtttggcaatttggcatgctactactatgattgtaaactttggttagttttgcaatgcatgaggaacttgctttacgcatatctgatgacctgaatgtatataaactgtgcggtgtgttaaagtaagattttaattgacgtagttttttttttctggacttgaaaagctctgcaatgtagtcttatgcttgcaatagttggcccaacatattttctgattatatttccgcttttctctttgactctacacttaacactttcaagggcagtaattttctaaatcttgtgcctatacgctaattgattcgctaatttctctcattttgttccatccgtcttctttctgttaacattttctgttatgtgcttcagacaaaacaatgaggaggtacagcccaccatatcgcagtccccctaggaggggctatggtggcagaggaagaagtccccctaggaggggatatggaggacggagggagcagggttctggaagtctcttggtccgcaacatcccattaagctgcaggtagtgaaaattgataactatgcaaaattggcatgtcgattccattttgatgactgtgttcttcatgaaagagacaaatgtttcaattcacaagttacacacttaattcaatttcattgattaccttaactgtggcagaggggaggatcttcgagttccttttgaaaggtttggtcctgttcgggatgtttacctgccaaaggattattacagcgggtaaggcattactgaacaattatattaacataatttggtttgttagttgtcaattgctgaacaacatttatcttctttactctagcgtagtaaatgtagattgtctatatttgtctgtgctgttggcctgtcgttgaaatgattttagaagctgttctgatgttatgcagtaaaccacaaatataaccatttttttcatgacgggaactctcagcaaacatcttccagctttagtgtgttgtcgaattcgtcagtcacctttgtgcatttctgctcaaatagaatgctttaatcatttttttttgggtctggtgatctagttaatagatttattgttgtctcaagacatgtaatgcactccttgccctgagtttttcccctgaaattattcccagggtcatgttggattgaagtaaatacaatgttgaaggataccttttaatattcctaacaattcatttgtttggcaagataaagtcttttccgtacgaagttcttctatgaagacaagatttgtttcattgagaaaattagtttcacgaagagaagataagagagttgtactgggtggtccatgagaagataaatatgaagtgaagtttatttgaagtactatcatgacttctcaaacatttggaaacttgaagcgaatgattttgtgaagatactctttatgaggatcaccatgcgtagtgttacacaagaaattcagatactagagcctggacatctaactgcttttgcatcgagaatcatagaggacatattgagttttgaactgtaatggtaacatgacagacacaatgctatacatgagcactttacaccctcgttatggttaggttttttcatcaatctgctttaaactaccttttctaatataatcaacatttacagggaaccacggggatttgcatttgtggagttcgttgacccttatgatgcctctgaggctcaatatcacatgaatcgccaggtgtttttcggccgggagataactgttgttcttgctgctgagtcgcggaaaaggccagaggaaatgcgcagtagagctagagtcaggtactttattcccattattgttttgaatgtccagccttatcttctgtcatgtgctcgtttagtcgtttgcattaacgttatgtcattgtgtgcttgatttgcaggggttactctggaaacgaagggcgccgctcttcatattatggtatttttagcattagtcattatttgtgataaggcctttcaaaatgcatatctataaatctatgccttttttaactgtactgaggaaatatgctctcgtcttatcacaacaaaattccttcagtttttctcgagtttcttctgaaaagttctgtttgctaattccttttgttgccacaccaaaattactgataggctttattgtttcatacagggaggtctcgttcccgttctcgctctccccactatcgaggtcgtccacggtcaaggtagatgaataatgtccatatatcaatcctcaagccattcaccttgtactcatgaatccggtcgcttttaaaaggtcatactctcctgctccaagacggcgagatgactactcagcttccccaccgagaaaggatacgcaccccacaaaatctcctaggcgtcagccaaaagaacatgatgaagagaagaagcggagatcctactctcctgccagtagagatggcgaccctcgcgatgctgataacggttatgagaagtaagcatagtatttcatacttccatcactttttccttaaatgcaatatttgttttcattattgcaatagggccatttacacaccaatctggtgttttacgagtagtaaccttctgtagacttgtaaagtatgatgaatatgaaaggatgtgggccttagggtcacttgaactatgggcagcattttaatctttgctgcatactcacgacagattttgttagtcttattctgtattaattaacaggaatacatagagtgaaagtgctaactatggtttatgttcttcacaggaggtcgcccccacctgacagcgatggatcccctccacaccggaggtctcctaggcactcctcagggtcgcctccaggatcccgctctaggtccgccgatgtttcccctgcccgcagcgactgacagaactttgaaccaacgaaatgggatagctgcatgatctccacagcacctccaattctagtcagtctccatcttccttcctggtccaaccaagctgtttcaattaaaccgaagccctaagcggcgtgttgtattattgctaagtgtgcttgccatgagtttggtatggcacatcgcctgtttgtgtgctcatatgttgggagtccaggatgttgtagtcttttgagagctgctttgtttggtggtcatttgctttttgctgaacattaacttgaaacaatgtgacattggtgttgtgtactaccactagtgagccttgaactgggtaaccgcctatttccacatctatctatgcttgtgagtgcttagcccaggggcccatgctgccatgccaatattgccatcgactttgtttgggaaaaagcttttgattggatctaccactgactgggccagcagtacactacactgcctctcttttcttcctcacactgcaacgattggattggacttgtgaatgcagcagcatcatgctgctgctgcaaacgcaatcccttttaatcatggagcaattgttgggttgcaggtgatcgatccatggcgtgcattgcttccatggttgttgtcaatgtttgcaatttactccctaaatgtttgacattgttgactttttagcacatgtttgatcgttcgtcttattcaaaaacttttgtgaaatatataaaattatatgtctatataaaaatatatttaacaatgaaacaaatgataggaaaagaattaataattacttaatttttttttgaataagacgaacggtcaaacatgtgctaaaaagttaacgaccgtcaaacatttcaaaacggagggagtatttatttatttatttttactttcatgatgcagcagtgaaaggcaggggttggtaggatgtgtcacgcagaaagtgtactgctttttgtgcgtggttgggtttgtgttgtgttgcttgattgcaggcactgcagatacgtgggctttgttgtggtggccggcctgaaaagttgacaaatctgtctatctgtccgctgctgactgctgtctcatctttcggctgagaattaaaagtggcaacggttcatcgccctgacgaccatcgttgatcgatccatcatgcaacaggatatatatactgcatgagtactggtactcgtagagtcgtagtgtatttctcggagtagcagcatagcatactcattagcatgctgggtaacgattaatctaggagctgtccgatggcaatgatcgggtgtatcagacccaccaacccccccccccccctaaaaaaaactgttgcatctaaaatttgcagaccttttcttttattttttatggatctcacgaaatgtactagattcaatcaaattttatattcaaatattctaaaattttacaaaattcagtcctatcggttttctccgatagaaatagcctaaccaatactacattaaaccttggtctacaccgatcataatcaagtagcctttccctcgaggacgcaaatcacacggttataggttttttttccctcaacccacacctagggtttaacttttcggcttgaccgattgtatcggaggtcaccggtagaccgaaaattaggaatttttgaataaatattactaaaattcacgaaaagttaaaactttttaaatattttggccaaaataatatcgtaacggaggggtccaaaatgactgaaatttcagaaatcaaagtccgaaatttccaaccttgcccacacctactccctccgtaaaaaaaaaacctaaccaatgacttgatataacataggacaacgaacatgtccagtcctatattatatcatatccttgtctatgttgtttttttttatgaaaggagtaggtgggtaaaatacactcgatgggtgacctagaccatgcaaatagaaacaactggataaagtatagcacatatgaacaatcaatagtttaagttaacaaaaataaagagcacacacatatatataaattgaagtgcaaatttaaccattatagtgtatccaattccacaagttcaccacttaatttaaaaggtgtataaactattctagattctactttatactaatgcatgttcatgcttcatacaaccaatagtatgtatatgtgaccattcaattgttgtcgctacatgagaaagacttctctttatctcatttctttaaccttattggttcatcatccttaataagctcctattgtatgaggaccctaactcatttctttgaaaatggtgtatccaattccattatagtgtatccaattccacaagttcaccacttaatttaaaaggtgtataaactattctagattctactttatactaatgcatgttcatgcttcatacaaccaataggactgtggagaacaaaaggccattgccatttgccagtttgtcacataacaatttacaacatgtcataatatatattcccttctatatcttttgtatgacattgacgaattcaattttgaacaaaccaacgtcataatttaaagggagaaggtactgtatgctatccatttaggatatgggtgtgactattgcgaaaccataccactgataccaacgcacatttctcaccacttaagtgttgtttttattctcgttgaaggtgcatccacaggtggatgaattgacctatcattatctaaggttttgttcgattaaaccctatctcaaggggatttgaaggatattgattatacacttctcactatcccctccaatctattactcctatgaaggctttgttcggaggcacttgctacggctgcggcaattcaaatcggctgtcagttgcaaccattcacaactgctgcaggctacggtagctagtctagctaaacgcagccgaattaaccaaacaaactctaatatggttaagggtttgggtttgtctccattttgatcatttttgaagaagttcacgtagtagtagtacaatactaaggctgtgtttagatccaaagtttagatccaaacttcagtcattttccatcacatcaacctgttatacacacaactttttagtcacatcatctccaatttcaaccaaaatctaaattttgtgctgaactaaacacagcctaaaatgaggaaaaaaaaggatttgaattttttcaccctccgaggggagacgcgtccggtttacccggggagggaagaagatgcagaggcgcagagcaccaatgcatatgcagcagctgcaggcggcagcagcgaccacttgtgacctgcactactacacgtcctccctcctcctccttcctctgctggcttcttgctgatttggtgtgatctcttctgatacgcatcaacacgagaagcatcgaatcgagtgtacatgtacagtagtcgacagtactactacagtatggacattcagccagctgcatcgatctgcgccgttggatcgacacgacgtgcggcccggatgcatctgtcggtcgtggactgtagcaaaccacagccagtgatgtgatgagtgatcaatcgatggatctctatatcagctgacctgatgcgttgggggatccaaggttactactgcgcgtgtatggatcaatctttggtggtagccagggtttacaaaaccatcttattattacgtaacattctcagttttttaaaccacggcatactttgttgtaaccgtaaccgtgcggttaccgtaataaccgtcaaactatagagtgacggtaactctacacaaaacagtttgacgaattatggtggtagcgtgtcctcttgttttctagggaacgaaagatgagagagttggttagaggggtccgtccattggagtactagcttaatttgatctcgattgatacttgcaaaggttgatgtttaatcatagattcggtcctcgatctaataacaatatctaacccctctgctcaatctaatttagtgctagtacatgtatctatctggtcccgttgcgtgtcttcttttctactactgctcatttgctttagttgtgttctttagttcatcggccagctgaaaaatgcttttattttcttagaatccctgccgtttaatttgaaaatgatgtgaatctgaacatatattcatggtagttcatacgaaattaatagtggtcttcatataatgaagtttactgcattacttaggatgcatccatttggaatggttgggatctcctcttctgccgtacgtaaaatgggacgagtcactagcacataactaattaaagtattggattaaaaaaccctgaaaatatattaatataattttctcaagcaacttcatatataatttactagtgccaaaaccgaactgtttagcgatttgaaaaagactgagttcctgcttgaggttccaactctcctccctcgtttttttttgaaactgctaaacggtatgtttttttttgaaaaaaaaagtttctacgtagatttgttttagaaaattatatcaatctatttttcaaaggaaaaaaatctaatactgaattaatgatgtatttgaccggtcgagcgtgtaataattagcccgggacagcagtcgcgggagagaagccgatggagcatgcagcattgcagcggcagaggaggtgtgcttccttccacagtactgtagacgctgcatgcgcgggtggcagcgatggcagcgcaggaggccggagatcgtggaggatcggagtcggagagagagggaggaagaagagacaagagaagcgcaccgccggcaatggcatggcatccgcattgcttgtcgatcagccacagccacaatatgtcgcgccggccggccggccacccacacagggacgcactacaacagaaacagcctatagagacggcttgggaaaccgtctttatcaaagcccacctcctatcccactctattactagatacagatggaagagacagatgaatgaaccgtctctatagttaaattaatccgtttgatgaaaatttgataagacgggggttaaaatccgtagacacggtccttccgacgggtgtagaaaaaccgcgtcaaacgcgtgcgaaaagatttgtttttggcgcccgttcgctaaattttttaaatctacgcgcgttttctgatgaagttcgcgggatatttttcgttcactcggaaagtcggaggtggttacgatccaactaaggtacaaaaccaatctattatccacttctttcaatctttcaatacccaattcctaggaacgccgcccagccaccgcccaccggcagggctccagcctgccgtgcgcctgcagcattgccgcgccccggcgtcggtccggcacgtgcatcctaccaccagctccggcgcgcatattcgtgcagccgttgcccagcgcgtccctcagtggtcgtccagatcacatttgctccacctcggtcgcgcggacgtccctacagccgtcaggcagtgcgtcccggtagcgatcgtccagatcgtatcctgctgaagctgtccaaggtaattaccgcttcgcaagctgcagccgccggcatcatcacttgtttgatttgttagtagcaagcaggcgaggctaccactttgttgtttaatcggctaccactttgttttttaatggctgcacagtgtgcacaccaattgtttgatgattgttctacacaagcaagtccagaaagaggttaacgcactattttttaattattgtaaatcaagttttgatcaatttagatgtgaacggcattgatgcatcggtatgcaagcacccaaaatttggttgccaaacacattctcgttaacctgggcactaatcatgtagatctaatttaaattagtaacgtaatcttgccgttaatcacattctacgtaaatgatcatttcattttacagagatggcggtgtatttcaacatctctcatttcgtatgtatac

SEQ ID NO: 69170 - DNA, 2823 bp, Oryza sativa
tactccctccgtttcaaaatgtttgacaccgttgactttttagtacgtgtttgaccatttgtcttattaaaaaatttaagtaattatttattcttttcatatcatttgattcattgttaaatatactttcatgcacacatatagttttacatatttcacgattttttttaataagacgaacggtcaaacatgtgctaaaaagtcaacggtgtcaaatattttgaaacggagggagtactatcgaggtgatttaccactgctcgtgtgactattatatggaaattgtatactgcatatgcttttgtgatcaaagttatgttttcttgaagtagtaaagacttaagcaaaactattcatagatattttggttggctaaagttattcatagacacagattgtgagttcctgttcatatttatagtaggattaatttgcactaaaccatagaaaggatatgacttaacaaagaagaaaaaaaaaacaaagatgagaatttgttatgaagggtaaattttccatttatcaacttgagatatgaagatttgcatgttctcattttggcattttaactgatatgcaacggttttgttattaataacattataatccattttttaaatatagtgcaaatgataacaaggtcccaaagattacaaggcttggagcttttggagaatggagtacaaaatcaagaattggtcccaaatgatcattatgttgaaaaacagaacataacaaacgcagattggcgcacaaattgctatgagtattgtaagatgtatttgtttattcgcttcaaaacttgtgcttacagactaacttttaaaattttacagatcctgatggccgcattaaaagatgtcgaggaccaactaaattggcaaatattgaaaatcttccagagggtgttaagattattgtcaaactggatcgtttcaatataccttgctcccaatctgctatagttcttggatcctatttaggaacacttgtcaggaagccacatctagctccactgaacattcttcaatggaatcataaactttataagagagcatatcatccaaaaatgatttctgaagtagaggtattgctctttaattttcacagctttttaaatcatattcttatggtgattccaatataattccattcactctttatttttcatatgcactagagaaagcttgcaattgatagaagagctaataattggattctccactagttagatggcaaatggaggcagtacaagtcaaaactgaaaaggggctattacaagcctaacttacctatggaacgagtattgcaaaccgtgcccaaaattgttgctaaatctcaatgggccaccctagtttcttactggtacttagaggactctaaggtaaatatatgttgggactttttagtgactgaatgaccatcattttgatttatatcagctcattgatgctatatgttgtatcattagaaaatcagtgacaaaacaacgagaatgcacagaatattaagcatccacacatattaggaagaaagagttttgcaataaagaggaaagagctggtaagattttaagcaattttcatatattaattcactattgcttcaattcctcatgcactaaagatgtataatctgcaggaagttaatggagtggaggtggactgagcaaccttctttgatgaatgccataagacgaaagatggcagatatgttaacgatgctactgaagaaaaaatggtatgccatattgcttttcttatataaactctttgtaaaacaaaatacactacattaagagtctacaatcttttccaacgtagaatgaagtatatatgaaattggctgagaaaagagtggattgccaagaactcagtgaagctgattttgaacaagctatgttagaagtgcttggaaaggatcataggggtagagttagaggcatgggtccaaccattactccaacaaactattatggtagaagatttttgaatatatcaggaagcaatgaagggaatggctccagtaatgtaaatggtttcattagttttatagtatcatatttgactgagaaatatccagaggataatttgatttctaggttgccaccatcagttgctagggtcattccaagacaagaggtatggccacaaaattactaattttaaatgttgtaacttatatagccataagcttccagaataacaaattcatgcatgtatcttcaggttgatcagaatgaaggaagtcagccaccaaatactgctacatcctctcttccatttgatcagaaccatgaaaatcagctaccaaatactactccatcctctagtgctagagcatcatctcagtcttgcagtgaagaagagtgatttacaatggcaattgtaccattccgtactacttgctgcattagaatataattattttttgtgttaatttgtttgaacctattgtttcattgttatatcagaaaagatgttgaagtattttcattgtgaacaatgtatagatattgcttttgattttaatgacaagctactggcgttaaaagtcttgttaatgtggtctgatggtaattcaatctgttggtattgttttgtttatgggttttctgaatgaaagatgtattgattgttggcatgtggccaatagcggggttataaataataagtgtagatacaggcacaaccgtgtctatagaagcagaaattgtctctaggaaagaaataagtaataaattcattatgaatagagacggttgtgaccgtttctagagaaaacgtagatgtatctactataagctagacatggaaacaaccg

SEQ ID NO: 69171 - DNA, 1743 bp, Oryza sativa
tatacctcgaactattaaaagtgcttccccatattgtctaacagtatttctttttttttcatatctctacatacaagtcatatatgtttgtttaactaccaatcttcgttgttaactttctcgatatttgtgccgtgcgctgttgtgccaatgccgtgaaccagtgactatggtttgtgtgcgttgtaccaacacctaattaaggctagctctgccgccccatctgtattttaaacccgcgtccgccactgataccatgagaatttggctttatattagtagcaatccaaatgctagctaaatactccctctatttctaaatgtttaacaccgttgactttttagcacatgtttaaccgttcgtcttattcaaaaacttttgtgaaataagtaaaactatatgtatacatataagtatatttaacaatgaatcaaataataggaaaataattaataattacttaaaatttttaaataagacgaacgattaaacatatttaaaaaagtcaatggcatcaaatatttagaaacggagtgagtaattattagggatgcaagtgggtagtcccgctacccgcataaaaacatacttggtagttcattttccacgtggtagtacaaaatttagaagaaaaaatgaactagaaatgagataggcagactaaaaaaacccacttgcatctctaataaccaaacaagcactaaatctagaactgaatgtgacacattctaatacaacgaatctagataaatatatatttatatgtctagattcattgtatttagaatgtgtcacatctagtactttatttttttataggacggaggaagtactccagttgagagagagagaggggggggggagagtactccctccgtcctaaaagacctaacctagaaggagatataacccctcctagctataacaataaatttgaacatcccgaaccattgtactgggagggtcttatcccattatagaaaatagatcttctgattttgagagactgacacaagaattttatatcttgggaatccacgtatattaacaacccatattagaagatactactagcagtactatgttagagaagtctacagcatctgctatacgaagattaagtaccgggacgcaatacggaaaagccactaatgtatgattaattgagttttgattatttcaattgagttttaaagcaccttttacatagtactcaaatttgaaagatgtgctaacagataaatttgagataagagctgtgtctaaatcaaaaaataacggacatggatcctctgcggaactgtatttgtagtagcagtagctgatagttggacccgatcctacatgtcagctgctgctactacaccggtactactgcaaacaatctccaatgaaaaaaaaaagaaaaactgatcatatgcagtggtcagtggagtggccctagagagagagagagagagagagagggagagacgagcagaggggtgatggaccgatggtgcggtggtcagtcgctcaccggtcagtcgcatcgcatcgcatcgcatgcatggacgtggagtaggctggcccgggcggcctgccacatcgtgccgccaaacacggagtacacaccgaccgcagcccgtaggcgtaggcaatggcagtgccagcgacgtcctcgatcggttgcgtgccatgccacgccacgccatgcagaaatgcagatgcagccatcggaccagtactctccctccccagtc

SEQ ID NO: 69172 - DNA, 6772 bp, Oryza sativa
gaagaaaaagtttggaactaaactcggccgtaatagaaatatattaaggggatatttagataagggttttggcgtgtcacataagatattatagatattatatagggtgttagggcactaataaaaaactaattacagaacccgtaaataaaccgtgagacaaatatattaatcctaattaatccgttactagcaaatgttcactgtagcaccacatgttaaatcatggagcaattaggcttaaaatattcgtctagtaaattagtcgcaatatgtaaaattagttatttttagcctatatttaatattttgcaggtgtttaaacgttcgatgtgataggatgcaaaattttagggtgggatataaacatgccctaaaatttaaattataactagaaaggtagtagtacgtttatttagaaatataagagtatatattctagtaattcaatcttattttaggtttggtttttctgagagaatgcgagtacgtgccactacggatcgagttggcctgctagcagcagcaaagcatgcaggccagccagtggccctgtgcgttgcgtacgtgtaggtcagtacggtgtgacccgcccgatactactactgcactgcacacactccctccgtccgtgtagtactcctacttgcttcctcctatggaaaaaaaattctaaccttgctacccgtcctaaaataagtgcagccgtggatatccatacccaacgtttgactgcccgttttatttaaaaaaattgtgaaaaatttaaaaatatttagtcacacataaagtaatattcatgttttatcatctaataacaataaaaatactaatcataaaaaattttcaaataagacgaacggtcaaacgttaaacgtgaatagtgcaaaactgtacttattttgggacggatggagtatatcataagtactataaatttaaacatgtagtagtaggagtaactgttcagattcgtagtattagaatatgacacatctgatattaggttgattgagaaatatctaggggttttccgactatctccacaagttgatgggctaggcaatataggttcgaagcttcactcctactaattatttaatattaggtcattctctaatatttgcgtctttgacaaggttcacaattccgacgaaaaccgatcgaattccgcgaaattttgaggtttcgacgaggctcgaaagtagaagccatctgaaatttcgatgagtttcattcaaattcaaatttaaattgataaaaaaggaaaaaaatatttaaaaaaatcttataaatagaatgatattcatataacctattgggatataaatttttgaagaaattgatgtattccgtgtatttgctgaaatttaccgtaggaaagaaaagaataaaaattaataaaaggaaaaaaatcatttgatcactttttctaataaccgattgaaatttcgataatttcgctcggaattttatcaaagccaatcggttttcgcgagcttatcggtaaactcagggaatttgtatttaaattttggtttataaaatttgttcagaatctatcagctttccaccaaattttataaataccgtcgttccaccaaaccctgaaatggaaggccatcttgaaatcgtaaaccctgatctttgatactcctactacgtggtactcactatactagtatatctctgacccaggtgggccccatccaacccctccctcagtccctccctctagagcctggaccctgtttatcttcttctctctagctaccactaatctctcttcagtttttgtttggtttggtctgttctggtcaccgtctgcatgcatatggctcattcgatcgatcgaccggcgcggcgccaaagattcacccacgacgctctacctaccctgtctgctactgtcccatatatgctccctccgttttataatgtaagactttctagcattgcccatatacatataaatgttaatgaatctaaatacatacatatgtctagatgaatatggacaatgctagacaggggcgtactagctaggtggcaccgtggtccatggaccacctaaaaatttgaaattatagtatatgtgctagttaatatagtaaaaattatatagtggaccacccttttaattgacatattacatatagatgaaacacttttactttaaatcctagttacgccactgatgttagaaagtcttatattgtgaaacagaggaagtacatactacgtgtatcaacaccatgatgcacaccatgtcgatctgaacctttgaccatgtcggtcgagatgacatgacaaaacaatcctgtcacgctggtttgaatagtgtggcaatgttatttggtactatcatcgcgcatgtgtgtgagtcatagtatcataatgtcaaattcatagttactaggaatatcctaatacctatgtcagatttattatattaggatgttaaatttatagtgctcctagaatatgtacttatcagatttataatgttgaattaacttggtgtgtatttagttctttgggtgtaaagttttaagtatatgaatgcacatttgaagtattaaacgtagactaataacaaaacaaattacatattccgcctgtaaactgcgagacgaatttattaagcctaattaatccgcaaatgtttaatgtagcatcatattgtcaaatcatagcgtaattaggctcaaaagatccgtctcgcaatttacatataaactgtgcaattggttttttctcacatttaaattaatgccctatacatgtgtccaaatatttgatgtgacgtttttgactaaaatttaggccttgattccgaaatggagttactatttgatgcgttggtcccaaatacgctaaaccatgtttcttttttttttcgactggccatgggcaacgagtttcgatgattggcgtttccgtttagaaataaacacttttttgtgcttgcttgcgagcattggaatggcttgaatgaaatgaatattaagataaataaaagaaagaaaataaaccattgagaaagttatttatttttatattagtttcctatacttgactgaacaacttccaattccgttatttcaactacaccaaatgatcttttgaattagtcaagactcatatttatggccccttttatatggttattgttttattgaatttgcttcaggcttgcgattcgactttgatcgtaatggattggtaccaaaccaagatcaaatcctaggcaagtggatctaattttaacagccggcacgataacaatgaaaattgctccttctttagtgagattaattatatgagaagattaattatatgagtgaccaacgaggatggattagctaggctaggcaagcagtaattgctacaggtgtaatgtgacccagcacatgacacgaccgctgtgtaaaggccgtcaaaagtcaaccatactgtactggatataccgcccggcccgttgtacgtactgtacgtacgtagacagacatggcgatgtcaaatcaaatcaaatcaagtccagtacaatactccctccgtctttaaaaaaaaagacaaatcctagattttcgtatccaacgtttaactatccgtcttatatgaatttttttataattattatttttattgttagatgataaatcatgattaatactttatgcgtgacttatccttttaatttttttataatttttttaaataagatgaacggtcaaacattgaacatagaaatccagagtttatttttttttgaacggagggagtaatccatatgcaatcaatctcacatacattatcgtaaaaggggacgcatcgactcctcctaagttgatttttttccgaagggagtaggtctctctagcataaataccctgtatatctagctcagctacagcctctgatcattcactccatctttattccgccttcatcaattcgatccctgcatttcgctaagctattgtggtgtttgtttctatcgaaaatagataaagtttagatgtgaaattaagacacggaagacaataagatcgttaacgcatggttaactaagttttaattacttattgagaacctttaaatgaatagatttaagcaacttctacataaaaagttttgtacaaattacatcgttcgatagtttgaaaagtgtgctaacggaaatcgaaataaaatatgtatcttagtcagaaaagaacagggtaacctcatcttcagccgaatccacctccacctcagcttcaatcgtgcccatagaacttacgctctctgcaaggtccaccatctcagcaccagaggtggcatcgagcaactagagctcgcactagtgaagtggctgctcgccaaggagaccgaaaccgagctccggccatgtcagctggctacatggcaggggtgccacgggaggagggggttagtgctaatgtctttggtgtcgatccattggaccttggcgccaatgatgcttgcgctgagctaaggttctattcctgaataatattttttataggcttatttgtaaaaacaagttttctataagggccaaatatacacattttaggcaaatcaaacctgaagtggatgctttctcaaatttcagaaattcattccccaaatttagcaaaatttactcaaaattagtcaaaatatgtttacaaattattttcttttgggccaaaatattctgaaatattagatctatcggccctctcaaatttgtttagctttcaccaatatagaatcctgctcactagctatgtgatgcgattctagctgacctggcccatgccctacccactccgtataaattagtgtacgtacgtacatacgtgcaccgttcatgcttgtaacctaaagtaaatacatgtacaccaccctctgtataaacgtataagagaccacaccctgcagcaatgcttgcccaattctagcaacacctctagcccgtgtcaccttcctttcatagctaaacaaaccaacaaaaaaaaagtactagtatactagtagtatacagctagacggtaaaagaaaacaagtttatacgtactccaatggaatactccagtaatttaaaatttactccgtattatagcatagtatcagttagtactagtatactccctcggtaaaaaaacgaatctaattagatgtgacacattttaatacaacgaatctgaatagagatatgtctagatttacggtactaagggggtgtttagatccaggggtataaagttttggcgtgtcacatcgggcattatataatgtgtcgtatagggtgtttggacagtaataaaaaaaactaattacagtatccgtaagtaaaccacgagacaaatttattaagtgatccaattaatccgtcattagtaaatgtttactgtagcaacacattgtcaaatcatggagcaattaggcttaaaagattcgtctcgcaaattagttgtaatctgtgcattagttattttttagcttatatttaatacttcatacatgtgttcaaacgttcgatgtgacagggtgtaaaattttgagatgggatctaaacagacgggacaagatattaattgtatagtaagcgactattatataaattagctagtattaaattggctatagatattttaaagctagtagttggctatactattaaacttgatacgagagagggagctagtaattagctactccattaaacttgctctgagagtgaggtgtgaggaggggaaaaaataaaaaaaattggagagacaagacaatggatggagatatcacgtcacatcaccgacacgctgcactgtatacgtacgctgtacagtacagtacagtaggagaacgtactccctccgaaaaaacaaaccctagatttacgtgccaacatttgactgttcgttttatataaaaaaaatttataattagtattttcattgttgtcagatgataaaacatgattaatactttatgcgtgacttatttttttaatttttttcataattttttcaaataagatggacggtctggacacggaaatcaaggtttgtcttttttttataaggagtagctccctagggcgtattcgtacaggcctcaagcagcgcgcccagccaatgggaacccgccacgtttccgtctcccatcttcatttcttcctgatcctctgccactttgatggcggagtagtaaaatacgaagtctctagctttccgctgcgacgtctactcgagctctgggcaacttgtgatctcatctcctgaatgctgccatctttggttaattgatttctcttatctcttttgttcttcttcctctctctctctattcaatataaataccccgttcctaaaaaaaatcaattttgtgttcagattcaatactaggattgtactctctccgtaaaaaaaaacaaacattgggtttaaatctggacatgatgcatgtccagattcaaacccaaggtttatctttcttttgggctggagggagtattttttttgacggagtagtataatctaatatagagtctcattggttacctatattttctaatatataagtcaaaacggtatattagggaatacaaattaatttatataagtaaaagttttatatatttttatagcgatttaaaagctaacgcaaaaagaattacgttgaatatatcttaaaatcaactctaaatataggttctagaatttaaattttacatattgctttggcttattaggtcaactgataaggccacagatataac

SEQ ID NO: 69173 - DNA, 1034 bp, Oryza sativa
aaacttctcacgagcctaacgaggtgtgcaactttttccttttatatatgataagtgctactccccctgggctgataatatttgtcgttttaaagaagtgtgaggtcaaactttagaatctttgattataaatcatttttaaaatatttatctttcaaatatggtgactacatatatagattagtcttaaaaagtactttaataaaatcatatatctgttaatacttttatacatattataataaaaaataatggtcaaaattgttttttggaaaccgtgcccttgtccaaaacgataagtattatcaacccggaggaagtatctcaataattctatttatatgaaaaattagtgtattgtggcatcatatattaatattaacttctcataatctttttcttcaatattgttaattaaaattattgtttttttacaaaattttatcatcaaaatatacactatcctatactcgatcgagcttctcgagccgagcctgtttaaaacctcgaaggatgactaggctcgattcaagctcggctcgagcttgtgtcgagcttaagcctaggcaggcaagattggctcgttgacagccctactccgatcctaagggtacctactccgatcctaacgtaccctagctacagccattaattgaattaaatgtttctcaacggctgcacagtcatcaaggtctccatgctgatctcgatcccatgtcgatgccagtatatatatagttctttttttattttcggggagtatatatatatatagtatgcgagtattgattatttgcgtgtatatgcacggctttgaattgaccttccaacctctcgtatgacaatccatttggatcattgtagcacttgacagtactgtgtatgctgaccataagcatgcatggaacttgttatgtactctaccttagaatttattagtaagatcaggctgatttgctcccgatgtagggaccaaaaatattatagtcacacttccaatttgatatatagtagattttttggtcttccaaaat

SEQ ID NO: 69174 - DNA, 6958 bp, Oryza sativa
taatgattttaaattttaattattgcacatgttttaagaatcaattattttaagaatggatattattaataaaaaagaacgggtcaagttctactaatttaatttaacaattatatctaatcttatataaccttatactaccattttgcaaggtttggactatgagcattgtctttagggtttgttgaaaccatgccaccctatatttgtaaaatttgagatatatcacccgtatctcaatgacatgtaggatccacatgagtcaatgacatgtgggtcagtgaccaggttcttgttccaatttcaacaacatatatgtgcttaatagtatcttcgttttttaatatatgacacgttgatttttaacacatatttgattattctggtcttatttaaaaaaatcacgcaattattatttattttattgtgagttgttttatcacttacaaatattttaagtatgatttatatcttatacatttaaatttttttttaaataagataaatgattaaacgtgtgttcaaaagtaaatgatgttatatattaaaatatagagagggtaaccactcctatgttgcactgtactctatatttttttccttggcacagttttcaactaacaataatacttcaactgtaccgtacaagccttccacagcaaatactagtcaagtactgatcactccaaacactatatgtctctgttgagagagaagtgaggaaatttagcgcagttaatgatactccctcaattctaaaatatactccatctgttctatattaattgacgttttgaacatagttgagattaaacttttataactttgactatcaataactttaaaaatatttagtttaaagaaactagaaaaacatatatagatttgtctttcaaaacactataataaaagtaaacatgtatttatttattgtatatattataatagaaaaataaggttaaaggtatatcttgtagagctagcgtatcattgtctaaagcgtcaattaaaacgaaaccggagggagtaaggcacaatcacccttaactagctattatataacaaagaaaattggttgtgccttatattatagaatgaatggagtaacatttaaaaattaaatagtttctggatactaatgtagtagttcattttctacattttataactattgagccttacaatctagagcgagaatataatatagtactagattatttgatgggggctagttggagattcttaaaagtggacacagttactagaaacttcttaagaagagcctatattatatttgaaaccttcaaccagtaatacgttgtgtatatagcatatgtttaaactagacgtacagtgagtttctccgtagcaaaagaaattctaccaagctaataactcaaaaatacaattagtataaagttttaattgttactacctccgtctcaaaataagtgcagccataagtttccgcgcttaactttgatcgtctgtcttatttaaattttttttataattaccatttttattgttataagatgataaaatatgaataggactttactcatgacttatgttttaattatttttaaaaaaattttcatataagaagaatggtcaaaattgaacgtggaaaactattgttaggaagtacagctagtagcttttagatcgaacaaacggtcatcgcaccggtcgagccagtgaactcatcacgttgacccggtcgccatgcacccgcaagctcatccacctagcccaagcccagcccagcccagcccaaaccatccatccccggcccaccccgccgctgacggctggctcccacttccggaatattccgtccatcgccgtcaccccacctcctccctctctatcctcttctcctccatttccctctcctctcccctctcttcgctggtcaatccccctccttcctcgaatcttcgcttccccccccccccacccttctcgccgcgccaccgcctctacaaatccactaaaccccctcctccgcctcgccgccgccatgggctcgtcggcggccgactcgttccccgcttgtggagatgatgcaatccgagacgtgtacggcatcggtggtggtggggaggaggacgatccgtccctcttcctctacctctccgacctcgcccccgtctccccctccgcctacctcgacctccccccctcgccgccgccgccgacgacgacggcgacgacgatggtgaaggagggggaggaggcgccggaggacctggtgctgccgttcatctcgaggatgctgatggaggaggacatcgacgacaagttcttctacgactaccccgacaacccggcgctgctccaggcgcagcagcccttcctcgagatcctctccgatccctcctccaactcccgctcctccaactccgacgacccccgcctctccccgacctcctcctccgacacctccgccgccatcaactcctacgacgccgccgccaccgccaccgccgttgccgccgccgcggtgcccgtgccgcagtacgagagcatcgagctcgatcccgccgcgttcttcgccgcggccaactccgacctcatgagctccgccttcctcaaggggatggaggaggcgaacaagttcctccccaccgagaacaagctcatcatcgacctcgaggcctcgtcggagaataattacctcaggggtctcgaggaggccaagaggttcctgcccagcgacgacaagcttcaggttggattcgctgcggcggcggcgcctgtggtgagcgtgaagaaggaggcggtggatgtggtggtggcaaccgcctcgggcggcggcggacgagggcggaaaaacccgtacgacgacgaggagctggagctggagggagggaggagcagcaagcagaccgcggttcagggggacgatgtcgcggcgcgcgccatgttcgacaaggtgatgatgccctcccatgagaattgcaccgagatgatggagaagctgaggattgccatgaaggaggaggcggccaagaacgaggccagcgccggcgggaagggtgggaacgggaaggtgaagggagggcggcggggcgggagggacgtggtggacctgcgcacgctgctcatccactgcgcgcaggccgtggccaccgacgaccgccggagcgccaccgagctgcttaagcagatcaagcagcacgcgaaaccgaccggcgacgcgacgcagcgccttgctcattgctttgctgagggcttgcaggcgcggatcgctggcacgggcagcctggtgcaccagtcgctcgtggctaagcgcacctcagccgtggacatcctccaagcgtaccagctgtacatggctgccatctgcttcaagaaggtgtccttcattttctccaatcaaaccatctacaatgcttccttgggtaagaagaagatacacatcgttgattacggtatacagtatgggttccagtggccgtgcttcctgcggcggatatcacaaagggagggtgggccaccggaggtaaggatgactggcattgacctcccccagcctggtttccggccaactgagcgtattgaggagacagggcaccggctcagtaaatacgcccaggagtttggggtgccattcaagtacaatgccattgcagcggttaagatggagtcagtccgcaaagaggatctgaacattgatcctgatgaggtgctcattgtgaattgccagtatcaatttaagaacttgatggatgagagtgttgtgatcgacagcccaagggatattgtgctcagcaacatccggaagatgcagcctcatgtgttcatccatgcaatagtgaatggctcattcagtgcaccattctttgtgacacggttccgggaggctttgttcttttactcggccttgttcgatgttctggatgcaactaccccaagggaaagcgaacagcggctgctgattgagcaaaacatctttggacgagctgctctgaatgtcattgcgtgtgagggcatagatcgggtggagcgccctgagacatacaagcaatggcaggtgcggaatcaacgggctggcttcaagcaactgccattgaatccagaaattgttcaggtagtgcggaacaaggtcaaggactgctaccacaaggacttcgtgatagatatagatcaccaatggctcttgcaaggatggaagggacgaatactctatgccatctcaacatggacgccaaatgatgctctctcttatttttagttgtttttttttttggcatcgcgacaaatataagatctaggtatttcaataagatggctagtggcagtatgtcatgtatgaagatcgatggtgttggtgttggtttgatggacccaatgacttgaggtatgcctatctagaatttggagtgcacttgtgattccaatgggttggttcttcttctgattcaaaccaattcatgcaatgcaggctatgagggagaattggtagcccaagttgttgaagccataagataaccaagcatgcatgtagatatccatgtttttatgtgatgttaattagttgcttctgttgtcatgttgcagcttagtgccacactaccacttagaaaatagacttaggtcctggtccggatgatgttcgctgcagcgtcaccggttcttgcgatcaatccagtcagttgatccggttgtaattgacaccagttactctgtttttactaggtgcttactgcactgtggcagacagtaacattgtaatatgctcaaaatgttgaactgggttttggctagtcttgtgctgttgtcaacctgagaactatcttttcggccaacttatttggtctattcatgatccatgttgcaacagagggtcaaacatttttgcccattgatgtgtgtgatattgtttttttaattattatttgcattgatgtgatattgtgattccatacattgacataccttggctgtgtttaaaccttagttctttttcatcacatcaacatgtcatcacatcaaacttattttgctgtggaggctagaaattcccacattaatcgaagaaaaagataaaatctacaccgctagatcgtgatagtcctaaattataacggttgatatttaataaggctacaaataagttttgggaactaacttaaatgcaataggaaactaaaaggctacattggactgatctgtctacatatactagaaacataaattgattaggagtaggattctgacgtataggtgttggtcctgttgaagcctgtaatcggattaggacttggcaatacatatttgaatgcatatggcgctagagcctgaagtctgtaattagagtcatttaaattcaccatatatatacggccatgcattgctaggagaataggaacaactaaacagtacatacatatagcataccatatgctgtatgcacaagcctagcagtaaaggccatatacatgtggctgcactggcttacgattaattaggcagtataaatgcaaaacgccagtggttaaaggcatgtgcgtaattcaatatatacttaattaataatttcataaaaaatgagttgtcgcaggaaaaaaaattttatgtcataagaccttcaccttcatagcagcttcatcagtcagaagtgcaatttgatatatgtgtgcacttttgggtaaaagaaaaaaataattgtaattcgataaaaagaatattaaaagaacagtctatctggaaaacaagacaagattaattaaaattcgaaaataataaaataaatttcaacattagaaaaatagtagtagtttatgtaggaatacaatttagaaatagctaaaattcataattaaaaataagaaatgttgcaagaagagaccatcttaaacgaaacatgagatcaattaattgaaatttggagtaaaaataaaataaattctgaaattataaaataaaattgagagtttagataggaatacaacttataaataaccaaaattttcgaacggaaattctcacattaatataagaaaaaaagaagagttagagttctagttatattattaaaacagccttgaaagaaggcaccacgttcgctgtggaggctggaaattcccacattaatcggagaaaaagaaaaaaaagaagagtccaagtagaaatacaatttaaaataactgaaattcgaaattaaaagtaagaaatattgaaagaaatttccatatagaaacccaatacgacattaatcaaaattcaaaataaaaataaaataaaatccgaaattaccaaaaaaaagagtctaagtagaaatacaatttaaaaatagctaaaattcggaattaaaaataagaaatatcgaaagaagagtccatatagtaacccaatacgagattaattaaaattcagaataaaaataaaataaaatctgaaattagcaaaaaaaagatgagtccaagtagaaatacaatttaaaaataaattaaattcggaattaaaaataaggaatattgaaagaagaatccatacaagaatccaatacgagattaattaaaattcggaataaaaaaaataaaaaatcaaaattagaaaaaagaaacgaaaagaagagttcaagtaggaatataatttaaaattaactaaaaatcggaattaaatataagcaatattgaaataagagtgcatataagaacccaatagtagattaactaaaattcgaaataaaaaaataaaatataatatgaaattaggcaaattaaaaagagagttaaaataggaatataattttaaaacaactgagttgaaaataaaaataaaaatatcaaaagaacacaatacgaaaaataaaataaattctgaaatgagaaaaagaaaaataagatatcaactaggaatacaatttataaataactaaaattggtgagaaaaaaataaagattactaaaagaaaaaaccatctgaaacacatgacttgattaat

SEQ ID NO: 69175 - DNA, 14419 bp, Oryza sativa
tgtataaagaatgtggatgttactagtagctactagtatctgctatatggccaaatcaagactgttcattacagatcatgtttccggcctactgtcaacaactgggcagttaagtatttaactatttaccgcttttagatgtgacgtttaacaatttgttactaatacgtttataacatgtgggtccttgtgtctataatatgttaaatatctcgtcagcaaaaggcaggccatgtatgtgttgtttgcaatccaggaatgcaggtgattaaaacctcttgtttccccacattgattgatgctattcctgcattgccatcccaataattcatcaagatatgctccttttagcctcaattagctgattctgtgacgatccatgctataactgcacctaggcatcccagcctcatctttacattacctgtaaatgcaaaatgaatcttcctagtaactatcatgtatgtacatgcagcacataccagaagctcttgaaagttgcataataggagcatctggatttggagtctttcgcaaaatacggcgaaaatctaaagttaaaactgaatcaatcctgcaaaaatgtcgacaagattaggggaatatttttccatcacatgctgtgatccggtggatgcctagagataagccaaatggagatcaggaagactgaaaaaacaggagagcaacatgagacattcagagaacctggcactgatcctggaggatgacaggttcagaaaaatggtttgaccacaagaacatagctgagcaacaggccaagaaaccactgaaaatggatcgaatctcgtgtgatccaaaaatatttgtattcaggtgaaaggcgatcttgtgtgattttgccatgctggtgctgctgatttgggggaatcaaaacgaatatgaaattaaatcgcaggatattagagtaacctggacgcatctgatgagctgaccctgtcctaaatcatcttaaatatctttatcattatgatatttattatctcttattaaaatggttgacagggtgcagtattcttgtatgctagtgcttctctcttgacagacttcttgtgctgcaagaacacaacaattattttcaatccaggagtagacctacgaccgttttaggccgaaacaatttttttaagatatggacatgtacaaatacgacaacataagactatatatgtatttttttctagcagagaaaaaaaaagtttatatagacagattgtgaccccatgactgatataacaagcttaagcaagctctctgactgtcagacaggatgattaacctctgattaaactctgataaagctttgtttgcataagcaaagatgatcctagcaggctagctagcacaaatcctctcaaatcaatagaaaattttatctagattttctcaccgattcgccgcgtttgcatgcacatgtcgaagaggtcattgcttacagcagcaagagtcggcagtcactcaccacatgcacacaccgttcacttccatgtgcaccgtttatagatggcaatggcccggttcccatttccctgcggtgaattctcctattaggagataaaaatggttagaattagtttttccattgaaaattaaatgagagaaattatgtacacgtcagattttgcggcggcagagataatcctcaattaccggcctccggggtatccgtcccccgcggagacctgtataaggtccaaatttacaatttttttacatcctatgtgattactttacttgtgatcttggataaatgataatcttatttgttatcatgtgagtttgtcaatattattaatataaagtgtgaatatatgtggtgtattgtatatataatttgatatctatatatggttttaagcggctatgaagacccatcgggattaatttcctgtgtaagagcgggatggaacaaagttttttccgttgtatttcgcggggacgaaaacagggaaagttttgactcactggggggtagggaggactgaggaggatgtattatagatggccagatgggccgccaggcccgacacagtccaggcacgactggacttgggccgaggtcagtcgggtcagcacagcccgacctacttgctgggttgggccgtgcctacccacgggctatacccatggcctaggcacgactcgagtcagactcggaccgtgttgggccggaccaaacacacaatagccaccgtgcttctccatagaataagcctatttttccttccttatctctttgggctatgtcttatatggctggaatagtctattttgtattcctcttctctttgggccgtgtcttatatggctgagttaagtctatatagggtccctcaactttttttctttaatcctgccgggccgggtcggcccaccatgccaaggcatcggctaggcacggcccaactgtctggccgggccggcacgagcctgacaccaatcgtatcgtgccatgcttgagctgagccaaatggccgtgccgtgggctgggttattaggcctcaggccttatggtcatatataggatgtattccccgttgtcatctctagcaccgttagctgaactcgccaacccggatgcatcttggcccataacggtgacaacataaataaggaaataagttatgggccaagataggctttcttttcctgttctgactttttttcggttttagatttttttttaatatttacagaaataatctatcgaccaaaaaaattgcagaaatagcccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctatagaaggcctgctgcccagcccccagccctcattcttctctcctcaattccagtgaaaaaaaaagaagagagggaaggagaagagaagaaggggcgaaaccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcattggcttacacaagaagatattacgttatagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaagggaaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactcttgagtgtggagatggtatttggaaaatgcattgcaacgcgggtggctctctagctttggttccgtttgttcacccgaaggatccaggtgtgcagacgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaataaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctagtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgacaatttgccacacctgcttggtgttatcgaggaaagaaaccctgggagctcttacgaagtgaagaaattcccctcaattgaacatcctagcaagagtgtgctgcaaagggcgttcttagctctacatgcatgcaagatggcattcgtgaactgtcgtcctgttctctgcattgatgggacattcttgataggaaagtatcggggccagatactaacaacaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcagaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataagtcaggcaggggtatctaccgcaagagagtgaagcaggagtgtgttctcaaagccgacggcacatgtcattgctcttgtgcaaagccgaagctgctccacaggccatgcacccatgtcattgctgccgcagtggagtgtggcatatcagatgcagtatatgtgtcacagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgacctacgggtgaaggcactacctccactcgaccacgtcctaggcgtcgtcgtgccacgtctggctacgtggtgtagttcttatgttctatgtcggcatgtggattttcttgtaattcgtttcgaacttatcgatgtgtttatgtttcgtcgtgtaatgtcagacttcggcatgtcatgtctttaggtctcgtgatgtaacgtcagactaaggcgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcattattttattactattttataattttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggtttacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgtggacccggccagacgatggactgtggacaggtccctcctagcagctttggtcgatcgatggaggccagagacgcacacttttcacttgccgtacggtgaggtagcccctaccctacaggacgtatcgtacttgttggggctaccgctcgcgggagacgctgttgggccagtaaccacggctgtggactggcaggacgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctacaggcggaggctgacgagtactcctacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagaaggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaagtacgttgcatcgatcttatcgtattgttaagttaattgataagttcattgtacatcacatcgatcgtctcgtattgtagtgccgatgggctcacgtccaggttaggcggtcgtatcctgagtttgttatggagttcgaccgccttctgccgactgacgtcgtgtgggagccctacagtgccacggctacccaggctcgtgcgccgttgggtctgtccacactctgcaccagggaccaggcgtactggatgactacggttccgatggtcttcgacatctgcgttgagcctcacgcccctttccgcgtgatgcggtagttcggattccgttagccctttacagtaccgtttccgaccaccgtcccagctgctgttcaccggtaagatcttgcactacgctttccgttgttgcattaaaatctgcatgttcacaatattttgtaacatctgtcgtttcacactaatattacacattaattcgcaggtactcgcgcaagagtcagcagttagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagtagcagccccacgttgcgagcactagagacctctatgccaggcaccgtgaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgatggttcaacgacgatccaacgtttaggcgcggggattccggtacccgtagaggagcagctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggaggtaggtatttttattactatttctgtacatgcctcgcacatataagtgagccgtttcacttgccgattgcttcagggtttcgtgcaccgttcagcaccccaccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctataacgcaggccgcccacttctcccaggctgcagggtcagcatctcaggcagctgtgtcgacctcgcactcagcgcagttctggcagtacaccgggacttcgtcacaggcagccggcacgtcgagtcagggtccaccactggaccatgctgggacctcgtcggactgcttgttgccttccaccttcctcttcgacatcactgacttcgacttcgcttcaggctcgacagaggacgtcatcggcccctcacagctgggaggcgcactgccggtgcagacgcaggaccaggcgcaggccactcctccgcgggacactcgtgctacccgtactgtgccaccggatcttttcacctactcccaggaccacgcgcgagcacaggcccggaggaccaagcgtggtcgcggcgcggggcggggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgtaccgatgcagcctcctttgttcgcgtgtgatacgagtatttgtccgccatttggcgcatacaaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccgaggtgttgaggatccaaactggcgtagcgatccttgtgtatacctactaccaccttggtgccagcgtcctctctgcctatgtggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaacgcggcttatgaacgacaatgtcgtgaacaacagagcgactggcaggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaaaggttctaactccacctagccgtgttgtgcagcttgaactaccagagcaatacagggttactaaagcgcggtttgagagaggagagggatcctcacgtaggggttacctattatcggacaacttggcatattgaaatttctactgtcatgcttccttgtcccattactacatcgtcgttgtgttcaactattgcactacctccctcctagtttgtcacgcccggaaattcactagtaatttccgaacttatttgtgcataaaatcctcgtccaggaatcagccgaggtacacaaactgacaatttaatatacagattcatcaaattaattacaacgataaatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcacgtgcacaaggataccaaaggatggcataatataggctcatttgcaaaagcagcatttagcaaaacatttaagagaggtaaaacagtggagtaattaatcagaaattttaatcaacactgaacagcacacccatgctgcacaggcccaaccatcctgaacaaccatacccggctgtacagatctaatctccaaaccaggagctaagcaaattattaccaggtataacatctataactattgtgagaggtgtgagactaatcacgaaaaacattgctcaacccgcccataaccgcaggcacggctattcgaatagttttactctggccagaggtgtaccactgtacccacaagacacagcctcaacatcatgtctactatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgtaatgaatcatgttatacaaaaggtaaagccgttgcccacgctggcttgtggttggcacgattaatgtttcacaatagtagctcgcgaaccggttcttaattgtcatgagcacgactctcaaaaccatgtgctcacaacccaccattatcaagttttagttgacaagtaattaattaaccaatcacgattgaccatcgtgaactatctttaaaccatcattaaataatagtgagtcataagttatcccaatagtgtgctaatgtttctaagcatggctaagcaattatatctaatatctagctgaaccaatatataaagctcaattagtcaagttataataacccaaggtatcaaggaataaagtaatcaatgcaaacaagccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtattcaattaatcttcttgaatacttccggcgcactcgcgaaccttcgcaacgacggaaacgacaagctaacacgcaaaacaaagaaaaagactaataaaaaccaaataaaccatacataaaaagtaaacaaacatgtagatcataattttagatgaattatgagacttgaacggcctcattctaacttcaaataatttattatgaattttacaagattaaatctaattaaagcccatttaaaaagaattaaataaatttaattcaatttatggacaattttaatatgtagatctttattttatataatttttgcaacttgaaccacattaaactgagttataatgaattagttatgaatttttaaagattaaatcggattaaaacacttatatggattttaattgaattacgacgcaataatgaattatttttgaaaaggaaaaggaggattattgcgtcagcggctaggatttcgcggtggaccgggtgcacggcagcggttcacgggaacgaacggccgagatcgatccacccaaaacggacggccgagatcgaacggtccacgaccggctcacgggaaacggcaacgatgatgtcagcgatgacgtcagcaccggcggcggctcggcctcgcgtgctcgccggcgaacgacggcgcgacgacgcaaatggaggacaccaacgggtagagggcgacgcggcgaactcaccggtgaccaaaacaacggcggaagggcaacggacggcgccggcgacgaggaagaaacggcggcggagatcgggtcgacggtgacggcggtgctctggcggtcttcggcggcggcgaaggggcggacgaggacggcggcgacttggcgaccacgatggcggtcttcccgagcgatgacgacgaccggaacggcggcggcacacggctgaagcgacggcgacgacggtggcgctaggtcacacggcgctagagcgctaccggcgacgagaggcgaaggcgagggtggcggcgggtagaggagagctcggggatccttataaaggggctagcgagcggcgacgaaggcccacggcgaccggcggcgggatggaaagttcgggctcggagagagagagagaccgatccgaatcgacctcgaatccacgaacttccaaagcgatttagacgatgattccaaaagagaaaaggaagaggagatcgaggagattatttcccctctaaagatttcaccggagaaggaaagacgcgaccgaatttggaaggaaactgcggcggcttgcgctagggtttctggcggcggcggcggcgcgaggaggaagacaagactgacaggtgggtcccgcctgtcagcggctgagagagagaggagagcggcggctcggcggacttggccgactgggccggggagggagagagaagaagagaggttttgggccgactttcggcccaaagccaaaaggaggatttaaaaacatttttcaatttaaattattcttgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcttttaggtttttaagatcatttctaataattccttttaaacaataatttataatttaaggatttttaaacaagaaaagctcttaacaattataattagatcattaatgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaaagaacatttaatataaattatattattaatttattaaataatttataaatcctgaaacaaaaatcaggatgtgacatagttcgaatctaatatcatctatgtaaccgcaatgcaaatagttgtatcatgttcaaattgtactactatttcttcatgttacataattctccttgtttaagtccatataatgtttctatgacccagactgcgataggcatatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgg

SEQ ID NO: 69176 - DNA, 2131 bp, Oryza sativa
acccagatgaaaaagtacggccgcaagctctttatgggcggccaaaattgcaattagccccttgccgccctctgtacgggcggcaagggcctaatcgcaattttggccgacggcggcagacggcgcggtcgacccaccgtctgccacgtcagcttgccgcccaccattagggcggcaggggctatttctgcaatttttttggtcgatagattatttctgtaaatattaaaaaaaaatctaaaaacgaaaaaaattcttcctgttctcccttgtggcctggacttatggaccgtggagtaaagttgctgtaactagataggccaactttttttttagataatggaatataatatcccggcctttgctcaaaaagaactacagccaattattacaaagatccactccagaagagagtgtagttcaagacaagttgaacacaccaaacaagagaagagaggacccaaactgagaaaagcaaaataaaatgtggagctagaaggcctcgtcaaggcctaggactgaagttcgaagccaatgcatagaccaatgacaatatccttgcacgaagaggtttctccaaagcggtgcccccaaggaggatgcgacgtggatcgccgccaccactcgttcggaaccgaagcaaggttttcacccagagaatatggtagggaaaggaaaggggtatgctaaaacaacgcctccaaggaggggaacgacgccaaacggcgtcgccgttgtcagccagccaaatggctcggcaaggctttcgcccgcgattccctgtccaaacccacaccaccaatccgcacaagaaggatcgtcgtcggtcaacaacattgtcccttcagcgattcggccaaggccaccgcccacagttgttcccgccgtcgacagcgcgcccgctcccggactcctcctgccccgcctccacatatcgccgccgccgacgacgcaccgtcagccggatgatggccttcaaccatcgccgccataggtaccatcgtcgacagccgccatcgccactgccacagccaccaccatcgccagccgccaccgtcagccaccatcaccaccgccaccgccacggacacccctgtccaaccaccaccgtccagccgccaccgtcgctagccaacgctgccagacgccaaccgtccagatccggccggggtggcgcggatcggaggtgcagcgtgaagcacgggtcgccggcatcatggaggaaggcgtcacgggtacggcgttcacagccggagcattgacgagggcgccgcgccttcctcgtggcggcgaggttcttgatgagggccggcgtcgcggcacgcgccacagtccgccgccgtcgtcgccaacttcgtcgccgccacatccgccaccatcgccgccgctagccacccccctgccaggtccgcggagtggcgccagcgacgaccgagcccgtcgccggtcaccccggccaagcggggagaccagatctggcgacgccgtcgctggagccgcggagagccgacaccgtgaccgccgcgcccaactccgcgccgtcgccgcgccgtccctgtcgccacgaccttgccgtcccgccgccatcgtcgccacgcccgcgccggggcgaggtggagccgaggaggatggccccaccgccgccatcccaacgtgtcgcccggctttgccggcgacgagctccggcggcggcgaagcacggaggagggaggaggaggggcggcggcggcggctaggatttcgccctgaactccctgataggccaacttagaaggaataattccactttgactctcaaaaatattgatccaatctacccttgtttgcaacaccagatatcttggttctccaactatcaaaaccggcccaatttaacgctcaggcagtattaatagtggtatttgctgacgtgccatgtagcatcccaatcattaaaaaagtagagcccacatgtcatactcccctcaccctctctccttctctcccccatgatttctcgacagcagctggggggagcgcatgcaccgtacgtggtgggtggcggcagggcgacggaagcaagggagcagggacgaggagcgacagcgtggagcaatggcgacgaggaacgggcgcgggaggcgggaggatg

SEQ ID NO: 69177 - DNA, 15232 bp, Oryza sativa
cctccctccatcctccccgacgccgacggtgaccaggcgaagcgacgacgcaacctaagacggagcagcggttggagctcagcctcctcacgcgtggcttcttcccccggctagctccctaacaccccctactccttcctcggcattgccgatcgccggcgacgacggcccctcctccacctccgacactgcgggccccttccccgaccaccgtccactacgaaagtcacgaaccccttcttctttcttcttctttttggactagcttgtcgccgaccgcgcccgtagcagcctcgcgcgtggaggttggggaagccggtggcagggacaggaggctcgggccggggtccgccgcgccgacgtcgaggcgacggtgttctcgcgttcccgtgtcctccgccgtcgcctagctcccgccgcagcgcctgtgctaccatcgccgcgcccatgagcatctcactctacactcgtgctccgccaccgacgccgacctatgtcacctgcaccgcaccaggaagagaaggagaagggaggagagagagaaaagaaagaggaggaaaaaaaagatggaggcaatgacatgttggtcccacacattgagtcagccagtcaaataagtcaatgcgccacatcagtgaaaaccactcacaaaagcaccaagggggttatttttttgcaccggtttcaatagttgtgggggttcaagtggtcaacatatttggtattacggttgagggacatgaattagattggagctatatttgagggactcaaagtgaacttattcccaacttagaaacccattctgggttccactagatcggtgattagtagtttggactcaatttgatcacaggccacaatgaactttgggcccaatttgatcaatagtctggttactagtagtttgggcccagatgggcttctttgcttgtttccttatgtcctttatttccccttcttatatttcttttgagtttcccacattttgtatgagttgttgtttccctccagtagcaatttgtgtggttttcccttttcttttgtgggtcctgtggtttttctgacaattaatatgctttaaggttttacagtttttctttcttgaactcatggatttttagatcggacctaaatctttcctcaaaccaaacaatctccaacatagacatctcctaattaagagggagagtcaagttatataacatagcaagaagtgatgaactcgatcagaagaaaaattactgggggtcctatatataattaattcctccatactatctaattattaactactccttccgtctctaaatgtttgacgccattgacttttttaaataggtttgaccgttcgtcttattcaaaaaatttaagtaattattaaattttttcctatcatttgattcattgttaaatatacttttatgtagatatataattttacatattttacaaaagtttttgaataagacgaacggtcaaacatgtttaaaaaagttaatggcatcaaacatttaaggacggagggagtaatatactaattaatataacacaaaatagttaaaattgaataatttactcaaggtcgtgtgacgaaaatgtcactgctagcaaggggacgaaaatgtcttaaccgttgagccatcacatcgtccttgcgagacacacggccaatcggatttggtcctgccaaaggacgatcatcctcgtgcagaatctaaacactgcatcaagccatcaaccactgcacatgtgatgcaaaattaagctttgggggcaaatggacaactagacagttggtcactttgtcccctctcatgaccagatctggcctgctaaattctctcccaaatccaccatttaggctgcaaatcagtctcctgccaccactaattattccatccatgcatgtacattcataaatttggcctgatttcaggctggttttgaaccctaatttggacccatttgcaaccaataaatatccagagctcatcatgtgtcatggagagattataagaatctgtctctctgcatgcacatggcttcacttgttgcatacttgacaatcacatatgcatctacttggctcacatgctgatgcatgatgggtttcagattaattacaccacaaaagggctaaaagcatgattcatcaccatcatatatatctcatgttgatcactgttcactctatcttgtctgattgtctctgcatatatggatttttccatgtagagtataatatgtgtgtatctttcggcttcatgtcggcaaaaatgatgatcaagattgagctgaatatctatccacttaaccgccataagcatggccggcatgatgtatccactgtcgtgatcaggacacgtgtcgtgacggcatgcgctgttgaccggtcaaataatgattagtgtcagtggcattgctggtttgtgctcactatcccctagtgactgatgatcatgtggcgaaaagttagctgatagtggttttgtgataataaactaattaaggtagctaaatctaagcttatctgataatcacatggcagacagtgaagccagagcagtggatgagctttgcttttgttgattggcatcttctaaccgtttgatttcttgtttgtttgcggcacaaattgctgcctattactccctccgtcccaaaataaatacagttttgcactattcatctccaatgtttgaccattcgtcttatttaaaatttttttatgattactatttttattgttattagatgataaaacatgaatagtactttatgtgtgactattttttaaaaaaaattataaatttttcaaataagacggacggtcaaacgttggacacggagttccacggctgcacttattttgtgacggaggtagtactttttttacattcttaaataattgtcgtgttataaattcatgcatataaaaatctataaaactgattattaaatccctaaaaaaaccttccccaaaaagaaatatccggcacaacacttggagttgttatgttcataaaactatttcgagatatacttaatagtacaaaggtaatggttgtgttgttttaccctgaggtctcgtattcaatccctaacacgctcataatttcttaaaaaaatgtttggagtgacgtctctctctccaaatcttgtttttttttttcagaaaactattcagatttgccatatggacatatggttacaccaatgtgtagagatttatatcatcaatgtagttagatcaacggacatgaacttaattaggtcaaattgcagcctaattgaccattgcctgtgcatggcttgtcctgatgcagcgtgtgcaaacataaatgtgctgtctggtccagtaggagccatgtgggctttgtgtgctacaatgtgttggtgcacatgaatctgaacacttaaatttccccctgtttctccaacaaatggcaatataaagttccaaacaaatgcgtgatccaacactagttgaaaatgaaaggagaaacaacatggacaactaattacttataaaaaagcactaaatcacgccccgttttaaaaaaacttgaatctgtcaattaaaccgttgaaataaaattaattgtctccgttaaaaattcccatagaatccaggtaaaattcagacgtacaaaagagtgccatcattagtacgtgtgagctcacaggagcatgtccctatcatattaccgtgtgacggattatgacagaagacacgagggcatgggcagcgcgaaggctgtccgttgtcctgcgatcccaatcttccttctcatttttgttatgacaataatgatgtagggtagggaaagagatagggataggagagatgttatatatctcaaaaattagtctttgactcctgccatgagttctaaaaagaaaatcccatgacggattggtgagcaatcagcctcactgccggatgcatgcattcatccagtccaagatcacagagagacagtgccatgctctgaaatccgaatgctggctgtccccttttgagaaggtttgaaacccttcctcatccgcacgcaaacagagcagtaaattaatacataattaactaagatttagaaaatatatcactttaatagtttaaagtattttttatgaaatacatattatttagtagttttgaaaaatatacgcacgaaaaacgaagaagacgaagttaagaatctcatacgtagcaataaaaaaaagactaaatactcctattttatcaaatctcgatgcagctatttctcactttatctactcctaatacaattattcttcattttcacaaaatctgatgtaataatttctcaaaagtaaacttaattattttgaggcaaatggaaggaaaaaaattattaatactaagttggtttatttcgttttaaaataaattaacctcataacatttactaatacgaagttggtttattctagaacggatggatggaatagaatgcagcggcggagacgaatttgctgtggtgctcggatgaggccggctggccgggcgcagaagatccgtgggctccgtgggtggtggtggtggccgcgcgtgcgtgcgccgcgcccacccgtcgcttctgtgggcgcgacgctgtgtggccgcatctgcgcgcgccctctctctctctctccggcgacgcgatgccggccggtggacggcggcttgtcgccgagactgaccaccccctgccacatgggccccaccacgtaggtgctcccacgtgggcacacgtgtacgtatgtgtgcattgtacatttgtactcgtatatacacacgtatatatgtagacaagatgcagtagaatgtgaacttttttctctcactctctagaggagagcatcctgcattagattatcgtaaacggattaatttttccacaaaaatgaacctgctttggaatacatatggtttttaaaaagaaattcttactaacgcagaatttttatagggaaaaaaatgcctgagaagaatcaagttgtcctaaaagaatccacctgtaatacaacttctactattacatagatttttttttacggaatcaacaccctagatcagttagaatattgttcttaaaattgaacctgcttgattttaaccaaaaaaaacttctttagaaaccaaacatttttctaggaaaaaaaggactgagaagaatcaattttcctaaaatatccacctacagcacaacatttacaatcacatagcaatcttttttttttcaaaaaaaaaaactaacacccaatatcaattagcagcagctcagtagaattcgaatgcttcatgcaattaatacaaaccaatgtaaaatacagagatcctagcattgtgcaacagtacaaaccaaggtaaaatacagagatccatatcaattatgaatattttgcaccacaatgacatgagcagagccgaaagggagtgtcccatggccattgccccaggggacatggtcccataaattatttcagacatggaaagagatgccccaccaaacaatataaactaaaccaagtcctactttaattaactagctaatcaatctccctccaaatccaatgcataatcacatacattagcataaacatatcacttggattgattggcaactgtgcactataaatacccccacccatgcctcattgcataccaaaccttcttccccaaaatctccagccacaaccagaagaaagaggcaccagtctgctcaacctatacatttttagagagagaagctgcaaagggtgtgttagagagagatggagatgtgcatggatgacaagtggaagctcaccaagaagggcagccgaaggttggaggagggccgggcttcgagaggcccatcccggtctgtgccagggcggctggcgagcctggtgaaggagcaaagggccaggttctacatcatgcgtcgctgcgtcaccatgctcgtctgctggcgggactagtgatcgatctcttagagctacgggcctaaacgggtcgggctggctgatgcatcaagaggtcgccttgcctagtaacaaatttattcgtttagtgatgatgtttgttctttctttttttctgagaaagagagcgatgtgccttttcagtggccatcctgtggtagatagttgttaatttgtgtggaaagaattaaatagcttacgttagctgtttgagccatccatacagaaatgtaaactgtgacaagtgtctctttgaaagactaatacattccatggtttctaaatcaaattctctacagtacctacagtacagtagtctgttcaattttttccactaaatttctccatctcaaggaggcacaagaaatgtgtttgtgtatgttatgtctgtaattacttttaggcattgtattgcaagttcccggacagtttgctcacccgcacaaataaccctgcagtttgctcagtttgcacgaaattcatctgaaatgttcatgtaggattcgcactttataagcgctagtgccttgccaagtcgacacgtggctctcctcctccgaattcagaagtccactactcctggacccacccgtcaatgccatgccgtgggccccacgcggcagcgatgtggtccccacctcgccgcgcgtggtctactgccgccgtttctgcggcggccatcgccttcctcgattcctcctctcgctagggtttgcgggagagcgccgcggcggagttgaggagaaatggagatcgacggaagcggagacgagtcagcggcggcggcggcggcggcgacgagcactgaccccggccgcggcaggaagaggccgccttccccctcaactccgactccgagcgacgacggggaggactccgacgacggctgggcggtgagcgacagcggcagcgaggaggaggaggaggaatacgacgacgaggaggagcaggaaggtacaggatgagttctaaatcttcttctatctgaatgatgaatgattcctgaatattttgtttcacgagtcgttaatcttattcagtttttcggtttcatatatgttccccttgtttgattcagaccgaaatgccgagcacggcgaaaatttcagataaaaaaaacaacgtgctaatctatttatttgatgataagtaacatatattctggttagaagtaatttcaggaatttgattgtcttatgataagccaaactaaaaaaagaaaaaaagagagagagagaggaaatagcatactgcaagtctgatactgctggataactgaaatgttgcttcacatgtgccctcactccatactgtacaagttgcagaaacagaagaggatcatttacttcattaggtacatggctgagaaaaaacctggcaataacaacttgcagttactaatatgtacttgtatcgaactatcaaggcggcaatcaagttgcagtgcagtgcagagtgtgttccttttctctacagagttacagttacacactttgagaatgttagcgattcaatgctacatgccgcaatataatgttcaatgcagtgcagtggcagtccaccattcagttaatctagtgcctccttgctttttataagttcccattcccctctttgattcagactgaaatacaattgaaaaaaaaaaggtgctcatcagtttccttaatacttttagcttgtgattgacaacttggattaggatttaggattcagttcttgctctttgattgggtgacattggaaggaacatcactaagaatatcttgcttgaattagttcctacctaatcctacttgtaatgaactttggcaataatataaaatgcaaaaaggaaaaaaaatgcaaccttttattctatattcagtatacataattacagactttttgacttaatcaacttccatcgctatgttttctgtcaagcgtctaattttagcttgcatacatatgatagatggtggtagatcaaactacagagccatggaaattgtttcagttgattgattttcctatgatttttttgtatagggatgcaccgcccatttactgttgatgattttccaaggcttagtagtgaccattctgtgcagactgatgcactctatgatattccacatcttcgtcttcgaggcccttcaccactcagtcttttccgtgcattcaatgatcctctcactgacaaacgcatgcattggtttggttctttttacttccatacttatcttttggcatgtttgacatttagtcattatttttgtaagtttggatatttctcttgattgcatcatcactgtacacagtaacaatctaatagtaaaacttaaagtaacatcctcattgtcaatagcacttctcttgattgcattattacacatttactggtggtatgtgatgttactgaagaataactcaaatacatgacgtaatactttgtgttcctcattgtagggtatggcatgtttaccattgactagccctgctcgaggtatttgcattacaagccgtgcactgtttgaattccaactctgtattcggactgaagactcacctgaggctgaggatgagcccataggtgaaacattgattgaaagatgcactgaattcaccaacattttaagatcagcatcattcaccaaaactgttcgtctgtatggtgagaagtgtggattggatgtgaagtttgctctgctggtaaatgcagttcaagcaacagttgatgttgagattatacattcacctgcttgtggccttaatttgaagttatatgccaaaaccagtggcttcagcgatgtgatccgtctcttccgaggtgttgcacaatctggtcgcagaattagatctcttgtggcggtggtacgacgtagtcaccttgatctttgtatcgaagggtctccagcagatatcggtcttggtgagaagctgccctgtgtaaggtgggagcacaaatttggtgctggttttcatagaactgcagatgaagtggtgaagcttggtgattttaccacaatttctgtgaaagttacatggaaagctgtcgacaagcatccgccgccgaagggatagaggagcttctatatgcaatgtaaaaattggaagatgttatgtgtttggcatctttttgtgcgctatctcgacacctatagagttatactcttaacatgcttgacttcgagctgcctaagtgtcagggacaaatttgtcagagtaatgtagaactttttgaaacgtatatgttagcaaggctagtgatctcttagggtggccatggatctgtcaatagaactttggaccctgctgctcgcagccgactaacagatttatctgtttactgatgatatggttccttttgtagatagtagccaatttgtgtggaaagaaaaaacttccattagctgtttgatccatccatactgaaatgtaaacagtgacaatgtctttgtgaaagactgatagaatttttatggtttctgaatgaaacgttgtaaagtagatgacattcttgctgccttgtgaagagaccgccgttgtgtttctgaagaatgcacgttgatttgcagtttggtacaaaacatagctttaatttggtacccaatgcctgtaggtttccatcaggcgtggaattgcattgcaagttcctgaacagtttgttcaatgttcagtcatgcatgcagaactgcagagaaatgtgcagtgaaaagtctcgggccaatcagagtggcagagactcaccaccggctggctaaaaaaggtgaagagtctgtaagggcaagttttaaagtggaggtgagtgacacatctaatttaaaccatgtcatcttctcagagcaagttcaatagtatagccaactactagctctaattcatttatagccaatctaatagctcattcatacaatagttacatactacactattaatacctagtctcacctgtcatagacacactgcgtcttgaagtccgtgctacagctggctacaaatctgtagcccgctgctcttctctctcctgatttatctccttaaaatatgtttgcagctggcttatagcctgctattgtacctgctctcacatcatcttatatttttcttggagattgtgtggaggttgccccttgcatgaggggtggctcattctctctctcctaacttttctccaactcatcacctaatcctatgtggtaaatttagggggaacatgaagcggttacagtacttgccctaagtgccatcacaaagaatgcaacatactgtattagcatgatgcttgaggctgtgtttgcaaccccatgttcccaacctttctcccttgtttttcgcacgcatgcttttcaaactactaaacggtgtgtttttttggtaaaaattgtctatacgaaagttgcttaaaaaaatcaaattaattcatttttaaaaagaaattagctaatacgtaattaatcatgtgttaaaaagtcactctattttatgtgcaggaggggtgggtcccatcagggtaactttgctcatctacacaaattaactaattgcgctaacattatccacgtctccacttcatactcgtgagtcgatctgcccctccatcatgtcctacgctgcgtgcttgtgctccgcaccttgagcagaacgacgctagcaggaggcatcagctgctgggaggcactgacataggtggcaaactggcaacgttggccatagcagtagcagggtgatgcttgtagcaaacacgagggaaggaaaagttggagccgaggagaggaggcgctggcggcagatggttcgccggtcggccaattagcggtgccacgtgtcctttccctgcactttaccatttgatacttatactccatgcgtcccttaatataagagattttgacattttacttacactgtttaaccattcatcttattcaaaaaattttagaattattatttattttatttgtgatttactttattatccaaagtattttaaaaataatgtttcgttttttatatttgtccaaattttttgaataagacgagtggtcaaacagtgcaagtaaaatatcaaaatcccttatattaggggatggagggagtaccatgtgctcgtatcagctagtagctatcattatctaaaatacaaaaatcagctagtagctataggtattagctagtatctacatggtacccttaggaataacaggcctgatacgctacctccatcccaaaatatatgtcattctaggttgtttagtatgtactaaggttaagagaaaaaaatactataataccccttagtaactaatgtatagttggatgtgagatggtggttgggggtataatgggaagaaatttgaattagaattggttggtgtaataagtagtacttccaagtgataaccattttgggataacttttgaatgctagaaaaataagtattgtgggacggaggaagtattatgagtatcaggtctagtacccatgatacaatatatatcaagtctaaaatctatgggtatcagcagagctcgtgacggttggcgtccttcctgacctcattttttcctagttgttcccgtatcggcatgggaaccggatctagtgggcgtcgccatgctgcaagcatgatacgaaggaggatgtcatggaaccaatcccatccgttgccctcgtcgccaacatgcgcttgggttggatccggtgatggtaaggccatagacctttagattcggtgttagcagcccgcttcctgattcactgatgagtggcacggagcagcaaccaagagtggagcacatgtgaatgagcagggaccagacgaccagtgaagggaagaaggagcgatgatccatttccaagctggctcggacaaggaggaagaggggagggaggaggaggagaagcacacaaggaagagggtggcaatgctaggcggagagcgatgggcggaagaggagcgtgtctagtggataaggagcactactcattttatcccgttctcgctcccctagatgagacaccatgctgtagtttttctgttttattattaaaaaaattatatttttcgctgccttgtgaaatatgaagtttatcaaaagagatccttgtgtttcggaagaattttggttggtgtatgcaggcaaagcctgacaacgcagaaatatcatacaatacattattctttaaaaaatgtcatacattgatggagaatttagaaggaagataaattgaaggaaataatgcaaatcgaagaaatatcatacatggatttaacttagcatccaatgcttgtatgttctgttaggcattgcattgcaagttcctggacaatttgttcggtcatgcaaataactttatagtttcttcaaattttacgaaattcgtctaaaatttttccgtacaaagaggctttataaaatgtttgttttttcaaagataagaaatgcttgtatgtacagatcacagatgtactccaatactacggtctgcagttgggcgctagtgccttgcaaaatcgacacgtggcccttccccttccggagttcggaagaagaagcgacccaggacccaggacccacctgtcagtgaaacgaacgccatgccgtgggccccactcggcagcgatgtggcccccacttgcaaaatcgaggacgctagcgagcgtcctcgattttcctcttgctagggtttgtgggagagatcgccggcggtggcggcggtggcggcggcggaggcggaggcggaggcggtgttgaggagaaatggaggtcgatggaggcggagacgagtcggcggcggcggcgatggctgaccccggccgcgggaagaagagaccgccttccccctcaactcctccgactccgagcgacgacggggaggactccgacgacagctgcgcggtcagcgacgaggaggaggaggaagacgaagacgaaggcgaggaggatcaagaaggtacaggatgatcactataattcttttactatctgaatggctcctgaatatttcgttcgacgagcctctgtaatcttgttcagttttcggtttttaaattttccccctctttgattccgactgaaatatgtaatgcagaaaacaacgtgctaagcgatttgcatattggtttacttttttttttttgcttgttcttgatgataagccacagagattctggttgaaagtaatttcaggaatttgattgtctcatgctatgaatctgctattgctgaataactgaaatgctgctcacttgttggcatgtgccctcactccatattgtactgtacaacagtacaagtttcagaaacagaagatgtgcattaggtacgtagctgagaaatatctgagtatctgactaacaacctacagttactaatgtgtagttgtatgaactatcaaggtgcggcgcagtgcagtgtgtgttcctcttctccacagggttacactcacacacttagaggatgttagcaattcaatgtctgcatgccgcaatataatgttacatacagtgcagtggcagtccatcattgagttaagctagtgcctccttgctttttttataagttcccttctttgattcagactgaaatataatgggaaaaaaggtgcttatctatttacttggttcttttagcttgtgattgactatctggattaggatttaggaaccggtgctttgctctttgattgggtgacacttcaacgaacatcactaagaacatcttgcttgaattagttcgtacctgatcctactaaactttggtaataataacacacacacacacacacaaagaaagaaatgagtgtgcaaccattcatgtacgttcagtgtatagtctttttgacttgtcgatttccatcgctatgttttctgtcacgcgtctaattttagcttccatacaaatgatagatggtggtagatcaaactccagagcatttgaaattgtttcagttgatttaattatcccatgattttttttatgtagggatgcaccgcccatttacggttgatgattttccaaggcttagtagtgatcattctgcgcagactgaagcgcggtatagatttccagatctttgccttcaaggccctttgccactcattcttttccgtgccttcaacgatcctctcactgacaaacgcaggcattggtttggttctgattaccgactcgatgacgaatctgaaagtaaatgccttctttaaattaacttctttgagttctctggtgctttcttttgtcatatcatcatctatagattactgtaaacctgcacatatttctcattctttagtcatcaattttgcagtcaatgtcaacagcgctcggaccgttgattgcttaaatgggtgtaggtgccattcgatgaatctgctccagttgattgatctgtaaatctctggatatcgccatacccagcctggacgtgccaaaatcttcgggttttttgcggtgcgggatgacttggaacctctgcgcaactatgtctttaggcatgcgattgacaattatgaagctgtctctgtgaaaccaaagacggtaatttagtttgcaaacatgtgactgtttgcttccatactcatgttttggcatattgacatttagtaattattttcgtaagtttggatatttctctcaatgcatgtagcacaatccaatctaacagtaagacttaaaataacatcgtcactgtacatagcatttttcttgattgcattcttacacatgtactggtggtatgtgatgttactgaagaataactcaaatacatgatgtaatacttggtgttcctcattgtagggtatggcatgtttaccattgactagcccagctcgaggtatttgcattacaagccgtgcactgtttgaattccaactctgtattcggactgaagactcacctgaggctgaggatgagcccaaaggtggcacattgattgaaggatgcactgaattcaccaacattttgagatcaacatcattcaccgaaactgtccgtctgtatggtgagaagtgtgggttgggtgtgaagtttcttctgcttgtaaatgcagttcaagcaacagttgatgttgagattatacattcacgtgcttgtggccttaatctgaagttatatgccaaaaccagtggcttcagcgatgtgctccgtctcttccgaggtgttgcacaatctagtcgcaaaattagttctgttgtggcggtggtgagacgtagtcaccttgatctctgtattgaagggtctccagcggatatcgatcttggtgagaagc

SEQ ID NO: 69178 - DNA, 1414 bp, Oryza sativa
cggagccttttaagcagtagcaaatttgcacttatgtatgaccctttttttcctccttttaagttatatacttggatttttgttttagagagatgcaaaatgcaataacttttgtgcattagttacagttagcttccatgacaaaggggaatactgcagttcagttaaaattagttaggtgtaattagcttccatggcaaaggaatataaacacttttttttatgttgtctgagtaatgcacgttgctattatcttgtaggtgtggaaacgatttgctcaatttgagcaaacatacggggatttgtcaagcatgttaaaggtatgaggctcataattgtatgaatctaggcaaaacttatatatatgttaccattgcaggatagaataatccattttgcaaaggcatacttgtgttaaaatttatgtgctccatggttgtgccttggacttgccaagttgccatctgtgacataacttacagcacttattaaaaaccttttacatagtatcggggcaagacaatgtcaagtatggtagaaatactaagctgctgcttggtttggtcagttttggaacaataattacacattgtaaaatcttgaaaccacattgtgggcatacaattttttttaatcttctgactgtttttgtattgatctcacccaatttattgtattgtgatcctttaatgactttatattgtgcttgttgcaatggaatttgtgtatttcctgctttcctaataacagctcatgcacaattggattaggatgtgcatgctttatatatatttagccttatttaatttgactttggagaaaaatattttttccctcattccttgctctaaattatgttttctcaggtggaacaaagaaggaaggaggctttatctaggacatccgaagacgccttatctgccttggaaaacacactttatgacgttgtttctcgatacagctatatggatctttggccatgctcaaccaaagaattggattatctatcaagacatgaggtttgcactatctcaaatatacaactaccttgcatatttcatccgaagcaaatgtaacaagctcatatttggaactcacagtcaagctcaattttaatgcatctacgtacaaggcttagcgttactcttgctttcccttgtctctgctctgatgccactggctgttggacttaggacttaatataaaccataccaagtaattatctaaaaggatatgctcatgtatcccttggcagttcttgtgcgagattgtgagaacattcataaatagaaagtcggaatctatttcatgttgcaattttgagatatctctcttgagtcagtccttaatatttcagtctacttgaaaatgctttattttttgctacttaatgtttctgatgcaggtttttaca

SEQ ID NO: 69179 - DNA, 6439 bp, Oryza sativa
tcacaaatttgcctgctattgaaggtatgcctcaggattgagccactttatccaaactaaaaatacaactttctgcaattgctagttcatgtggtatatgtaattaaaaaccgaaatgaactagaatggctccatgtccccactttatccaaactaagaacttgcactccgatgacccaagtactcactgtcctctgatctgtagcctcctagttgtgtgccagatggtatcggaatcattaggagcaaagcttaaatgagatcctgttgcatacctttttcctgtagtgtatttgctggaatgtttgacagtttaaagattgcaatgttcaacatcaggcatagcataactgattgaaaatactacatgacttagaagtcgcagcagttctttcagaaaagtttttttcatatgtatattagcatattgttagtcctttatttactgttctgggattccatttgcatgacatgaacagctgcatatatgtttactgataatctttgagtacctgatctttttgttgctgtttgatatcttgaatttaagttgctgaagtatcgctaaggtcaatgtttttttcatcttgatagggccatcaccagatatggatattgtgctaagcgtgctgatgcagagtacattgccagtgggagacaaaccaggttcgcaagttcctggtcctgccacgagtgacctctcaggtcctggcaaatcaggattgaaccagaatggatccatccatagacctccaagagacgggcaacccacgaagcggaagaactctgaaagtaccgtctcttatcttcaagctatcctagacaaacttttatgatctacctacagatatatgatacaattggatcaactataggacctgataatcatcaacttgtgtgcaggggggcgagcacaagaggaggatgatacgtcgacaacagtgcagagccgagcaatgccgcgggacatattcaggcttaggcagatccagaggaaccgcgggttgggcccttcccagtcaggatcagcggcactgtccagtggaagtgtgttctctggagatcagtcagccagctcaggctagttcaaatttacaattctatgtagcgtcatatatcctgatagggttctactacaattctattatagagtataattcatatctaggtagggtctagtttagttaggtccccccctgatgaaagatgtatgcataattgcatgagtgatgttggcgcgtaaatgtgtttgtttgactgaaaaggaaacggtttgcgatgaccacacgcaagttgggaatgagcagtcgatatcatttaacatcgtaccatttgtgatgatgggtaccaccttaccatgttcaagttgttctattatactcctatatactagattatgatgttttgtcccattctttatttccctgcctagcaggtaactcgttttattatgacctatattaaaactagaaaatggattttgtaacttatgttgttattttctcttgcttattactccctgatatgcttgtgcatgtaaaaaaataaacataagaccgtcgttggaatgaagaaagtttgctggaatttcacgagaattcaactatgccaaaaaattcctgtattccaaaggcgctttaaaaacaatcgtctggttcaattccactgaatcttattcgaattcgttgcagatagtgttgttgcgagaaattttgtttcaaagatcctacagaaccatttcatcgtgatgcgactcatttggcccatgcactatcccaacacaaaaccacagagtaaaaaaacttatttccattgcaatctactgctgctcaagatattcttttgtaaccattttggtttgcaatttggtggtccatttattattcaatagagctactagtaggaaacttggaatgatcaaaagagactcaaaagattacatatttctagagagaagtgaattccaacagttgtaaaaaggacacgagaagaagaagcaagaaagcgaggtgtccaactacgcatgcatgcagcgccaccgtccggcggctcaccggccgccgccggggccgccgccgccgccgccgttgatctctacgggcggccagcggcggcaggcggcgacctggtcgaggaacttggcgaggcgggcgtgcttggccgcccactgctccgccatcttctgctccttggcctccgcgtcgcggcggaggccggccatcttctcccggtactccgcctccacccgctccaccgcagctgcctgctcctccctcagcgccctcatcttcgcctcgaactcctccgtcgcctcccgccgccggcacgccctctccgtctccagctgcatctccaccctcttcatcctccacgccgcctccttcctgtgcgccgcccacgccctctgcccttcctccatctccctgcaacaatagatgcgagtcaagcgacgacacataaaagaggagatccaatcgatgatagtgggtcaaagaagacgaatgagatgaagaaatcccccatttaacgccgttaactttttaattatatgtttaaatatttgttttattaaaaatttttgtgaaatatgtaaaactatatgtagtatacatataagtatatttaataaatataagtaaatgaatgaaatgataggaacaaaattaataattaattttttaaaaaataaaatgagcggttaaatatttttttttagaaaaatcaaagagtattaaatatttaaaaacgtagggagcaaaagatttcaagcacctgcaacactccatcaactccgccaccaccacctcccctcctccaccaccaccccacgtcggcggcggcgccgcaggcgccggcgccaccgccgccgacgcgaggctaagcgtcaccgacggcgaggaagaagacgacggcgacgacgacatccacggcgggaggatcggggcagccatcattcggcggtggtggtcgttgacgagcttgtcggcgaagtcctcgaggagccagtcgtatcgcccgccggcgcagccgcgctcgtcgccgtccagcggcggcgggagtcgccggcgatcccgatcccggagctcccgctgctgcttctccttgaacacctcccaccacttgcccagccgcttcgccgtccggccggggacctcggcggcgatcttcttccacttgttgccgtgcttggcctggaggcggatgacgaggcgctgctcgtcgtcggtgagcgaacctttcttgatccccgggcggaggtagttcttccagcgctcgaggcaggacttggcgtcgcggtggagggggcggttcatccgctgggacacgaggctccactcccggggcccatactggcggacgtaggcgaggaggatggcgtcttcctcaggccgccaccgctgcctctccctcatcggcggcggctgcatcggtgttcgccatcgccgaccatcccagctcggtggtgcgagtactcatgctgctctcctgcacccgcgcgccgccattgtcgtgagaagtcatgcaagatgaagaagaagaagaagaagatcacttctttagttagctaccaagagagaggattgtaatcgctcggttggatgttcgcccgtttattgaaaaaaaattcagaaaagttgataagatagattaatatgaaatatatcaccccacaaacatgcaattttaaattcgacttctacaagttataacaaaattaataaattcatttgtgaatatgcatatacttattggagttaaatttgttatttttgttacaatttatagaagttgaatttaaacttgtatgttggtggagaggattgtaatcgctcgggtggatgttcgtccatttattgcatgtcaaataaataatataaaaaaattaacgagatagattaatatgaaatatacaagttataacaaaaaaaacaaattcatctgtgaatatacgtgtattaattattctttttattttttttttcatattcattttgttcacatgcaacaaatgagtagatatccacctaagtgattaaaattgtttctcgtgatgcaaaatatatataaaggagtaaatttcagaaagctgtagttatttggtcaaaggtatcgcttttctataagattaaggcgaacatttcgcaaaactgttgtaactatatcaaacgattttatcattaaactgcaagttctgcaactgtaaccagttgtgcgtgcgtgtgaacttggcatgtatgcatgagtatgacgtgtagcaaattgatagttttgacccaaatagttgtagatttctgaaatttactcaaataaaaaaaaaagatcatttctttagcctgtttgcaaggctcgtctattagtagcaaaggtgaaatcttcatccaaatagaggacgaggtcatgtacaaacaaaaagaaaagaaagttagatttttggctcaatgtaggatttcatcttacaatggtaaatgagcatggattctaatttctacaacagaaaagataaaagtcattagctaagaggaaaacaagcacatgagaaatcagatcatgtacaaaaaatttacgtatttttagttcaatgtagagcacttatcttacagatttcaagtgtagtaagtgtgtaagcatgaactttgcaaacagaaaagatcaaatcttcagttcagaagaaagaaacgacacactgcagatcaggaatggcttggcatggtttctagttgtgctaatctagtcaaacaaccagtcaaccacaaccagtttaaatgcaaatgttgatacagagtaaagtgattaccgtctggagggagcaagaaactggccagaacagaagctagggctgtgatagtgtaaagttagttgctttattcattgcagcatttatatgtttcagtttggggtgtcaaaagcaggggagttaatttatttgttcagtgatccataactgtgacctgcacactctacacatcctacttactaccacagtaccacagataaagcttatacatgctcctctacaacaacattggtactaaatttgtgcaagattattcctttgacattatacagttaactactcgttcagataacagttaaagcacagaaaatgacagagagagaaaaaaaaaagagaaggctgaattgctccaattggttctttggaggttgcaagggccaaccgaccataaacactattggtaagtaagagcattgttaagcacccatgattcatccagctattactatcaacatacagacaaattcacagatgtcaggacaagttgtgggcacaattcttgtgagaggaaataataaggctaccactgttttctcgcaagcttgtcttccatctttagcagtgtcaccatctggcattaattgggagctgatcaatggggagataatctgccaaaacacctacctaataccctcaagaaggctacaaaataagggaatgtgcaagaggcagaagcaaatccaaagtaaaagtgatgattctaggaccatttggagcccccactggttgcctactaatgacgaattaaagctatggccagggctaattgcgcacgagatggaattttgatttggacaataagggttagttggttaggtgtctcgagcaaatttgacaaatcgaaaaccaatttaatttgcaataaattcactctatttaatatggcacctctttagttttcacctaattgtaatgaaggactcatgagagagaaatgcaataaaatctgcaagaatttcacctagaacatcttctgaattcttgcaagcaatatgcttttgattttattttttttaagttgagacaaaacagttgtttctaaaaaaaagtatttataaaagggatttataggaaacttaggattcctcaagagtggtcttgtgccatccatttcatctagaaattcaagcattaaccaagaagaaacaaaatgaaagaatgttgaaagcatggtagtaggccaaagaaatcaatgtgttgttgtttgttgatctgattggattggaccgttgtatcctccttggctagatgttactaccacagtagtagtactgacaaattgaaagcagtgtgggggtatactatactatactactcctataccacaagtatactgaaacatggatctgtgttgctgggtgttactatctttcaggtaactaatatagcaagttctcaattactgaccattttgtttttttttccttaggtggtaattttcatggaagtgaatgttccaagggatatgggctgagaagcaggtaaaaacaatcatgaagtaatcaaaggaggaatgatgaagaagaaatggcatctctggaaaatctgtactgaagaagttactttgtttacctctcttgagtaggaggaaacaatccataaacccccaaaagtactctggataatagcatatttcaactaatt

SEQ ID NO: 69180 - DNA, 8691 bp, Oryza sativa
  unsure (1)..(8691): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcacacatatacaattctatatgcatataagtttgatgtactgaacaacttatataatccaactagaaatttattaagtgatcctctagattcctggggaagttaacaagctaccttagtgttccatggaatcgtgattgttcccttcaggggcaggcccaggattttaagattgggtattcgaaatggaaagggggtaaaaaaatttttttacaacatgagcacaatatttggtacgtataatcaacaatatggcgacaaaactcgatccggtttctgaacgaacacgctacttagccccgcaaatcgcagcaccacgtctcatctggttatcaaccgtgccgaaacccggttaatctcgccgagaaggctaatccctacatgcgaatcgaagaacacaagcaagaacgagatagattgcaacacaattgcatatgaatgattaagcactcgaatttggggttccacaaaccgatctagcggcgatactattcttgacagattaatctaagcaaaaaccgacttaaaacgatgacgactactgaacaaatataattagggatgtcctagggttgccctagggcgcacacccccttgggctaagtccatgacacaattacaaggcccaaaacccaaatcagattcggactggatgaaatacgtggcttattttgcagattcccggcagctcggtaggaattttaacacgggaccaaaaccatatgaaagtagactccataagctttctaacaagtactcataggcaccgaaaatccttctagatcagcggttaggtccatttgaagttgatgctatcaggaggcccgaatccgaatgcaaaacgtgtaaaactttatctcttggcttctatagaccaaaagtgacatggtgagatggaagtagacttggagaaggtcttagtttggtccccaatcaacttctttgatcatccatgcattcgttacgctcggtctcttttccttcaccaaagcaagtatctctgtaaacaaaaaaaacacacgaaactcattgtgtagcaatgtttgttcaaatatataacaagtaaatccaatatagaacatatgcacatttggttgagtaatacataagatagtcaaggttatatccgagctagttgtgtcctcatcatgaaggacgaaaatcggatttggtgtaaagttaagggacctcaaatgaatttattccacatataaatgcagaaaaaaaagcccaaggcctagcggcatagtctgactcaccagcacacaaatccatcgggcatgcacgtgcgcttgtagggtacttcactagttttctctgtttctcatctccagtctcgtactttcctgttggccatttggcggcgtggcacggcgcatgcgaatttactttctctggatgattcatattcatgaaatgtgaaaacaataagttcaaagaggacctaggtttgtgatttagattaaattgaatcgatcaaatgagcgttcgttttccttgtaggaagataaaaatgaagatgatcaagtgcataaagattagtaacgtcattgagagaaattttctttaagattagacatgaatgaatgatgatgcgtgcaagcaatttctaagctacaaaaaccatcttataaacataatttcttttcattgtttgtcttatgtaagacatgacctacactatctattccatacttgggggtaaactaagatcttttaccctatttgtgtacttgtgtgtatgagtgactctgattcggctcttgaggattgtgtgggcacacccacgacaaaatacctaggtccgccacttggtggtgagatcgagctgcatattgatgagatggatgtcgagacacagtggaagatttatcgatctgcaacaactccaacaagaatcgacgggctgcaaattgttgaacggtgaaaatgctgatgtcattgatgctttcttggctaacaatagtgatgatgtgctgatgaagtgtacaacggtgaggtggtaatggcaatagtaatagcaacatgctttgttcttggctcctgttagctctccagtaatcaaatcacatattgttcattgaacagcttgccacactttttttccattaaatagtctcgacgtctagtagtgtctatcacaataaaccgtctgtcagataaaataaaatctgatctgacaatagagaatgagatgagggtagtgttatcacaatgttgctagaagccgagaaccatgatgtaaaaaaccacatggagtattgtgggagcggaaaaatagacaaaaatgatagaaaaattaagtagacacgtctactctagtttctacatgatatggcaatctcgtacatcaccgccggacccttgtgtattgcttaatttgtacgttcagattgcttggtagcattctgcattggtaagttagctctttgctgcataaattgatatcgagttcttccagagatggtgggaggccctcttctggcaaccttgtgatgcgagtacaatgccaaatctccaacctcttgagtgagggaaggcggtgtaatccggcaggaaaatctatgaattcgctgcacgcaaatttgagctcttgcagggacgagaggtgctgaagcgctttctcttgctcatccaatagtctctcctctccgcgtctgtgtttttcaagctctaggcgtttgagggagccaaggtacttgaagaacgatgtagaaaggattctgggatcatcgatctctagtctttccaatcgagggaataactcatcaacccgccctggaaaccaaagaaaagatggggacaagctggggcatttgtatactttcaaaaacctgagattgcagagggattgcgagacctctattttggtgagctgtgaacattctcgaatctccaactcttcaagtgccgtgcagcattgcaactgcagacattccaaacttgcgttgttctgcactagtaattttttgaggcggacgggcttccctataaaacagggtagcgccgtttgtagggaataatcatgtacgctcgcctggtcatcatttttgccgttatgcacagaagacaagctgaaattgcgagatttgtctgaacaactgcaatgaatcttcttcagagaggagacgagatttaacggaattcgcaggagtccgtcttcagctgagcttatcgaagcgtcacttggatgtcttgacgaggaagcctcaagatctaacaaaagctctagttgacacttttcctcctctcccatcgatagtctcgttaccgccaggcaatttcttaatgtcaattcctgtacgccctgcacatgttgcagtatctgagatagccacttccccgttattccacattctgtaatactgacaagttcaagagatgggcggtcattgcgatttccaattccagctaccatgtcttcacgggtagaagtaggctcttgcggaacatctgaagagaaaagattttgacactcgtctatcttcagcctcttcaaatggatcagttgcctgagtccttccaacgaaatatatctcagatttcggcattgtgatatatgcaaagtagttacaaacctactaaggttgtggtagggcaacactgttttatccatcgctgtcagcttatcagaaaatgagttactcctaatataaaatattccttcgtttgacctcatcgttggaagtgttgaaattccattgatgaagaactctgaaacagtagttgaagggggaaaaggatgaggcacagtgaaatcaggacaatcatcgatggtgaggttgctgaggtggggcaaccatgagcaccccaagttacggcagttctcaaacaacggaaagaccttcagaaccgggcaccttttaatcttcaggatccttaaactggagttgaagtccaccatggaagtgcaagagcacgtatgcaagttttgcattccaattaaaataatatcctgcggtgaacggattgagagcaccgatgcattcttcatctcgatcaacacaagctttctaagcaatgatagcccttctaaagaaagtgtatgccattctgcacaattttctagacgaagtgtttgcagataggtaagtgaagtggaaagccaagttggggctttagttccattgtaccaagatatccgtagatacttgaggttgtgatggggttcaagaccttcaagctcctcacttgctatgtctagaatatgatctaaactaggggcaccattgctatcactcatttgcaatctctccccttctgtttctgagtgcatagaaggttcggatatcatgttaccatcgcattcattttcagagctcccaccactgtcgtatctattcccgtcactgtcatatccattccgtacacccttccagaacaaatgtagtccctccaagcaatggttgcttttcaggcttgctccactggcctcttgctgagttgtaacgttttcaagtcgagacacacccggttctacgggctcgctcatgcattgaagttgtgttatctcaaagccaatagaattctcaaccttgaaatttgttagcttctgaagtgaggccatttctcctatgctagcaatggaagaacacactcccttttgggcaagatgccgcaggctgacaagattatttatgtcatcaggtataaggggacttccatatgaaccaatatctagtacttgaagatggtagcacttgctcagagcatggggcaaagcttcgtgggtcactctttctaagagaagatgaaaagctccatgggactctttgttcttaaatcttagatacctgagatgggtagtgttcgccaaactggaaaggaaggaatcaagatcagcataagctgcagtgatatgcagcagtcgcaaatgctgagcctccctgaaagcatcttggaaggatttaaaaaaatgatggttatattgcccaattagtaccaatgtcctcaacttactccttgacataactttcatcaaacttttctcaaattcctcattacgagataattttccattttgatacttgcagtatgcagaattagttactatcgacaaatgacgtatactcggtgctaactctctgcactctgatccatctatagttgcacattctgtttgtgaaaccagtcgtgctaaatcatgcataagatcatgcataacaaaaactactgatgaagaccaccaactttcagcttgctgaaagaaacccgagttcaccaactcagttagatattcccatcctttgtgctcgaacttctcactggatttttccacaaatccttgagcaatccatatttttatcagttgtgctttactgaaagagtaacccttggggaaaagagaacaataagagaaagattgctgtagctggttaggtagataatcataactgaacttcagcacatgcatgatgccatcagtatgtttcagggattgccattctttgttctctataatgttgatccaatggtcttcagtaagatttcttcgtagtaggagcccacagtttttgctgccaaggggttgccttttagctccttaattgttttcctcccaagattctctaaattttgattactaccatgttgatcagtactaaatgcatatgctttaaatagtgcccatatatccccatcttccagagcttctaaatttattgatcctgccgttccacacctttgagcgacagtcagtattcgagttgtcacaatgatcatattacctgtcacttttgatgcattcacatgattaggtcttaaaggacccagtagtttgttccaacagtcttctgtagtgacatcccagacatcatccaaaacaatcagaaacttcttagatttcatgtgtttctcaagatcctgctgaagcatgttaaagttgcttattccttggtaacttcggttggagacacaccctaaaatctcccttgtgatcctaaccacatcaaatttatcagatacatggacccatatcttgatctcaaactgatttccgatttccggatcattataaacatgttgggacagagtggttttccctatccctcctatgcctacaattggtaggacggttatgtcattggatttatttcccatgattagatttttgatggattccatctctgcatctctcccatacattttgggctcaagaggataagatgatgttattgcatttggggccaggggtgtactctcacacctctgatttaaacttgcatacccacatagcctcataaccccatttacagcctcttgtaactgatgagtcatatgttggatcatgttggagagttcacccctgttccaaggatgcgtgctaactgcctcgtggagtgttgaagtgccatccatcctcatcctttttctgccaactgaattaccaggtgcatttggtgcaccctcaccggcactgcaaaagaatgtgatcgtggttcggcaattagcaaagtcagcgatataacacgatcttaagcagataaacgcagacggttaactcagcggaattaagagctactccctccgtttcataatgtaagtcattttaccatttcccacattcatattgatgttaatgaatctagatctagattcattaacatcaatatgaatatagtaaatgctagaatgacttatattgtggaacggaggaagtacgtgccttatgtggctacgtaaacattctattgaagattacagagcttcaattctccgtttttatatttgacttttattaccatgatctacatcataatggctgacgcgctaaaacgcatctacatatgcgataacttaaaaagatgttccttatatagaaataaaatttttaaagcgggttacatcatcctcaaattactcttatcgcaccctttttttattagtagtggtcatagtaaaatctttaatgcattagttgactattaatccataccaaagggcaaatggacttattatagttactaggaatgtagcctgtgtatacgcacggacatgttgtttaatgttgttagaatttttattacgaatatttatgtgtggatgatatttttgaaatatttatttaatctattttaaacgtgtatttgttaataactggtttggtcgtattactactagaaactgtatatccttaaatttcttagaaacaaacgtgtcacaataatggagttggttcgtagctatttgtattatgtgtgattctatttttaaaatttttcgagtttccgaacttatataacattttttattttgtatgccatagattactttaagtagcattttaattttattatatatttctaaaatatattttctattaaaaatatacttcatccattttatattataagactttctagcattgcccacatttatataaatgttaatgaatctagacacctatcaatctagacacataggtgtctagattcattaacatctatatcaatgtgggcaatagctaatgatactacttcatctagccaaagatgatttatattacttatacttcctctgtcacataaatcggaggagttaaattttattctaaaacaatagaataatttatatgtaactgagacaaagtaattttttaaaatactagcacgataatctccaaagtaccgtattatatttttgacagatatctatagtgtaatgcacgttagttcagtgtctggtttcttttcaacacctattctttctaacgacatgagacacctttagtaatttggagaatacgtatgtacatttaaattagcattgtatattcatcaagtttttttacacctaagatatgatgtgaaattattatcatagcgttaattattacttgtcggttccatatgttttgatgtattttgggctatagacattatcaatttattgatttaaaggaatacaacgggatcacaaattggatatataattttaaaataatttaaaagatagaacacttaaaaagcattgattggacattttatattatatttgtgtaaatttcaagattattatattttatctttaaattgaacaaaactagttgggcagcccgcgcaattgcgcggctagcatcaatttaaaatcatatatttttacatataattttatttaaaattttattcccttgattctaataattttatattttctttaaaagccatgctagtcgctaccccttactcttttgacactttttttttgcttactcgatctacctctgtttctattcatcctctttagaactttataaattaggccttatagtttttagagtttattgtcttggtgggtttcgttttcataatttttagaagtatctttaaacatcaccaatttactactctacggccgtccactaccacctctctttattgtcatttggattttaaaattagaatataattattgtttgtattccttttttactttttataagtctcatcaaatcgttagtggcttcgccactatactcatctacagcccgcctgctgcctgccctccttattgttgtagagattttaaaaatccttaattattacttgtcggttccatatgttttgat

SEQ ID NO: 69181 - DNA, 6364 bp, Oryza sativa
tcattgttctttaaatcatatgtacgtatggagtactttttttggttaatagctatatgtttctcatgtatccgtatatacgataatttttttatttttaaataataaatctaatataatggtgtaaaataaaaaaactaaattgtgttgttttcatttctacatatgtatatttaaattagcgttgcatatttatatttgtgatatttgagaccctaaaatatgatatgaaataaaattagcatcacattagaaatagatatgcatatttatttgcgaggagtagcggtgggctcctgctcgtgtgccatttttgagcctggcagacgccacgtcacctgatctaagggcaaaatgactatcttgtccttcttcttaattcatttctcctccccttcctcagtcccttttacatctttccttttccttgccagtgagctgcttaggctccggcgagctccccgccttgtgctcctccctccctcactcgactccctacatccccagcccctcctctattcctactgccaacgtcatcaaggatcagcgggcatggctgtccggcaatgtgatgccattgctggtgcctcactccatcatcgatgtcatcgttgtcctctgagcacagagcgtcgtcctcctctcggatcttctccactctcccccgacgtcgacggctgcgtcagacccagccttagggcttcccctgcctcattgttcgctgcccgatgcaggaggtgagggtgcacattgggtggtagaagagccaggggccgttcgtctcctccatagccattcggcagcgggacgctcgaggtcctcttcacgtcgtcctggccttggcttgatggtttggcattggtggtgatggcatcaccagctcatgcgcaggaagaaggttgaaggagagagaccccaagctggaggaagaagaaaggcaaaatggtcattttgccctcatatctggtgacgtagcgcctcaccagctcaaaaatggccaatgagaaagaaatcatctctctccaatggtaaaaaaagcaaagttctttggaagagtggcatttgagaacacgccatccgggaaagtggcaaatagtccaaaatcccttggaccgcagcattgctgggccgcgcgcgcttcatgggctatgtgcgtgaataccctagcaagccggcgggggtccgacaaggccttttttttcctttcgatttttcttttctttttttagaactttctttctttatttcagaatatattttcttaaagggctcatatcatgaaaaactaaaccctaatcagataatatttttatcttggatataatttttgtttacccgttccaacgcatgggcattttttctagtctaattttgaatttaattttgttttaattctaaatttaaatctgtcgacgagtgatactcgtagaccggataagtagagtattggggtacattggaacgagggtctatgtagtacgacatcaagcagacaaaagacaaagattatactggttcagggcccttatcaggtaatagccctagtccagtttatatggaattgatgatgatgagaacacattacaaagagagtagtcgaaacagatggtaccgacgagatcgtagtcgagagattcgacgagatctcccactgagttggctccgtgtactccggcttcataaacttcgggaggtgtgttgaagatgagatacgattccctgaacccctcccaggggtcccttttataccgtggatcatcttgccccccaagaaaagcttgaggatatcggacctggtacagtataacagaaactctatcctttccgagtaggattttggaaatcacttgacccgtagagatattttctataatttgaagtagtttccatgtgacatttacaggaacaatccatatacgcgaaggtatacctaatcgatatatctcgtaagtcgtaggacatgaggtatgccttatctgtaaccctaacaaattcaatcccgagttgggctttagaaggactgttttttttcaactttcgttatttctattccaaatttaagttatttataaattgtatttctacttaattttttttctaatttaggaatttattttattgtttattttgaattttaattaaactcgtgttgtgttcgattattatttcaataatattcttttatttcgaattttagtcatttcaaaattgtattcctactcaaactcttttttttttccttttcaaatcccagaaaaaatattttggattttaattaatcacatattatgttcttatatggactcttttttcagtaatgcttatttttaattcttaattcagttatttattagattgtattcttacattgactaaattttagttatttaaaaattgtattcctcttaaactctcatttcttttcctaatataagaatttattttattttttattttaaattttaattaaactcgtgttgggttctagattgattgttttttttcactattttctatttcgaattttagttatttcaaaattatattcctactaaaactctcttttttatttttcttttcataattttctaatttttattccgaattttaattaataaagtattaatgcattattataaggactcttattccaatattgcttatgtttaattccgaattttaattattatttttaatactgtattcctacttgaacaaaatcttagtcatttataaattgtattcgtacaaaaactcgcttttttatttttctgatttaggatttttttttattttttattttgaattttagttatttcaaaatttattcctacttgaactttcttctttctttttctaatttcagaattttttctgaaatttaatttatggattcttatatggattcttcttccaatattacttatttttaatttcgaatttcaattgttttttagattgtatttctatttgtactattcttttctttttcatagccaacatgggaatttctagccttcatagctatcgtgttgtctttttttatatatatagatagatagatagatatgggaatttctagaaatctaaaggcagtatggtgtctctttttagctatcattcacagattggtagtatacctggaagggtctggtggcggaccaattgcttcacgtttcttcttacaattgtcactcttcagatggttgtgtaaaactgacgtccctttgtcggaaccgcacttgaccaccgtgtgacagtggatacatttggccttcaccgcctttccgttttccttttccgtgatatcgaagtcctcccaagccttggatcgttttttgccaccactgctactcgctatgccagcgttgcaactcggtctcgctgcttgctctactccatgttcatccgcgcatgaatctgaaccaagattaaaacgtgcaacggaaattggaatcaagtgtactacctcttttcaggttacaagactttctagcattgtccacatctatctattctatctattatattattaaaatagctctaaaagaagaccccacgttcgctgtgggggctagaatttccacattaatcgaagaaaaagagaaactattttgatcgttagattatagctgtttagatttttcaatggtgcagattaacacatgaaaaatattggagtccaactagaaaacgactacagaaaattgggaccgacctatattctatatagagtgatggcaagttaattaaacctttatgattaggattaggagtcggacatatttgcatggagatcctgtaatcaaatacagagtacaaatctaaccagtgtaggacacgttaactcaaggtagaaataaaaaaaaatcaaataaccaatacagttggaataaaacaatgtaagaatatcattatgcatgagcaaatggaccaggaacgtaacattaggcgtgcaagtaggaatacattttaaaaataactaaaattcggaataaacaataagtaatattgaaagaagattacatataagaatccaatacgatattaattaaaatttagaataaaaataaaataaaacccaaaattagaaaaataaaggacataagagtttaagtaggaatacaaattaaaaataattgaaattcgaaactaaaaataagcaatattaaatgaagagtccatataagaacctaatacaatattaattagaattcagaataaaatataaaataaaaataacataagtttaattaaaatttgaaataaaaatcaaattaaattctgaaaatataaaaataattataggagttcaagtataaatataatttataaataatataatatcggaataaaaaatatgaaattttcaataaacaccatccatctataaaacgcaacaatgacgaataacaataaagagggaagaagcaacaaagtcgtaaaggaattaagtgacagcagttgatgggacatctaaaaactataaacaaaacccaaatagaatcccaatggcgatcaaaaggagggacgacggataggccgttaagtagtacgatcacggtggttggctggatttctagaaagtaaaaaaataaacctcaatgatattaaagagggaagacaacaagggtaaaaacaataaacaaaaccacaaatagaatcccaatgacgggtaacctgttaagcagcacaaacacgatggttagcaggaaagtaaaaaaataaaccataatgagaatcatgttcgaattttaaaatcacaatgacaattaaaagggaagacatcgggcgggccatataggagtataatggctaagctgctgacggtttggtgggacttctacaaagttaaaagtgaacaccgacgatcattatatttgaattttaaaacccaaatgacgataaagagagaaggagacggacgggcataagtggagtagagtggcggcgtttgatgggacttctaaaaattataaaaatgaaagccaatgagttgattaagtctaaaatttataaggttctattttaaagttcaaaggaggacgaatagatgccgtagtagatcgaacaagcaaataaatgggtgaaaaagagcaagaggtagcggcaagtgtgactttaaaaaactataaaattagaaaaatagagatgataaggttagtcttttaaagtcctaatatacaaggaagctatttaacaaattttaagtaaactcatatgtaaataattttgtatggatactatccgcgcaattgcgtaggccaccttgctagttcatatagatggatgttaaagattctaggcatatgggtaatataaaaaattcttataatatgaaacagagaaagtacgtacgacgtcctgcgttacgaagaagggaagaacaatgtattttttatgtacacgctttacctccttggagctgatgctggagcctgtagtattcgagctcgtcgaccgcgtcgtcggcgtcgtacagcacctcccttagacgaccgagtgatcgggccagcggtttgttcgcgatcgccctccccttgacagcaccgaccaccacctccaccctctcgacctcagaccggagcttttcggtgtcatcggcgagcccgacctggctaatccacgcgccaaacttgtcgttgtccaggttctccactatggtatccgccagccatccaatcgaggactccagcaaattaccttctatctcctccatccgcaaatgagaagttattagtaactcttaaccgatggtctatggttataagcaaaatacgcgaatgatatttgggaacgggagcaccggagcagccgagaagagaagaacaaacaacgacaacaaagtacaattacagccggggggactcaccgcagcccgcatataaaagcagtacagaagtcagaactcagaagtccgacatggttttggaccgagtgagagacgatgactttgctctccccatattcaaaaggataaacctcgagcaagcctttcaaaccgcacgcattttagatttcgcgtcgtcagatttgcatatgttatcattacgcatacgactgcagcaatttgactgaggatataaacattgtaatgaatgaacttttagagttgaaataatccctccccgacacggctgactcagaagctctgcagtacgcaaataaaacaatttggagaaccgcacgctgaaagcggaagatggattctaatccctcaggccttgttcggttgctagggattaaatcctaaggggaagcaaaccagggagggattgagtgaatccccccaatttcactcaaaccctgtggggactaaatcccttgtttcttccaatccctctcttagaaactctgtgttcgt

SEQ ID NO: 69182 - DNA, 9238 bp, Oryza sativa
agtgccagccataataacaggaaatgcttgtaatattccactcatatgatataataaaaagatgttctgattccatttaactgcttgaaaggttgttaaagatggctgaatgaactgcattcaggcattgttgaagatctgacatgtcacaatgtcaacaattacacctgatcaagaaataagctattttcagttggaggcatagtgttattatccaaaattaatcattcattcgatggttaattagtggccactggtttctttagcacacacatcagtagacactgatactgagcaagttgaatccatctgtggcgacttcgatgattgattagtctaaatgcacaacaaaatccaaacttctcccaacatccctaaaatgacacatcagtaatacccttcattggatagttaattagtctataaatgacaccatcacgaaactgctaccatcaaagaaattctatggaacatccctaccagtcaatttcaaggagtctgcaaggaaaatcagtgagtagacatcagtttacctatcacagaaatagagaagaaaacaaaactactaccatccaattattctttttccttctactagacataacgcaatgaacattataatgcacaaagtttcagaatcaattgtatagtagatgtgaatcttgagttgcctgaattttaagaagatatagaaatcatgtatagtggatagacagatatatttccgagttgagctcgcttccgtgtggaccgtgtaaaaaaatggcataacagtgaacccaaatccatcaccaattcacaatcggctcaaatctgatttgaggagctgggcatagccgcaaccagcagttgggttcttcatacgcaatcgacaagcagcaccatgttcaaggccttgttcttgatggtggatgaggaggagcccttgcagttggagacggagataaaccaagaaacaaggaccaagaaccaaaccctaggtaggataggaagaagagaggagaaggaagagagactcaaaagtgagaaggtggccagcggaggagacggtcgccggaggggagagcgccgcgtcgtcggagcgccgtcgaatcccagtcacgtccgtgtcaaggagcaaccactgtccgagggcgctaagtcagttgcagaagacgctggagatgatgctgattccggaaggagggaagatgaacttgaagcagctgaaggagaagtggtgcgccgtgcaacaaggcccgtcaagataaacctgaagtactatgggcctgactgggccgtgtaattaagtctaattcctgtaatagttcttcgtgcgagaggggaaagaactgagtaggtgaggaagataagagagagagaacacgaggtgaactctgtctttggcgaccatggtggcgtaggcggcggtggctccattcctgtcggaatcggagaaatatctcagtaatagagttgccaattccttcgtgttctaatccgtgcgttcattctggattgcttttcctgtgcaagttcgttaacaattggtatcagagcctctacgctccaagaattccttggcgcggttgtaaaattccagggggaggattggaattgttcttagaacagattccacaataaggcaacttgccttctcttggttaactgagttcgggaaggagcgggggattctagatctagttgggttcgctcacaaattccaggatgtcgcaggagagtaaacttgatgtcttgttgagaactattgaggagaatgagaagaagagaatggaggcggaggcgaggactcgggatgatctcgctgatctgaagaagatggtggagatttgtcttcccaagatggaggagaaggtggaaaaactcagcgagtccgtgcagacactaagccacaaggtggagctgatggaaggtggcgcgatcaaacaagaaaccgctgcagatgcttcagcacaaggaactccatggttgcatggtaagcggaatcctcctcccatctcacctagtccattttctccggattctactgtgcaatcaccaacttcttctagcatcacaccgatctgagtactagtcttcctcctatgacttgccctaagtttgatggtgagaacccacagatgtggaagagcaattgtgagcaatactttgatatctatggtattaatcctatgcattgggtcaaggtggccacactcaatttcagtggtaatgcagcattttggcttcagtcgatccgttctcaaattatgggtattacttggcaaactctgtgtgacttgatctgtgctagattcactagagatatacaggaagcactaattagaaaatggttccatgcgcaacagaacagcacagtcactgaatatgttgaacaatttgacagtatcatgcaccagctaatggcatatgacagtgctctcacccctgtgtattttgttactaagttcattgaagggctcagggatgatgtcaggggtgcagttatgctacagagaccccaggaccttgactcagcttgttcaattgccttgctccaagaagaaatcctggaaagtaataagtctactacacacagaaggtctgataatcacattgcgttcaggccagtaccaaaactcaacaattatgtgccagtgcctccaggacagagatctgtagctgttagtgcacatgatgacaaaaagggagtggaatctgctaagtccagagaggacaaatttgcttctcttaagtcttacagaagggctaagggtctttgttttgtctgtggtgaaagatgggggagagaccataaatgtgctacttctgtccagctccatgttgtccaagaattattggaagcaatgcgctctgagtgtaattctgatgacatcctgacagctaaagaccctattgaatcagtagaggcaattgatggaggattgatggctatatctcagcaagctttgtgggggtacagaatcatccaaatctattagattaaggggatgggttcaaggaacacagattcttatgttgattgactcaggcagtacacactccttcatagatgagagcattggcacccagcttgtgggcctcactcctttaagtagatctgtaactgtgaaaatagcacatggtggtactatgaagtgcacacagcaaattctggggtgtcgttggtggactcaaggtcattatttcaagagcgacttcaagctgttgaatttgggctcttatgatgctattcttggcatggactggctagaacaatttagtcctatgcaggtggattgggttaacaaatggctagaggttgtgattgatgggcagcctgtcagactgtatggtgttactcatcaaaccgacagatgctcctctattactcctgatcaatgtttgggaatggctaaggttgggtcactgctatttatggtacagttgatgtctatatctcattctgaaaagactgaaatccctgatgacattcagtcaatcctagacccaagggattacccccaaagagaatatgtgatcatcacattcctttacttcctgggtccaagcctgttaaccttcgcccttatagattcaatccagccctcaaggatgaaattgaggcacaaatttcagagatgttgcaaagtggtgttatccaaccgagtcagagtgcctttgcatctccagcccttctagtcaggaagaaggatggcacttggaggctagtaattgattacagacaactgaatgccatcactgtcaagtgttcctaccccatgcctgtgattgatgaattgctagatgaattacctggggctaaatggttttcaaaacttgaccttagggctggttatcatcaaataaggatgaaggaaggagatgaatataaaacaggctggttatcatcagataaggatgaaggaaggagatgaatataaaacagcctttcacactcatactggtcattatgaatacaaggtcatgtcctttggactgacaggagctccagcaacctttcagggtgccatgaatgagacatttaaatcagtcctgaggaggtttgctctggtattttttgatgacattcttatttatagccctgatttgccctcacaccttgaccacctcaagcaagtgttaaccctgctgcagcaacatcattggcaagtaaagttatccaagtgttcttttgcacaacagcaacttacctacttaggtcatgtcataagtgcagagggggtatctactgatccaagcaagattcaagagattgttaattgggaaacaccaacaaccaaaaagaaactcaggggattcttgggtttggctggctattacagaaagtttgtgaaaggatttggattaatcagtaaaccaatcactcagttactacgaaaaggggtgccatataaatggactttggagactgaaactgccttccaacaattgaaacaagctctggtttctgccccagtgctggcattacctgattttagtttgccttttactgtcgaaattgatgcttcagattcagggattggggctgtcctgtctcagaacaaacacccaatagcctacattagcaaggcacttggtccccgaaatcgagggctatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaaacaataaagatctaagcagcggaaaaataagataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaaatgcacaggataacaaaggatggcatagtagggtttcatttgcaaaagcagcatttagcaaacatttcagaatttaataaaacagttaagtattaaacaatattaatccaacgctacacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgggactaatcacgacagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaaataatagtgagtcataagttatcccaatagtgtgctaatgtttctaatcagggctaagcaattatatctaatatctagttgaaccaataaataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggatctaagatgaattagttatgaatttttaaagattaaatcggattaaaacacttaaactgattttaattgaattatgacgcaataatgaattattttttgaaaaggaaaagaggatttattgcgtcagcgggctagggtttcggtggaccgagcgcacggcggcggttcacgcgaacggacggccgagatcgacttgatccaaaacagacggccgagatcgatcggtccacgaccggctcacgggagagggcgacgatgacgtcggcgatgacgtcaccaccggcggcggcggctcggcggctcggacggcgcacgctcgccggcgaacggcggcgcttcggcacgaacggaggacaccaacgggtagcggacggcacggcgaactcaccggcgaccaaagcgatggcggaagaggaacggacggtgacggcgacgaggaggaagcggcggcaaacttcgggttgacggcggcgacggtgctccggcggtcttcggcggcggcgaaggagtggacgaggacggcggcgacttggcgaccacgacggcggtcttcccgagcgacggcgacggctggaacggcggcggcgcacggctggagcgacggcggcgacggcggcgctagggcacacggcgctagggcgtttccgacgacgagaggcgaaggcaaaggtggcggcgggtagaggagacaccggggagccttttaaaggggctaggaggcaacggcgaaggcccacgtcggccggcgacgagaaggaaagttcgggaaaatcgaatccgaaacaaactcgaatccacgaatttccaaacgatttagccgatgtttccaaaggagaaaaggtagaggagatttcgaagatcatttcccttctatttattcggccggagaaggaaaggatcggccgaattggaaaacggcggcgacgcgctagggtttcggccggaggaagacgacgatcccgacaggtgggacccacctgtcagcgacagcgcgctcgcgcgggcggctgcggctgcggactgggccggctgggccgaggagagagagagaggggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggccccactttatattggaatttattaattaaaattagatcttcttttctaggcttttaaaataatttctaaaaattccatttaaacaacaatttatatattttgaatttttagggtgtgacaggctatcaacttatgagaaggaatgtatggctatcttgttagcagttgatcactggaggtcatacttgcaacttggggaatttataattctaactgatcaccatagcttgatgcacttatctgatcagcgtttacataccccatggcagcacaaggctttcaccaagttattgggcttaaactataaaatttgctatcgtaaagggaccagcaatgctgctgcagatgctctatcaagaaagtttcaaagtgattctgagttgtccatcatctctagttgtgttcccagttggttgcaagaggttgctaaggggtatgaacatgatccctattcttctgatctgctttcagccttgtctgttcagcttgactgcaaacctggatttcagttgcagtctggaattattaagtacaaggggcgcatttggattggtaatcatccttctctctagtcacaattgattgctgagttccatgctagtccaatggggggacactctggttttccagtcacttacagtaagatcaagaaactgtttgcttggcagggtatgaaatctcaagtaaaggattttgtacagcaatgtcaaacttgtctgcaagcaaaacctgacagatctaagtacccagggcttctacaaccattacctgttcctgatggatcttgggaagtcatcatcatggactttattgaaggtttgcctaagtcaaagatcttataactgcataatggttgtggtggataaattttctaaatatgcacatttcttgcctttggcccaccctttcactgctcttgaagtagccaaggtgttcatgttgaatatttataagttgcatggtctaccattggtgattatatcagatcgtgacaaaatttttactagccagctatggacttatcttttctctgcttctggaacaaaacttaatctgagcacttcttaccatccccagtctgatcgacagacggaacgagtaaaccagtgccttgagatttatctgcggtgttttgctcatgccaatccttctaaatgggtcacatggttgcacttggctgaatattggtacaatacttcttaccattcctctttaaagacttccccatttgaagtcctatatgggcactctcctaggcattttggaatcaatgtggacacttgtgaaattcctgatttgcaagaatggctaaaggagaggaaactgatgcaagcattggtgcaacagcatttacatagagcaaatcagcaaatgaagcatatggctgacaagaagagaagtttcagatcttttgcagttggagattgggtatacctgaaacttcaaccttatcggcaatcctcagtggcactccgagctaatcataaattggccttcaagttttttggtcccttttaggtgttacggaaaattggcacagtagcatataaacttcagcttcctgcaactgccagtgtgcatcctgtctttcatgtatctcagttaagggcggctaagggttataaagagctttcatcacttcagttgcctaaagctaactctgctctgcaagttccttctcagattcttgatagcagggtggtcaagagggctaccgatgctgttcttcaagtgctgatccgctggtctgattctgcagccgaggatgccacttgggaaaacatggaggactt

SEQ ID NO: 69183 - DNA, 7405 bp, Oryza sativa
ccgaggatgccacttgggaaaacatggaggacttacgcactcgatttcctactgctttggcttggggacaagccaaatttcaaggggaggggattgtcaaggagcaaccactgtccgagggcgctaagtcagttgctaaagacgctggagatgatgctgattccggaaggagggaagatgaacttgaagcagctgaaggagaagtggtgcgccgtgcaacaaggcccgtcaagataaaccagaagtactatgggcctaactaggccaagtaattaagtctaattcctgtaatagttcttcgtgcgagagggggaagaactgagtaggtgaggaagataagagagagagaacacgaggtgaactctgtctttggcgaccatggtggcataggcggcggtggctccattcatgtcggaatcggagaaatatctcagtaatagagttgccaattccttcgtgctctaatccgtgcgttcgttctggattgcttttcctgtgcgagttcgttaaccgtccgctccaccgccaccgctttccctgcgcgctgctcttctcctgtgcgcgagggtttttttccactccatatgggtagctgtttctttcccaacctaggacgagggggaaaggccggatcggcctcgattcaatccgcgacgggattaaccgaatgcaaacttttctgtgggccgggtttcaatccgcgtctatccaatccacggggattgcagcccaatcccggccaaacccgggccaacctaacaaggcctcaaagggatgcccactttacatgtttttacacttttacttctcaaaagatgttacatacttcctatgtcccaaaaagaatcaacctctagctgtgtatctacgatataggctatatccgaatacatagccagaagttggcattttttgggacagagggagtatatatctatatatttatctataaaagtgaacggtaaggacccctttgaatcgcagagttgaaaagattggaggaatagaaaaaacacaggattctaataggaattgaagtgtaaaacagaggattgcaaaacataggaaaaatacaaaaatgatcgtttgattggaccgcggtaaaaacacagaaatcatatgagagagatagattcaaaggaaattttccaagaggttggacctcttgctaagtttcctccaaaatctatatgctatgtgtcattccataggaatttcataggatttgaaaagtttcaatcgtttgaatcaaaggacgaaatagaaaaattttgtatgaaatttgaatcctataaaatttttatataaatcctttgattcaaatgggtcctaaatcttgaaacttcaccagattgttccacgtaatcaccattggatagagaaaaaggagatggcaaaaccgttggatttggtgggtaaaaagcagtaaaaaaatgttctggaaaattccagtgtattccctcaaacatggaagttaggagtagcaacaaacgaaatactaaaaaaagaacaaaatgcagcgccgagaaaattaactgcatgaccaaggatgggcctacttgtaaagcaaatatactgatgtacctatatagtagaagagttgactttctttgaaaaattagctatataattcattgttacaattagtccaattaattttttactgtgttaatctatctacctattatatatttaaaaaactaaaagtccattaacatcctacaaacgctattaaactcccatgtggctctctaaaataagaccaaaggaaaataacaaatccagtctatttaaggatatacttaaaaatatgaaaccgcctagtcgctgtcttcacggtttttctttgaagtcagtttgatcttggtaaactttcatacatgaatcgacctctttccttaattgaattcactaaaaagccatactaaattttggtgttaacattgggtattggcaaaatttgctacaggacactcaaagtttgtggcgtttgctgtaagacacccaaagaacgtgtattctctcgtggacactgtaaaaatgtggtaattagctgctagacactcgtctcattattttattattttcgatagaaacggagagagacattggttaaagacagatttgtccatgagcccacttgtcaatccctctttctctgttcatcttcttcctcctgcggcttcggatggggcaacggcgaagtgggcgccgccgctgcagcagcaactagagcacagggcggcgcggagctggctgggctggagcacggggcggtgcgggactggctgggctggagcacggggcggcgcgccgctgctaggagtcctccccagggctccgcttcggatggggtagcggcgaagtgggcaccgccgccgtcggccaaatccttgcgcgggacgcatgccccgtccgccatttccgccacgggtggatcgacagggatggctcattttttcattttttttcccttttgagatcccctcttctgttcttcctctccgtccttgacctcgcaaggagcagtagtgcgagcgaaatcaggggcatactgcatacctactccccttggggcccttcctgctcctgctggtgctgctcgcactcgctaaggggtatcgaatcaacgccgttttccagtttgcacacggctcggcttggcattgctgctgctgcaggtgtcaatacatacgttccagaacgaggccaacggggacatctgctacacggggctagcatgtacctggatgccatcgtgcttgcccttgccagatggagccgttggtctgctgtggcatggcagtgtgagaggagaagaaagaagaacagaagctggaagaaaaacagtgtcaggggtgttttggtactttcaatgctctttctctctccatttccaccgaaaataataaaagggataataaaataatgaggcagatatccagcagctaattaccacatttttacggtgtccacgagaaaatacacgttctttggatgtctcacagcaaatgccacaaactttaggtgtcttgtagcaaattttgccttgggtatttcaccactagtggagcagaaggacaccagttcattcaaatattacaagcagattggaatgagttattgcaacatgggagtatatcctttatctaccatgtgccatctaccagtacggcagtaccaactgaccaacttctaatataaccaaaaccctcattctcttgggctcaagctgtcattgttagccatggccgatggcaagctagagctggacgacagcgtcgccgtcgcaaggctggtcgacgagtaaccaacaacctccgacccaacggaggtcatgctgtcgccgtagtacttcatggtggaagccgcgaacggctgcaggtacactgccaccggcatcctcggcggcagcaccggcatcctgaacttcctcgactgcaacgcctccgccgcctgcctgatcgccggccgcgccttcgggtcggggtgcgcgcaccacagcccgacgcccaccacacgctccatctcccaccggtcgaacgcgccgccgagccgtgtgtcggcgatggcgtcgagcgacgactgatcatcatcaccccggccgtagagctcccacgcccactccaccaggcggaacacctgtccgccgccgtcgtcgtcgtccttcccaccacccgcggtggcagcggctgcacgaggtgtcactaccattggtcgcctcccgcttgccacctcgagcaggacgatgccgaagctgtacatgtcggactcggtggaggccttgccggtgatgacgcactccgggtcgaggtagcccggcgtgccggcaacggcggtcatggtctggaggctcatgccgtggtcgatgaggcgcgcgaggccgaagtcgccgagcttggcgttgaaggattcgtcgagcatgatgttgctgggcttgatgtcgccatggacgacgcactgatcccattcctggtggaggtacagcaccgcggaggctagtccattaataatctggtacctgacaaaaattagtcacataatatgatacacagatacagggaaagtatatttgattttcacagagaatttacatatgagtttacgtgcaataccgcgcttaatttcggatttttttagatcatatgagttattgtgaatttatagcattctttttagagaaaaactccaaattaactcctaactattacgatagtacgaatataaatgtgatgtggtaatttgtataatacatcaccttattactaactgttatgcgaagataaaatcgaactttcgatcagagtactactcatttttccccgtcctttccaatttgatctatcatatttgcaaatgttaccgagatcaacgcaaaaaatatcactccttttagaagtaaacctcatcggtcatgatgttgtactaggcatgtatgtggatatgaaaacgtgtagttgaattaatgtgaggtatgcaacgatgtcatttactcatacacagatgaacgaacatatatacaacgatgtcatttactactgcacacctaaacgaacatatatagaacaatgttatttacttctacacgaataagcaaatagataacagttagataatgatcgatttagaaactaagacgtacaaattttagggtatgattaattgggatagagccatagaggcagtagtaattactcccacctttcaaattataaggagttttgatcaaagttaaactactctaagtttaaccaaatttataaaaaaatagtaacatttttaacataagacaaatatattaaaaaaatatattcaattatagatttaatgaaaataatttggtgtcttattatattgtttataaacttaattaaatttagagtaaaatgattttgatcaaattcaaaacgaattataatctaagatggagtagtttatggttctcgtaggacaagaatcatcaacatctatctattatatactaaaagttcattaaacttcctacaaactcttctaagccgccacatagcactcctaaaaacactcctaagtcgctatgtggcgctttaaaaaattttaaaatccgataggcccattatttctagccattagatctattataaaaaatataattaaatttatctcaaaaactcgcatagtacgtgcacgtataggtattcccaaaaacaacaagtacgtccatactttgatacgtacactgggcccacatcattcctttttttttcttttttctttctcacttattagatggaaaaccaaactacctatatttataatcgtctcactttccagaaaacactggtggagaaatgctttctagtcccggttcataaccccctgtagtcccggttttccaaccgggactacgaatccgggactaaagatcgctatctttagtcccggttcaaataaccgggactaaaaatcaatctacctcatatactacggaattgggccgaccgaccaaagatggtttctccaccagtgaaaagacaaaacttaattatctacctcatatactacggagaaaaacgataaatcaaaaaatatatcaatatattaatagtaaaatcggaaagaaatactaatcaacaaaaatcataaacaccggcacttattgttgtcaatagcctttcaactatgattttgttaaaaataatactatacaaaaataagtagggggcaaaaattataactattttcatcacctcctcctttttgtccctccatgtccttcaatgcagcgtctagtgtttactatgccatcgtaaatattacaggcatatacatatggttgagttaaggtggcgtcagtaaaagatcactataggcaatgtatctaaagtgacattcttactaatgcaatcctttgtgggtgtgctcatagtgaactaagtgttaaaatggtgccataggctggtctttagggtcacggctacgtcgatgtggaaccaatgtttcagggcattatataagaaagctttggtagatacagtcgatgatgtggaaataagtgatgaacatcgagttaagtagtgtagattattttttagtgtattaataatatataatttattttagtggtactaatacagtttcatttattaaaaatgcacatagcttttaaaacaataacaatagaggagtttatatatgaccacgacaaaatgatttttatttaaatatgagatgtattcttattcttatcatatttagtagtatattaaaatataccatctattttacggtaaatatatttcttttttattgtaagaaaatttacattcccttacagtatatatatatatatatatatatatatatatatatatatatatatatatatatatatatatagtgatgtatgatttattttaccattcttttttttgaacaacaaataagatgtcagtgtatctctgggggctttattttcagtttatattttgaaaatgttttctgatttatattccatccttatagtgttttgaaatacaatctacgatacatgcccacgtaaatgggcgggctcccttccttgttaatcataagagatttactcccatccagcagctctcctctgtcatttactgattactataatttgagtgacttcaaatgttcaatacccttccctattctcttttccggttcccaatttagacgactagatttgattttgtaccttccgatactattacctaccggtacaatccgccggactggagcaatcatctactcataattcatgcacccggacgccgggactcggggacacgtcaccatccatggttaatgtattttcatcagtccagccaaattgccctgttgatggaatctacaggcagcgctatcgtaaatgcggccaagatgtgggccccacaaaagccacttcgtcaaggtaggaacacgcctgatcgatggtaacatgggcacatacgtacgtacctgagcggccaggtcaaggtctccttgttgctgtaaaggtggccgtcgaggctgccgttgcgcaccagctcgtacaccagcagcagccggcgggggccatggcaccaccccatcagctgcaccaggttccggtgccgcagccggctgatcaccgtcacctccgacctgtactccttcctcccttccatggacgccccccgggtgaacaccttgatcgccacgtcccgcccgagctccctcacgtgcccgccgtacacagaccccgacccaccctccccgagcttgccgatctccgcgaacccgcccgtcgccgccgccagctgcgcgtacgggattcgccgtggccccgtgcccgactccatgtcctcctcgtcgtcgtcgtcgagggagtcgtcgtaggagacgccgtcctcgcgtcggcggcgttttctcgctc

SEQ ID NO: 69184 - DNA, 8676 bp, Oryza sativa
ccgctcgggtcccacccgtccatgtgcgtgtcgaactcgacggcgacgaagctgccggcgcttgaggcgttgcccatggtggcgctcgccgtgttcctcgtcaagctctggtcgaagaggccgaggcatccctcgtagcactcctgcggcatgtcgggcatgaacggcgcgaggaagaacgtcatgccgtggccggcgagggcgttgcccctgccagccaccgaccggatggtgaagttgaagctcgcggcgaagctggcctcctcgccggtggcgccgtcccagagctgcaccggccgcttgtacagcgcgcgtcccctggcccgcgccgcgaactcctcaccgagcagctcgatccggccggcggtgaccatggcgtcgtcctcctgcctgaaatcttcggagacgaaggagtccgcgtcatagctgaaggtgagagaggtggcggggacggcaacgagcagcaagtggagcaagagtagtagtagctgctgctgctgcggcggccgcggcgttgctttgctgcttgaggaagacgaagggtttaggaggacagccatggaatggtgctaccgtacgtggttgcagtgcagttgcactgccacgatgacttgttcatacgccctaattagttaaccaggcatcttgacttactgccacgatgattttgatcgcagttagacagttctcagttgggtcccacataattattaatttccaacaaaagttggagattacttctgtccggtcgcctgaggtcgacaccaaaattcggagaccagaatgctcgcgtgcttgcataatgagtctgtagagtactactgctacggagtagcaaagcaaatagacaaccttattggtgggtgtaagggcattctcaatgtacatgtaacaatgggtagtaatataacggtcgggctcagtgaaaaagaactagctataacaaactccacaatggttaaaacctatgggaggaaataagatgggtcccacttagtcaaaatacagtgcttctttgaagtcttctactacctccatccctaattagtgatcactttgacttttttcttataatgtttggccattcttcatgtatgaaaaattaatgcaaatataaaaaataataagttacactcaaagtacttatgataataaagcaagtcacaaataaaataaataataatttcatatttttttaataagacgaatgaccacaaattataaaaaaaaaactcaaaacgacaactattttaggacggaggtagtattactcaaggaatgaattgactccctcctttgtgcagtacttttattcttttttttttctcttgtgaccaagccataagcttacggtcaactttagcatttaatggcctattgttacgttccacaatatttaaggctgagatcatttggagaatatgggaacaaatctcctacgcatagaaaacggagtggtccattagcttgtgattaattaagtattagctattttttctcaaaaatggagcaatatgattttttaagcaattcttgtatagaaactttttataaaaaatacactgtttagccgtttgaaaagcgcgcgcgtagaatatgcgggagaggtattgggaacataggctgccgaacacaacctaaggctagtcacaagctgccaactcaaccttatgacccttgttatgttcacattggatgccctatgttttcgtaaaatgattttatctcatatgttacttatccaatcgattattcgattataccgttatttttgtcacaattaaatatttacaataagatatcactcaaatatatttcgatgaaaaaatatacatgtttcgatagttgaagtcaatgtttcacctagaaactgactatgttaattgcatattttttaagttttttatgttgcaatagttatttggctaatgtttcacatcatgtgtatttagatgtttaaataaatatattatgatatttcactagagcattttaaaatgttacacgtaatggtgttatatgtttcagtaaatattttatgatgtttcaataattatatattaaatgtttcaagtataatataaaaatgtttcaattagaaatatggtatatatattattcaatatatagtcatgtgagagcttgttgtacgatttaatatcaaagaacacaatggtgtaattgggtcacagattgaatcattaatttaccattaaaaatagtttaaagtttgagaaaggtttatattagaaaaagaagaaacatgttgagttacacatgcatgaagaaatacgaaaaagaaagttgttgtattagcatgcatgcagcagaggaggaaaaatcaagaagaaagaagctgtacaaagagcgagcgcccgatatcatattgtttttattggtcgactgatttgttgttagccccacaaaagttacattatcatgagtaaaaaagtcgagtcgcagcacgccacgtgacaggcaacgaaataaaacatatcatggtagtggggtttgagtatgctatgtatttggggtgggtctagcatggcataacatctcttcatgcctaattatgtgattactttttttgtttcttcagttataaaccaaatccatgctgccacacaaattttactttactagattcgttcaattggattctttttttcaaaaaaaatattgggtgctgcatgatcagcatttttaatatctattaaagtttatgcactaaactttctaattgcaaatataaattttattatggacatgaagtctatatagaaacattttatatataaagtctatatattgaaagttcatatacataaaatctatatagaaactctatatatgtaaagtctatattttgggcttcgcatatataaagttaatgtatgaagaaagtctccacaaaaataattcatattaaaaaattccattaatagaactataaaaaagactaacaaaagaaagaaatatgaaaaaaaggaagtggaaaaaacaaaaaaggtttatatgtataggaggatcacgtgaaaagaaatggaaaactgggaatagaacaataccacttcatggttcatcctctaatcatcctcgtatagatccgtttgcgagattatcggtgggtgaaagttcactcacaagccctaccgatgtatttgttgctggtgctaaggatttttcgttggtaatttaaagtttttttcttgctaaattctaagtatccacaaaaataatttgtattaaaaattccattaataaaactataaaaaaataattcatattaaaaattccattaataaaactataaaaaataattcatattaaaaattccattaataaaactataaaaaagactaacgaaagaaataaatatgaaaaaaggaagcggaaaaaacaaaaaagcttgatatgtataggaggatcatgtgaaaagaaatggaaaattgggaatagaacaatactacttcatggcgcgtcctgtaatcatcctcgtatatatagatccattcgcgagattatcgatgggggaatgttcgctcacaagccttaccagtatatttgtggctggtgctagggatttttcgttaatacaaaaacgaaaaacgattttccattaatacaagaacgattttaatgtatttgttttgtgctaatttccattaatacaaaaacaattttaatgtacgaggacccctataggttgtaggcagatcataattggttgcttctgcaaaaatcaacctctattttcgcatgcagcttctcaagaggctcgtatgcaaaaatatattttcgttggtggacctattaaggggccacatgcaaaaatgagcctatttttgcatgcgggcgtcttaagtgatccgcaagaaaaaaaaacttcctctcgtccaaaattttttttctcccctcctctcttttcccacttagccacttcaaatttttttcacctcttctcctctctcttcttttcatttttccacaccctctcaccttatctccttactccctcccccactcatttttctctcctcctctcccacttcctactccaccgctgggtgggagtgatggtggcaggagcagcaggatgctcctcggcttctcctcttgcacagtcgggcgggagcgaggcaagagagacttgtgctggctggcgggaggctcctcctccaccgccgagcgggaatgcggcgggcgggagacgtggcaccagcggatctggttcccccctctccctccaggccggatgtggccactgctccgcccctcatgcatgcggatccagcggtagcggagcggatctggcctgggcaatggtggagcggatctggcacgtccacatgcaaaaattgattttagccaaacggaaaaaatcaatctgtatacatcactcagctttggttttaaacaaaccattgtacaaggaactaatacttcatcctcggagtattttgccttgtgggtaatggcctagctactccttcctatgttgattataccatttttgaaaaaaaaattaacaatgtaacagaacgataagtcatggtaaaaaaatactacagtgggcaaaataataatacttaatttgataggtgaaaaagaaactatagtaatagtatataaagtcccaggaccacaaaaatctagcctttacattttatattttatgataaattagtgcaaagacaaaattcttgtactacgggcagagggagcagctgaatttatccatagatgatgtggatggcctcgccttctactcttgactagtgtagcaaggaaaatttatactagtccaagtctagttttattccatagttggattgagaagtgttaggttggacttgcatgccttttcttattaacacgcgagttttttctacacgtagccatcgatcaaatggatatataccatctttgtttcttcctttcttattttctttcattttttctacaacggaggcatctgttcttttgaagggcctgaatcccgcgacccactcacgtggataggccgagagtccggatttgggccaggttcacggcctgtgtgttaaacaggttcaccctactgatcggtttataaaaaacgaataagctcatctgagatctcttaacttgtcgacgaatccgatttccgtccctcagctggaaaaccaaacacaacggtcccttaactatcaaaaccggtgcagataagatcccttggcagttttgagggcggttttagctgacgtggcgcctacgtggctaatttgacttggtcttcatctgacgtggcactgatgtagcgcctacgtggcaatttaatctggaaaaataataaaacccatgggacccacatgtcagctccacacataaaataataaaaaatggtgggacccacgtaggctccacatgtgatcctctctctcccctcttctccctatcccttctctctctccggctgatggagaggggcgagcggcggtcggcagaagcgggcgtcgcgcggggaggagctgggcgggcagcggccgacggcgggtgttggtatttcttacgtccacagataaatccgcaagagcacggaataccactgtagcacttaaccttcgggtgaccccaaaaggatatcgaactcagggaacgcgtataatctacctaaggctaaggctatccaaggacaacaactgatggtaggtaggctagagaggactttctatgagtgttaattatataagctaagcaaaggtaattttctatctgttgcttcgggcaccgacccctgctggtctgccagcgtggttccggctatagctttatgatgtatccgaatatggaggattactgggacggaatttaaggctgtcaccacctgccgcctatctctgacaaatccgtgggaaggtaatctctaacctagacaccacgtctaagttattaattactactctaatacttgcgcaggaacttccttctctatccagagtcctagtactagagcacttagtacaaatactaaacaatgaacccgcagagatggaaatcttattttacttagacaaagtaattaaataacataagaaaggaacacgaatacttactttatagaagaagttctccgaacctggagcagagtgtaccgacagctccggtactcctccggaattcctcctaagaagctacactcatcgaggtagaagtcggatgagcgccaaacttccgggcactcctcgagagcttcccctcactctctaccttattctaatgaacaaaagatacaatagagtctcttgtaattcagctcaaagttgtgtgttggaaatgagagtaggctcctccttttataggcaggtatgactgttacagcctatgcgaaataaccaagctaccccggaaccaccatcaggaagtaatcagggccgtccacgtcgaatctcgcgatcaacagcctcataagtggttcggccgaacccaggagggctccgttggacctgtttttcctcctggacactaattttgagaccctcagcccattggcatgatggttgggcccatttgcagttttttaattgacttatggggcctccaatacgtgtaaatgtatcctgaatgcacagaggtgcagtttgtcgctcgacggatgtgttttcttctcaaaatacctgtatatacatatttcaccaacactagtggaaataattagtaataatccttaccactaagttggacaccatgttttatttcattatatacaagtattgatagtcagatattatgatttaaggaaaataagtaagaaggagcagtagtagtaggaagccttaagtgacttcgttcatttacgttgagatagacgagtaactacctttttctattttagtcaccgtggtgggcagccatcacgatgagcgattgctgttcttccagcagcgccttcttcctgttttcaagaatgcggatttggttctgaacaagaactatatcatcttgtatgatcactgctggatcgacgaaagccagaaataaaggctccccgaggacacccagcatttgctctagttcgagcttagtgttttctatatcagcgatttcttgaggaatcgctgatagtcttgcagcgatatccatggctttgactctttctttcttgtcccgcaaaatatagagtgcgccgaagcttctatttataggcgagcctattctttagcagaagaatttcttattagaagtcctttttttaatagactgtaacatagataatttgcccagaattcatgtcctccattagtgcgaaaaagaatgaatcccttgagtccggcccccccccgggtatcgacacgcgggacagcgggctaggtcaggtccgcggcacgcggggccatagagcgcagacggcggcgactgccggcgttgtgcagaagggcgtcggcggcatcggcaggagcatctcctctgagtactgaaaccacgacgccgacccatcctccgccatcgccatcgccatcatcgtcgtcctttccggcctcggtggcttccgcggcgcctgtctgcatgacgacgtggccattgcagtgctcagatcatcaggaaaaagccaagataagagagatattcttcttttcttttctcaaaagagattcaccatcaggaaggatgatcacttgagcactagcactatataccagtatgcatgcatggacgatcaatcgataaagaagaagaagagaactgaacagtaaattcaggattggggtgccaaaatgtgtggtgggtgagaggggaaacctccaacctcagataaaaactataatatctatgaatctatctatccagttgacttgttgaaacacacagcaacaacacacaaaaccaaacaaaagacaagaagtagaagaaaaagagatatggatatagtcatgtagtagtacaaaagaaacaagaaactccatctacctttgctgattgattctgaatctggttgtttcagatatataactgtaatctgaaaaaagcctctgcttcctggtgatcagctcacacctgcagctctctctctctctctctgagctgagctgagctgagatgacaggagatgagctgagctgaggtgtgaagtgagtagaagtagagaaggagatgctagttgcaattgcgaaagaacaagggcactgtgtctttttaacagggcaagatgatgcagaaacagcaacagcagaagcagaagcagcgccgtgggtgaactggaggattccctgcggccagccattctcctgcagcgcctccttcttcgcggggagggcggcgatggcggcctccatctcccccatcgtcattcggattgccggcggcggcggcggctagccccggccccgcggcgaggtccgtcgcgacgcccgatgcagccccgccctgctccaccggccagccgctccgtcccgcctgtcgcccgcttttgccagccgccgctcgccctgctccatcggtcggagagagagaacggatagagaggaggggagagagagaatagagagaggagggaggagtgaggatgacatgtggggctcacgcaggtcctacgattttttttattatttcgtgtgtgaaactgacatgcgggtcccacgggttttattatttttttggatcgaattgccacataagcgtcgcgtcagatgaaaaccg

SEQ ID NO: 69185 - DNA, 8228 bp, Oryza sativa
ttttcggcaaatcaattcgaacaaattttctcctcgaaatggtaattaaggtaattatccataaaattttgtatttttcggacaactctctacacaaattattgaactgtcaaatcaaataattttcaactaaaattgtaaaattttcaaactcaaatataagaactttcatgttcataattacctggggagagttgaaagtttagtttagattaacccatcagagaaggccggcctgcattccggacgcatgcatgttacgaggaataagtccactttccggctgtaatttttatctcgaatttaatttgcatccctaaaccgcaatacccccaacttacaaaaacagttcaaattaagtcctctaatagtatggaaggttagttttactgatatggcaatttgacctagtccactcatgttgactagactcttacgtacgtgacaaaaatgaaagtggcccaacctatcattctaactctcctactcctaccttctctcttccccctgctctctctgtggtctcctctctccctcctcccctctctctcccctgcactcagtctctcctccatcaaggcatcacggtggtgatgacgaggtgaatggcggaggtggcgccatgtggtggtgtagcggtgtagattggaaagacaatggttccgacatgagtccagaccagcggtgtcgaggctgaaactccttggttgacgccggtgttggtactgccgtcaggatggtttgaagttgtattggcagatccttaagcaccaagccctccctacctggcgcgtcactgtcgacgagtaatactcatggaccggatgatttgagtattggggtacgttggaacagggatttgcgttgtatgacatcaaacaagcaaaagagacagattatactggttcaggcccctcgatgggtaatagccctagtccagttagtatgggattatatgaaaataccacatattacaaagaagtagacgaaactgacgattccgacgagattgtaatcgatggggatcaacgagatctcacggccacttggctccgagtactccggcttcgtaaactatgatgggtgtgttggcggttttggtcgatctcttccacccacgcctaggggttccttttatagcgtggatcatcttaatctctaagtcaaacctcgagacatcggatctggtacgatataacataaaccttatcctctccaagtagaactttggaaatcacttgactcgtggagatattttccataattagagataaactttcttaatgtatacgtgaacgaaccgaatgcgcgaaggtataccgtatatgtatattcgatgagtcgtaggataggaggcatgccttatccgtaagcttgacagcagccatggcggcgaggaggtgggctgagggcgtatattcgatgagtcgtaggataggaggcatgccttatccgtaagcttgacagcagccatggcggcgaggaggtgggctgagggcgtcggctgcggcctgtggcagcgacgggaaggcaagacgaggcgacgccaactaggggtgtcgaggaggtagtggtgacgatgcagcactagttgtgggggcggcgacgaggcaccaagcaatgctctagccgatgatgtggtagccatatctggcaaaggccaccaggttaaccctccccaccggtagcatgtaaggccgcagttgctccgcctcaacacctcgtttcacgcgcttcaaccagccttcacccttcatgcaggacggatccaagaggtaggcttcatcaggctcgagcctaccatctgatttttgcaaaaaaaaaattaattatatagcatctatcccatgggagtagctggagaaggcttggagaagagaagaggtgaagaactgtctctgttggcgcgaggaagaagatcaggagcgatggaggtagctgaaccggtacgcagtatgcataaaatggcccatttatcactttagcaaaagcccacttggcccatttgtctattttatccattgacttagggttttggagtctggaggctgcgtgggcgtggctgctggccttggctttgccctgtggggatttttttttgtggaaaaagtacaccgaaggtccctcaacttgtcatcgagttacaaaatcgtccctaaccataaaaccatatatatgacatctctcaacttacaaaaccgttcacttaatgtccttaaatggttttgaccccggttttatccgacgtggcagctgagtcagcgtgggacccacgtgagccccacatgttaggattcagcaccctctcttttccccctccccttccttcctcctctctctctctctaactttttctcttctccgggcaatccggctggcgggtggggagaaggtcactggagcgaggtgggaggaggtccggcggccggtggcgacacggacgcggttacatagtatttccctccggaataacgcggcggcggcaccacggactcatgcgatccacagtaggagctcatgcgggaaagcttcctgctcaattcctaagcttggggcgccgtggcgaattcgtttgatgagatggagggtgagttcttggagtacctgaacgtggtgcttcggccatggccgcgtgtggccgcctataggcggtcggcccccggcgacggcgtcggagatcgacaatcgcttcgttcagagatgttataaaaatcgatgcacaacggagacacaaattttacgtggaaaacccttacgggaaaaaaccacgggcgccgactggcaatcatcattatagaggagttgattacaaacgtaggggaataacaatgggaacgtcaccccttcctgtacggcttacaagagtatatataggggataaaagaaagacacctaataggatagacataaagtgctactaggaaactaatccgaatatattgtgggcccaaaattcggatcacatatttaacaagaaatcaaaagaacatcgacaccgtactgcgcccatcgattccgtcaagggcgccgttaccaagttcggatgaactgttgattggagagaagtaaattacatcgatctccattgctactgatcttgtcttgtggttaagcttagacagtgattagcattttgattttcttgtgatttgcccgtttctagtgtcgactgctgcgtgcagaggcacaaacaagtgcagggtgagcttgacctggtgcaggatgaggccaccgagtgccacaagagatcagaagaagcggaggccggcaaggcacatgcggtgaaggacctaggcggcaccaatgcgccttcttgatgagctaagacgaagcttggagaaggcgcaagccgagaaggcacgagcacggcaagacatggagctcgccgagctgcgtctccgagagacgcagcgagcgtcagcgagagccctgcggcgaagtcggaattcgtcgtcgccagggacctccatgccaccgccgaaatgagcatgcggccgctaccactgaggtggacgtccccgcttccaccgcccacctgtgcgctgcccctctcccaccgcccgcccacagctcctcccctcaccaccgctgcatcgcccgtggccggccgccgatgccctcgtcctctcaccggctgagtcaaagaagggagagagagatgaggaagggagagaagaggggaagagagagagagaggaggctgaggtggtagccagacatatgggtcccatgttggtcccacgctgactcagccgccacatagaataaaaccagggtcaaaaccgccgaaagacctattgtgaccggttttgattagttaaggggcaccggatatctggttttgcagttgaggaatgattttgtaactcgatgataagttgagggaccttcggtgtactttttccgttttttttggcgtcgagccgtcgacggcgtgcgattgccaataagatatcagacgattggcttaatgatttgatggtatgctatactgagcgagagatattcaaaagtattgatgataatgcaatcatgaagcgattccaagccttgaaaacccccaaaatatcctttcctcgtgaataaattgtaacagcttagtggtatgtggtatgttgcttcttttagttagcatttgtttacttctaccatttatgcaatactaattttgctcatttatatattcaggtggctgctcactttactctttgctaaggcccaagaaaattagcatcttaagtcaaggactcaaggtattcttttataagtatatttttctattaaatcatgtaagtgttacatttgaattgataatggcatgtgccttattttagcattatcaacttaaatttagacttctagtccagcctatcctcaatttttatcctggattcgccacttgggctaccttacactagtacagatccttccatctgtgacggcccataacaagactggaatttgcgggccgtcacaaggaagtaatttcaatcgggccgaagtttcgcccgattgagatatggtcgcacagccatggtatatcggcataaaactaaagcccatcacggatgacacttatctgtgacgggctatagttgaggcccgattgagatgagggtaccatatctcaatcgggccctaaaagaagcccgtcacagatgagggtcatctgtgacgggctccaactagaggcccgattgagataagtttattgcccgtcacagatgacactcttttttgacggccttttattaaggcccgatagagattacttgtatgcccgtcatggttgattgttttagggccgttacagatatttgttgcacagtataaataccccccaccacctagtgtaactgtatcccactgttcactattttggtgggaggctgtagggggcgattttttgtcctttttccaaggaaaacagaaattaaattcccaaaagtgatcaaaatggatcaatcaagtgagtaatataaatcattaattgagcaatttcatcacatcttacttttgcaatactgatcttataatatgtgcctctaatttgttttttttagcaattgatcgaagttggatgtatgccaaaaaattgaaacgtcattgtacggagtaccgaaagggcgtaataaattttatgaacgccgcggaggaggatcggataagaagaaacagtgattacatttgttgtccatgtgcagattgcaagaatgagaatatgtttgatagcggagaggacgtacacggtcatctgatacaacgaggattcatggagggctatacatgttgggtgaagcatggagagcaagaatcaggaagtggagcagcagcagacagaagtgtgtgcataatcaggaagatgaaaatgagcatgacatgtttataccttctccattgggcggtgaaatggttgatgtggatcacgatctgctgcaagacatgttacgtgatgttgaggacctagcccagaatgagagagatggaatgaaattcagcaggttggtaagtgattccgagacgcctttgtacgctggatgcaaagcaaaacacactaagttgtcagttaccttgaacctaatgaaggtaaaggcaagtagtggatggacagacaagagtttcacagatcttttaggaattttgaaggctatgcatcctgttgagaacacattgcccgagacgacatacgaagcaaagcaggttctgtgtccactggggttagaggtccgtagaattcacgcttgtcccaacgactgcatattgtaccacaagcaatatgcggacttggatgcttgtcctgtctgcaaggtttcacgatacaagcgaaagaaaagtgctgacgaaggaaataagtcaaagaggggtggtccggcaaaggttgtgtggtatctacctatcattgatcgtttcaaaagaatctttgccaacccgaacgaagcgaagttagtacgttggcacgccacggaaagaaggaatgatggtatgcttagacacccagcggattcgattgaatggaggaatatagatcgaaaacacaaagactttgctgccgaccctagaaacatgaggatatgtctttgtacggatggcatgaatcctttcggtgacatgagtagtactcacagcatttggccagttcttattgcgaactataacctcccgctatggttatgctttaaacagaaatatattatgttgtgcttgttaatctaaggtccaaggcaacccggcaatgatatcgatgtattcctggagcctgttatcgacgatctggagattctttggaaagaaagtgtggaaacttgggatgcatatggtcaggagaacttcaagctaagagttctattgttctgcaccattaatgactaccctgcactcggtaatctttccggacaaactataaaaggaaagaaggcatgctccgattgcaaggaacatccacgaaaccggtggctgaagaaatcacgaaagatggtatacatgggtcaccggaggttgctcccggtacgtcacacatttagaagaaagaagaaaatttttaatggtaagagagaacttcagcctgctcccaaagatttgtccggagatgaggtccacaatatggtcaaggacataagcaatgagtttgggaagaaaagaaaacgtagcaagacaaaggagaagggtatgtggaagaaaaaaatccatattttggcggctaccttactggaaagatcttgatgtccgtcattgcattgatctcatgcatgtagaaaagaatgtgtgtgagagtttggttggcctgatgttgaatattcccgggaagacaaaggacgggttgaacgcgcgccttgatctacaggacatgaatattcgcagcgaactccagcccaaacgagatgcagagataggtaaagtgtacctccctccagcctgccacacactgtcggaggatgagaagatcgcaatgttatcatgcttgaaggatattaaagttccatcgggctattcagcgaggataagtaagtatgttaaattggacgatctaaaacttgttggaatgaagtctcacgattgccacgtgctaatcacacaaatcttgccagttgctatcagaggcattctaccaccgaaagtgcgtcacacgatccaacgtctgtgcgccttcttcaatgcaattggacagaaggttatagatcctgaagatctagatgggctgcagaccgatattgtgaataccctctgtcacctggagatgtttttcccactgtctttctttgatataatggttcatctctctgttcatctggtgaagcaaacaaaactatgtggtccggcttttctaagggaaatgtggccgtttgaaaggtacatgggagttctaaagtcgtacattcgtagcagagctaaacccgaggggagcatcattaaaggttacacgaccgaggaggctattgagttctgtgtcaattacatgtccgatgccgatcctatcggagttccagcgtctcgtcacgagggaaggttgtcaggtgttggcacaattggaaggaaaagaattaggcccgatcaagcgtcgtacgtgcaggctcattatgctgtgctccaacatatggcagaagttgtcccatactttgaggagcacttagcgaaaatccgagatgagaacttggggcgatctgatgcatggattaacagagaacataattctcggttcaacgaatggttcaagaatcgtgtgacaatgtccacggatgtcccaaatgagacagtacaattgttggggatgggaccgtcttggaccatagacacatggcaaggatacgatataaatggatacacattttacaccgtcaaacaagatgacaaaagcacagtgcaaaacagcggcgtccgtatagatgcattccaggatcaagttgggtcaaacacatactacggccgcattgaggagatctgggagctaaactacgtcaagttcaaggttcctttgttccactgccgttgggtgaatctacgcactagtgtcaaagccgacaaggaaggtttcactttagtagatctatctaaggtgggatacgccgatgaaccatttgtacttgcgaaacaggtcgagcagatattctacacaaaagacccttcaaacaagaagatgcacatcgtgagggatggaaagcgccaaattgtaggagttgacaacgtcgtcgatgaagaagaatacaaccataatcttcatgtaagacctcaca

SEQ ID NO: 69186 - DNA, 7561 bp, Oryza sativa
atattacatgactttaaatgggaaagccataaatagctaacttgtacagctaatcaagatctacaacttttattttagtcacttcttcatccgacaaagtgatagtaccaatgtttacaaaattgacatatctgtgttaatatttataaaccagatgagagaaatgtgatttttgtgaataatataactatcactttgtcggatgaagaagtaaccaaaataaaaattgtagatcttgatgagaggatcaactttgttgttgaccatatttccatttgaaatcatttagtatttacaaatgttgattatatttgtcatattgtgaaaatcaatttcaagctgttagaaacaaagttatatagataaatgaccaaaataaaagttgtagttcttgatgagaggatcaactttgttgttgaccatatttccatttcaaatcatttagtatttacaaatgctgtttagatttgtcatattatcaaaatcaatttcaagctgttggaaacaaagttatatagacaaatgaccaaaataaaagttgtagatcttgataacctctacaattttgttgttgaccatatttcgatttgaaataatttactatccgaaaatatgttatgactaataaaatgaattattatacaacagctatatattttgtactcacaaatataaagacttatctgggaaatggaaaaatagtcatcagtgacgggccttagttcaagcccgatagagattaatctatctctatcgggcattatcttagggcccgtcacagatgagtcatccgtgacgggcctgactgtcatctcaatcgggcattagtatggagcccgtcaccgatgagtcatctgtgacaggccctacggcaaagcccgattgagatgactcatcactctaatataactagggtttctcagatcggatcgaaaatttttctaagtcccgctacagtttcccgcctccttagaaccctagcgccgccgtcatcctccctcgccaagcccgccgccgtcgccaccgagcccgccgccgtcgccaccgagcccgccgccaccgcagtcgtcctccctcgccaagcctgccgtcgtcaccaccgagcctcctcggccctccattcagacctccgccgccgagcctcctcaccgacgaccctccccccgagcaggaagccgccgccgccaccgagcctttacaccgatcggaccagtgttggccttcctcgtcgtcgccgcccgcgtcctcaccgacccacgtcgccgacccccatagagcacgacgccgcccgcccggtgccgacctgcccgatcggcgtctccaccgaccggcgccgccctccaccgagcccgggcgccgccgagccccaccggccatcctcaggtgagtcctccatcgcgtcgccctctactaactgtgaatgacatgtcattgaaatgtggatgtggatgatatgtgattgaactgtgagtgagacatgtcgatgttgggatgaaatgtggtgcatttatgaattttgtgatagatgattgtagtaattgatgaaatgtggttcatttaactttatttatatgcaatgtggttcatgttgggatgaaatgtggtttattcatgttgggatgaaatgtggtttattcatgttgggatgaaatgtggtttatttaagttgggatgaaatgtggtttatttatgttgggatgaaatgagatttatttatgttgggatgaaatgagatttatttatgttgggatgaaatgtggtttattcatgttgggatgaaatgtagtttatttatgttgggatgaaatgtggtttatttatgttgggatgaaatgtggtgcattaatgaaattattgtgaaatgtggttaatagattgtaataaattgtagcactaaattatgtttttttttgtttttttggaaaaaagtagataatgtctcagcaaggcgaaccaatgtcgacgacaactagtgggtcctcaagggcacgtactcctaggacagggaacaaaattcctaaggaacggttccgcataacagcggtggacgccgtagggttgccgacatctccaaggaaaatattgagccgatttaggtctatctgcggggtcatagggaggcagaaattcagtattctgtaagacgacttcaagctcatgccggccgcagagaaggacattgcttggctaatgttcaaggagagctttgattatcctgcggagcatgaggaccgtctcaggcgggctgctttcaaggttatgggcactgcttggaagaacttcaaaactaagctagtcggcgagttcgtctacaacccggcaaatccagatccaagagagaaatttccttggatcacagaacaggtctgggaggaattccatgcgaagaagtcgacccccgagtccagagctagaagcgaggcatatcgcttgctccagaccaggaaccagcatccgcaccggcttggtaccactggatatgccggtaaggaagaggaatggcagcgtgaggatgaagaagcggaggaatcgtgcacaccgctcgtgtttggcgatatcccacaccctcgggctaggaactgggccagggctaggtaccagaaacatgatgatggcacaatcttcatgccaaatgcagaagatcaacgagtatacgaagctatagtaagtgtctagtcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaagcgttgggcaacaaggaacaccgtggacggacacggggcattgggtcttctgttccttggaagtatggatttccagactacgcgtggcagtacaagaagcggacttccaacaaggcggagaaagatgcacaccttgaagccaagatccaggagtcgatacgagctgagctgacatctgaattcgacgaaaagctcgagtcgatgagggccaagattaggcaagagatccgagaagagcaatagatcccccaggccgtcgttgctgctgcgcacaaagagttaggaagtcccaccgaaaaacgcagcagttgcgcatcaactgagttggcggaaaatccaacatcggtcgacagcgccgtcgaccacataacggtaaccgtgaacttactcaatacatgaaagacgtaacaaatccatatgatatataatattctaaaaaaattgattaatctatcacaggaaccaacgagctgcaccctcacagttagggtgatgccgaccttcactgttccagcagccgagggacttgcgtacaagccgaccccagagacaagagtgcatggagcgcaactcagggccgactgtgcaaaagttcaagtcgactcggcgaagcccgaatacgagctgttccctctgaagtatctaccaaacgacgaggtcctctcactaggaaatgcccgtggtaccttcatccaatggcccaaggacctcattgagatcaggttacagcgaggccaaccactgcaccaggcggtcgtccaccaaagagacccgcttctactccttcagcccctcctgctcaagatcgtcatgcacaatcttacaatgtgtagttgcagtacgatacggattttggggaggaccgaacggaggccgacagcaaggcgattaatgaacccccaccgatgaagaagagcaggaaggcacactcttccccttagagaattactctcgataaacccgaagcaaaggggtgaggaaggggaggaaaggtgcaggcctcgcttctagctccaagaaagctagatctgggcaagagccaggaagagactaagggcaaagaggtcaagaagaaatacgtcgctccacaggagttccaactaggcatgccattggttggagatgacgtgcttcccgcaatgggcaccgcttgcaaggaccttcacttatactacatggagaaatctaacgccaggaagccaaataaagctaccgatatccttggacagcacgatggaaagccattccttggtccaacaaattatatcgtggtcgacttcaaggatcttttcgacctctacaggctccgagcggtggacacaagcctccttaagtgctactccttgtaagtattgtcgcccaactcattctggtaataacaatcggtttaacttgcttacaagatcgttgatcctgtgtgtaggttaagttggcaatggtgtcagaagcatgcaccagaagttgccttccttgatccacaagtggtcactgtcacaaatctccataatgaccgtcaatgaatggtcaactacatctacgacaccttgtggtcccgccgagacaaggagtacattatgtgtgcctataatcaatagtaagtgtgttaactaaatatacacaacagcatgacacattccttgagtacttaattaactttcactatattaatgccgcagtgcccattggatccttctggtcataacacctaaatggagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttcccggtgaagcaacaaataggtaaccagtgcggattccatgtgtgccacaacatgcgacttctgtatagagaaaaggtgaagactttggctgagtttgaggtcggtggtctcaattgtgatagactaactacattttagtacttttatatgatcgatcaactaatctggatttatgacaatgtagggcacaataaccaagtctctgactaccagctttgaggaggttcgcgaggagatagccagcttcatcctccgcgaaataattaaccccaaaggaatgtttaggcttaaactaaaatgatgaacaatgttgaacttctatgtttaggcaatgatgaacacttattatgcaactgtgatgatgtcactgtgatgcttatatttatgtatatattttatatgtttatgttaagacttgctaaataaatatttgatccaattaactcggttttacaggtaaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagctggggatattggatatctgtgtttgtttctgttatttttacagcgggcatggctagcaaaggccagaggctagccaaaaaacaatttttttttgtggattatagtcatctgtgacgggccataactaaatgcccgattgagatgaggtcatctgtgacgggctctagcttaggcccgattgaggtcactagtcatctgtgacgggctctagttttggcccgattgaggtcagcagtcatctgtgacgggctctagtttaggcccgattgaggtcatcagtcatctatgacgggctatagtttaggcccgattgagatgagtatcatctgtgacgggctctagtttaggcccgataaaggttagtagtcatctgtgacgggcgctagttgtggcctgatagagataggtcatctgtgacgggctatagtttgactggtcgtctgggtcaaagctatcggtgacgggctttacttagggcccgattgagatatattcattcgtgacggccgtttgcccgattgagataactctttacatcagtgacttctagcctgtgacggacgctgtgcccgattgagatggggcttaccgcccgattgagatgagggtatccgttctagtgttagaatcttatgcctctgcgtactagaataccacgtcaatcaaaacaaccatccatgctgccttaggattttatgtaacaggttttttaatgttggggattcaacatttcatgtattggggttgaaggatataatctaaacttgatgtaaaaataaaagacttaaagtgaagttattcccatgttacaaaatactccatccgtttcacaatgtaagtcattctagcattttccacattcatattgatgttaatgaatctagacatatatatttatctagatttattaacataaatatgaatgtgagaaaagctacagtgacttacatcgtgaaacggaggaagtaggaagcatctccactccctcactggaacagcctattgcactacgtactgattcactcagcccatgttgggaaaggggaagcttatggtggctgtccaaatcttatggtaccaccaaggcaccaagcgattttttgagagaaatattttttttttgtgagaaggcaccaagcgattaatcgggatatggacaagctgaatcaactcctttttaatacagtactggtcctaaagtgaacgtgaggtccgtaggttgtaggtgcgtgtaaggaattttgctactatatataagcccattctacttaggtattttttgtaagtcgtaacataaagtcatggtgaaataaaatagaagaagaatagttggattttttttaattcaagaatagctggattgggcatgtaacaatatttacggaatatgtaaattgaattgagcccaagcgaagcttatactcctactttttaatttacttctgtgcaatccaagttatagtgacatcctggtaattaaggctaagcagatcttgcctaacaaagagcatttaaaatgcagctaatccaactcaaattaagcgttcgaaccaaaatatctcattctatttataaaataaaagaaagagctagcgtagtttgtcctaaaaccaagattaagcgcacttgaagatcacctagaagcttcgcatgattttgttctacttctccgtttcacaatgtaagtcattctagcattttccatattcatattgatgttaatgaatctagacttcattaactttaatatgaactaggaaggtagcccatgcattgcgcgggcatgtattttattgtgttcgaaaaacttacatagatcgaatatcaactcaatgacattgccatgtttcataagtactatttctccataattttacttcatcggcattgcttagataatttttccaaactatttgttagcttttaaaatatataatatttaattcattcgtataaacaattatctatgatccgtataaacatttgtcatgtttcaaagtatctatttagtttgtttggaaaaaacatatctaacaaattaaacgtaaattaaaagtaaaatattttgtcttgtttaattgaatgtttagtggctttttttaacaaatcctaaagcactattattgttagtaaacatgttttatttgtaccatcaagttagtcctctttttagttggtttagattcacacaagttgttacatacttacatataaattaacaaatacatattgtagaccatcgcttccttgtaatatgtttgacctatagtatttttttt

SEQ ID NO: 69187 - DNA, 2656 bp, Oryza sativa
ccactgtaaatgtgctacagaggatgtacaatgatttgaggtgatgcaatacttattgtcactttttttataatgctctattttttttctatttggttaccatgcaaaggatatataggtgtgtgtgcttaaatggagtattttcatttttatggagtgaaatatgagtaatatgcatcttcaattatttatttaattataaaaaaaataacagttcaaataaactaaaaaacagttatgacataagaatcataattatttagctttgtaattattgatcattttttattattttgttaattagttaaaaattataagatagaggagttgagtgagataggagaagaagagaaagtcgaatgggacaaagtatgtgtacatataattatttttttacatttattgtgttttacttattattactttattaactaaaaataaaataaaagctttattgattgattaagatctatcttttttactcgtcttttcctacatagtatacaatattgaaaatgtgaacattacaaatctactactgttatttttgctttattataatatcataatgggaggagtaaatttttggaacaatacttagtgttattaggttcattttacctttttgtcattacatatctaattgaattattgtgaacttatatacaatgataaaatatatatcattactattcacaattttataattgtttgaatggcacataaaagtcagataatataaccccaaatatgggtctttaaatgtaaaataatcaaaatacataagcaaaaatattactcgtatgatataggggatctcatgattgagatgttatagctgcttatttttttcgtataactcttgctttctaacttatatattttgggaacattactcatagctatttttttagattttatgattgtagatataatttaattcttatgaagttatgcacaatgatagagtctataataatattatttcatatttattgtaattgcttgaacggtacgcaaaagtctggaaatataatccaaagtgtcatttttttcctcaaagttgaattattgtggaattttggtctttgcctgtagatgcagtcataaataattttaagatataagcggattaaaagttagttgtatgatttagatgttatagttgttgaattgtttaacacaaaaaatatattttctaactaataaagtatatgataataggggaagaaatatgtgcaaaaatatgaagaaattgagggatgaaggggtggatgtacgttactaacgtacgcacgtactatccttaagaatccttaagaaaacgtacgctacatacagtcccaatttggatccggtttgggggttagggagttcttttaaagacaaatctaatggtggtaaataatgggtccacataatttaatgaaaattaatgtctagatgtttggttttttcttaaaatttttagaaatttctctaatttattacagtgacacgtggtgtcttagtaagtagcgcttgcaggatgccacatggtggcttagaaaagtttgttatataatagatctaacttaatttgttcatgcatattctgtgaattgatatatgattgtgtaatctacattatcaatttttccctattttatatgacagttttccgtgttatgcaaagtttaggaggtgataaaaaattaaatatttcatataggttaaagaacaccatatattttttaattgttgatagactacgtgcaaataactatagaaaaaatatggttatttaagatttattattgtttaaaaatttgtataactaaagaaaaaagaagaagagattggataggaggggagggaagacgtacctacggacgtacgaacttgagttgtacgtccagttgaaggatgggcccatggggagaggagagggtaggggagtttgtggggttatttttttaataaaattctaatagacaaaaatattggacctaccggtttgttaagatgccatatagcggtttaggagtatttgtaggagtacacatggtggcttaggagcgtttgtaggaagtttcttggacttttagtatataatagatagatagataatagatgtggggaatgatagaatgacttacattgtgaatcggagtgagtagaaggtacactagcacaaaagaagtgagcttgttcttgaaatgtcactttcactaaaaaaatagttggagagagaggagaggccccctatcacacccgagcaactaacctgggggcgacatgcaagccctaccgccaccaccctcctccccattcccaaccgtacgcagccggagctagccgccggaaattgagcggctagctaggattgcgatggtggggctcggtttttgtgcccctccggcatggagagagtgttgccggacgacggcggcagtacgagggaggtgcgtgcggcgaactcgctgaccgagcttattagcgagtgtgttggggggcatattgcggagcagctttcgacccaggtttggtggccattccccgtcgctcttcttagatctggggcttcctcaccttgtcggtggtcggtgcgagggacctgcctttctctagctatcctcctaggccgtgcacggtgtgtaagttggtggggatggtg

SEQ ID NO: 69188 - DNA, 7684 bp, Oryza sativa
aactaattctactcgggcggctgtaagtattcccaatatatactccttgtatcgatcatacttaaatcaagtgattgggatagatcggacgccatgccgagacagtataaatcacttaaatcgaaatatatattaataatgggactacatatgttcatagcatagccgatcatatagatctagcatgtatcggctaatactccgataccactctatactaagatattaaagcaagtagaatatatcaaataaaggcctaatatacttaaatgcaataagatcttaaaataaagggcagatttaacatgtcaataaagcatatagagtaaatatagttaaatcagataagatcggctgaaactctgatgctaccctaatcagcaactagaaggcaggctagaggttgattttttaagcacgacttaatagatcaaactcaactgatacagcattaagtatgaaaagaagaacaatatctagacaatcaagctgctggaagtttcatagagtggtagatatcttatataatctacgtcaacatcgaaatctaacctaatcggctgtcctctaccgacagatgttagccgattgtagattagatagtggtattgccagagattatgtaagatatatgatagttcgacgaattacataaacgagatcagagtatcacaaagatggaagcactaatcccgagaacacaagtcgtcataacaagttttaccttttgttgaagatcgaaaccgatgcagctcaacccgaaagcaagaactcgtcgaaataaaactaaagcaaaaagggtggcgatgcgccgaaattgtattgaacgtgtgtgttaaaagttacatagggctcgggtctatttatacccgagaattacaagatatgcccataacggacacgactaatatctttaacaaactctaagataccataagtctttacggcagacttttgcccaagcatatctctaaggaaattacataaaatatcctaattaatagatacaattgacttctcaagactctatccatgtgcggcaatcatcttgaagcgccttaattcaacccaatatcatacatcaagttgcattatcggaatcggttgtatcagcttacctagtccgactcagacccagccgatcctaatcgtagccgatctggactccagccgattcctgctctgtttctgaactcaatctccgcctccgactttgcttcgatctaatattctttcccgatgccgatattaccaaatttggttgttaacacatgccccccaagtccggaatatttggtaatgtttcggatttgctgtaaatcgaccccgagtaagttcgcactttgccgttttccgaccgttactgccatgctttaaatattaaacgtcaccctcgagaaatctcacaccgtgacttccgttttcaccgctcaagcgaaactttgtcttctctctctccagcgattcctccgacgcaaaagcgacttccaggtgacttcatcttcggcgagatttccgcctgcagcgatgtcgtcctgcaccaacccatctgatgcgccttcagccgagtatgctgaggtaagttcccgtcggcttgatcccctttcttagcagcagatcgattttctcttatcttacattgctctctttttctctgttgttttggatttgtagcatctcttcaacctagtcgcgattcccagcctttcgcacaaaatccactattttcttggcccaatcggcaacctcgaccccactgatttcatcattggtgaaaccaaccggatcccctttagactagccaaccctaacctgggtcactggaagaataccttcaagtcttggccatctctcgaaaaacccacacctgataaaagctggaccacctggtaccaacgcgtatcgtctagtaagaaagttcactgggatgagattggaatcggccaagcgcttgctctcaccatagccaattctgctaaggatgaacctctgatggctaccgccacctacttttggtccaacaccatcaatgctttcttattcaaccaagggccgatgactccaactttaatcgacatcaccatgattactggattagatgtaacttcattggctaaccctatgagtatgaacaccaagaaccaatttgacttcaagaccaaaagcataggtggctagtctggctatgtggcagcatatatgggccaagggtctgttacccctcgggaacatgtagctttcttgctcatgtggttagaaaagttccccttctatggatctagttgtggccctacaaccaacaggcaatttgtagctgaagccttagaatcaaagaaagaatttcctttgggcaaaatccatctcggctatctgtaccaaacattgaacaacgcatcggctaaaatagccgtcggctcaatagttggagcaggcggaccatggtggctgctgcaaacctggttagtcctgatagtcatgaaggttgtcaatcggccctctatgacagaagctgaattcccactgccagagccgattgcaggagacgatggagaagagcgcacccatcgcagatgcatgtcatatggagaatatgcatccacaccaaccgatgctggagcgaagctatcggctgagctacttaagaattggttctgcagctcctatgaaggttttaagaaagatgcacgaatctggtttccctatgaagactcagcagaccttgaacttccatcggactttagatttgaagacattaatcatgaaaaattccaaaaatccagagaagttcttatagctacaatcagcctatgcatcctccccgtcggcattcaccaagggagaaacatccaagtctcctacgagttttatcacccaatgagctcggccagacaacttggattgggccaactcccaatcggcttattctttgccgacaagattcaatgccgaggacaaatcacatccactctaatgatggatcggctacttaacctaccaagaccccctctgggcagcattgataatattgagttggcaggatttagaagcaaaaactttgacagatggtggggtgaatggaagctgcatctatttcatcaatcggcttcaatgtatatgacagatctattccctgacgtcataccccaggtaaactttgtcattactaaattgcataatcagttagccgattcattacttgactaatctttttctcctattttgcagacaacagagtcctcccctcctcatcaaagtaatagtggcaaggacattgaatatgctcaaggtctaattccgaatggaggtggactatctccccctgttatcagctaccatgcccccaagacttcaacttttcttcacggcctaaccagggaactagccgatgcacgcaagaaaaggaaaaccagatcatcggccatgagtaccttggtcttagctccaaagaaaaaggccaaattcaagaaaactaaaccgactgataagtcggctgatgatctacccgccttggatacatctattgaacaagctttagatgcagaggaaattggtgaagatgttgaccaggctgtagccgaaatgagtgacacagaaagaacaccatcggcttcacccaagcaaacgcctccaactccttctgcccccattcattttacaagagtaagtatctctctttgacatcttctaaaattacttccctcttcggctaattactcatagactttgtggttgcagaaaaagaaaactgctgtgaagaaaaagccagcagcaacgattgccaagtcggctccaccagtaagatgactttaattcttttacttaatcaaactcaaccggctctatataacacttgtctattctacagcctcctcttgcttctcctcctgtatagcaatcgtcaagtgaccagactccatcggctgtggggagtcatcacatcaaggaggaagaacaaccagctgctcctgctatcccagtaagttttcctttgtctcaacaattagatcggctataatttacccaactcttactttttccgaaattgtctctgcaggttctagccgatatcttctcttttgatatcagagattaccttgatgaggcagacgaagacacttcaagcaaagccctagctcccctatccgatgatgtaagaaaaacacttgaagacatctctcatcggctagaagcctcttctttagatagcttggtagttgactgtggatcaattaggtcacggctgcatgaaattcaggctctgattcccgaagatttggccgatgtcctaactccagccgcttatctcgagcaacatcagttcaagctggaaaaagccaagctaagactagccgaacgccgtgagcgcaaagagattgaggtcacaatccaagctaatcggcagcttgtgcatgaggaaaaaaccaaacttgatcagctatctgaaggtccgatcaaatccaatattgatcagcttgaagctcgcaagattgagctcttggtgcaacttgaagaatgcaatgccgcgctagatatggaacacaaaaaactagtcgatctcccaaaatcaattgaagaacaaaaaacaaggctgaaatcggctatcaagaatgttgcgaacttgaccaagtccctaaaagtcatccctggaactgatgctcaagatgcccaagctattgaagaagtagaacaaattaggcaaagggctattttggctatccagcgatacttgtctcaataacttttgtgtaataggacttagaaattttgtaatcggctaagacgttctaatactttactgtcttgacaatcctttgtgccgattaatatgatttttaatatgactttgaaattcgctcaaaaatttgcattgcattttgatatatatatgtgcccccctaattttacagtgtcaaaagcactggtaaaattataaaacaactaagggcgatataacaatatcagccactgtacatcggcaaaccacaaccgattacaccatgaaaaacaactaagggcgatataaccatatcggccgtctcaaggcgatgtaaacacatcggctgtcatgcatcggcaatgctagacgatcatgcgttaacccaaacacttgggtaatattgcttcaaatatttgccattgagcgctcgcccatagacttcaccatcaagcccttacagcatatatgctcccttagacacaactttataaatttggaacggtccttcccaattcggcgaccacttgccaaatttactatcacgagtaccaatcggcaaaaccaacttccatacaagttctccttccgaaaaatctttaggtaccactttcttattataatgccgagcaacacgttccttatccttggtaacctttgcaagggctcgcaatcgtgactgaaccagatcctccctctcatcggccataaggttgtaatactcatcgactgttaaatcgttttggaactccgttcttcgagagccgattctaacctcccacggcaaaacagcctcatgcccataaacaagtttgtaaggagggacttggatggatccatgacaagccatcctagaagaccacaacgcttcggccaaccgagcatgccattgccgaggataatcagaaattttccgcttaatcaatttgatcaaaattttattagacgcctcggcttgcccattagtttgtgcataataaggtgaagaattcaacaatttgatacccatgctatcggcaaactgaacaaactcatcggacacgaagattgaaccctgatctgtagtaatagtttaaggaataccaaatcggtagattatatgttcttgaactaattgaatggcatccccagaatcaactttcttcaaagcaatcgcctgcacccacttggtgaaataatcagttgccaccaatataaatttatgtcctttactcgatggtgggtttatcataccgatcatatcaattccccaacctccgaatggccatggcttaataataggattcatagccgacgtcggcgctcgctgaattgctccaaacttctgacaatcttgacaccccttataatatctgaaacaatcctccagcattgtcggccaaaaataccctgcacaccaaagtaaccacttcatcttatgagccaattgatgagtaccacaaattccttcatgaacttcgccgattgcaactttagcctgatcggcactcaagcacttaagtaacactccatcaatcgtccaataataaacctcatcatccaacagtgtatactttaatggcttatatcttaatttcctagaagccgattgagatggattattcaaatattgatgcacatcatacctccaatcatcggctgtcatcgctgcaatttcaactttaacatctttgatcatcggcttataccccgacgccccttgagctaaatcattagcttcaacattttgttctcgagagacatgctttaaagtaaccagccgaaactctttcattagttcgtggcacttctcataataaactatcaatgtatcattcttgcatccatactctcctgccaattgactgattattagcaaagaatcccccatgatttcaatggcatcggcttcaacttccttgagtaattgcaaccctttgagcactgcttcatactcagcttgattattagtcgcatacggtttaatagtataagcaaactcgaagcatgccccctaggggaaattataaccagaccgataccacaaccatgagtacacaccgatctatcaaagaataaagtccacggcactatatcaactgagccaattgaatcattatgatgttccacaataaaatcggccatagcttgtcccttaattgccttcaacgactcataccgaagatcaaactcggttaaggaaaatatccacttttcaacccttcctttcaatattggagccgatagcatgtccttgacaacgtgggccttgcatataacagtgcactcattggatagtagataatgcctcaaccttgtacacgaaaaatacaaacccaagcataacttctccataggggagtaccgagcttcagcatccaagagtcgaccactgggatagaataccacctggtcctttcctttcaactgctgaatcaatactgacccgatggacttctcaccggccgataaatataacctaaacggttttcctttttggggaggaatcaaaacatgaggagagctcagatattccttaatattatccaaagccttttgctgctctgcccccaagtaaactgctgatcggctttcaatctcaaccaatggtgtaaaaggttctaactttccagacaaattagaaataaatcttctaacaaaatttatcttgccgatcatctcttgtaattctgtcttattctctggaggctaaatcttcttgatcgcattaacactcctttgagttacctcgatccccctttcatgaacaagaaatcccaaaaactggctagccgatacaccaaaagcacatttcgtcgggttcatcttcaggccatattttctggttctctcgaaaaccttcctcaaatcggttatatggtcctctatttctttagacttaacaaccacatcatcgatgtagacttcaccaaccagccgattaaattacgatgtatgtaattcatggctctttgatatgtagctccagca

SEQ ID NO: 69189 - DNA, 8452 bp, Oryza sativa
tttaagagctctatcagcttggttctaaactctggagataagttcttactaataaatgtcggccttggccgatcgcctggacctatgtctatttctaccagatcatcggccgacatgaaaccttgaccttgcttgtcatcgagatcatctactgtatccttagtgtagacatttgaaccctccacgacgccctcaaaataatagcttgggttctccatcttcgattggctgtatatcagaatcggacacttttagaaaatctccatcctagactttttcagataaacaatcaaggccatccatctctcaaagagctaaatcggcactggcaacattaactgacctgtcggctggcatgatctctatcttgtcgccttgccattgaatcaaacactgatgcatagttgaaggaatgcaacaattggcgtgaatccaatcccttccaagcaacaagctgtaagaacccttcccatcgatgacaaaaaacgtggtaggaatagtcttactgtcgactgtcagctccacattcagaacacctttggtttccgatggattaccaccaaagtctttgagcatcatgtttgtcttgatgaaatcctcggcatttctacccaactttctgaacgtagcataaggcatcaaatttaccgcggcctcaccatcaaccatcattttagacatcggcttcccattgacgtagccgtttatatacaatggtttaagatactgattctctgtcccctcgggtttctcgaacactgcctgttctggtgacagaaccaacttagccgattcctcttccgcctcgtcgacatcggcttgatcgatcccgaattcggctagcaaggtaaagaccatgttaaccggtgccgtcacaacactcttcccttttgccaacctctttgcctcatcggctgcaacatcatcggctacaggaaccagattcttaacacgccactcctgccttggctttgctttcttcagccgatgattaatttcttgttcaacctcctgaaggcgctccctgttcctcaatctttgaacccttctcttctgattcttcgtgaaaataccagaaggacaccattgattcttcctgattacattgtcctcttggccatgatcttgattcactggacctaatctttgatgaacggaaactcttgtctgccttagccgattacccttattatatgatcggcttgaactctcgacaatatcactgcacccaggcagttttcaatagatggcaacctcataccttcattccagcagaatctaaagaactcacaaccccaatgaggatcaaaaccatcattgtattcttcattatgcttctcctgctgcctgtcatacttcctctgatatttgttgataatcttagccgaattcacctaaaaaccccttgcacgggtcctatcggctgtttggccagctgtatgccccatattaacaggaaaagggttaccatcgaccttcatcggctttttggaatcatcaaacctaatcttgcctccctcaatggccacctgaatctgctctctaaaaaccttgcaatcgttagtagaatgggacccagaattatgccatttgcaatacctctttttgcctaattcctcagccgatgggattgtatgaccagcagaaagttgaatttgcttctctcggagtagcagatcaaagatcttgtcagctttagtaataccaaagtcatacttctcctcttttccagaactttttacccattggcatggtatgacatttttactcctcacccattcggctgcagctatttcagaatcgtcctcgtcatcattcaacccatagatgtatggacaaacatgattaactttcttagagcttttcctaacttccgcgaacctatgttcatgcaaggttactttctgtatcggatgtgataagctatcaaagtcttcagacaagaacttctccctaatcggagcaatcataccctgaaagaccaaatcgactaactgggcatcagttaaactcaagctgaagcatttgttcctcatctccctgaatctctaaatatactcgtgcacgggttcatcatgccgctgcttaatcgctgtcaagtcagataatttcatctcatgaaccccactgtagaaatagctgtggacttgcttctccaaatcggcccaactattgatcgacccatacggcaaagaggaaaactaagtaaaagtcgatccagacaaagataaccggaacaacctaaccttcaaagcgtctatagccgatgcttcaccacactgagctaagaatcggctaatgtgctcataagttgacacaccatcttgtcccaaaaatttggataagtctggaactttgaactgattgggcagaggaactctctcaaaccagtcagggtaaggctgccgatacaagcttccagtctcttttggtttaagcccaaactgttccctcattacatcagcaattacatctgcccatggtcattgttgagctgccccttgtgactgttgctgcatgggctcgaactgaccgtattgagacgcaaactgaggttgagccaatccccctggctgatattgggcttgcggggaaggaggctgatattgataattcaagttacccccttggtaattgtgaagattcagctggatattacgtaccaagtgctcagggacaacttgaggcattaatgtgccatccggttgtacgtggtgaaccaagtgttctgggacaacttgatttaaaaattattgcaccggctgaccatcaggcgtcgcaaacccggccgatgcgcttattgaaccttggtgctggatcggctgaacaatttgctgtcttaacggcgtttgctgaatcggctgcagaggctgctgccttggtggtgtttgttgaactggttacctagcctgttgctggattggttatacaacctgctgaattgggggtgtctgctgaatcggctgctgctgaatcggctgttgctgtattggatcaacaacaggttgaggtgggagaaacatggcagcaacctgatcttgggttagccgattcgcaacctgcccactatgctgtggctgctctctcattaacaaccgagggttcaccggctggcctggcgccatggctgatgaagtatgtaggggagttgatgccggcgccgttggctgagtcgttggtgcaatggacggaaccgcctaagtagatggctgaacatcggtaatcaaagaccgataatttgggaagacacctccttgcaaataaaccgggcctacagcctcatgctcagctattgaaccatcaactattgacttcatcatgtttgataagatattgactaacaccctagactgattgatcaaagcatgatgcacaacataatcaacccgatcttggaagttattgaaaaatcctgtgccacatcgctattctgattaagatttcctccctgtagcccctgagcaccatctccatgcaccccgtcaccttgtactccacggactccttgagaattgtcgccttgatttcctagagagccgtcggtagcacctttaatactcggctgagccgagccgtctggagcttgtttcccatctccctccttagaagaactggtcctaggatcatcagcgaccacttttattttgtacttctaaacaagtgtccccttgcgggtctgcatgaatgagttcaagaactgatcccgtgcttgctgcaaaatttgcttcaaactctttcttctgctcgggtgtgaatttttcttgatcgatcggcatgacgtttccttcattgacgtcagcaatcctaacttcagcatcttgtccttaacagagtctgggcaagatggtggtggtggctatttctcagccaagaggaagaattgttggctgacttcgtaaaggtcccaccaggcatgccaaaagcgtgttgatagaaaacacgtggcttgggagatctgcttaactccagtgcaggtccaaagctcgccttcgaatgtatgagcatgccagttgatttgatcctgtaatcaacaaaaaatagaagcaaagaaaccgcggttaaatctataaatgatagtcgatcggctaggtgccgatgacatatcatttatctttgagccgatgtcatatatgtatcgatcggcagtcatgaataaacaagaaggaactaaatctactcgatcggctgtaggtattcacaatatatactccttgtatcgatatatacttaaatcaagtgattgggatagatcggacgccatgccgagacagtataaatcacttaaatcgaaatatatattaataatgggactacatatgttcatagcagagccgatcatatagatctagcatgtatcggctaatactccgataccactctatactaagatattaaagcaagtagaatatatcaaacaatggcctaatatacttaaatgcaataagatcttaaaataaatgccagatttaacatgtcaataaagcatatagagtaaatatagttaaatcagataagatcggctgaaactccgatgctaccctaatcggcaaccagaaggcaggctagaggttgattttctaagcatgacttaatagatcaaactcaactgatacaacattaagtatgaaaagaagaacaatatctagacaatcaagctgctggaagtttcatagagtggtagatatcttatataatctaagtcaatatcgaaatctaacctaatcggctgtcctctaccgatagatgttagccgattgtagattagatagtggtattgccagagattatgtaagatatatgatagttcgacgaattacataaacgagatcagagtatcacaaacatggaagcactaatcccgagaacacaagtcgtcataacaagttttacctcttgttgaagatcgaaaccgatgcagctcaacccgaaagcaagaactcgtcgaaataaaactaaagcaaaaagggtggcgatgcgccgaaattgtattgaacgtgtgtgttaaaagttacatagggctcgggtctatttatacccgagaattacaagatatgcccataacggacacgactaatatctttaacaaactctaagataccataagtctttacggcagacttttgcccaagcatatctctaaggaaattacataaaatatcctaattaatagatacaattgacttctcaagactctatccatgtgcggcaatcatcttgaagcgccttaattcaacccaatatcatacatcaagttgcattatcggaatcggttgtatcagcttacctagtccgactcagacccagccgatcctaatcgtagccgatctggactccagccgattcctgctctgtttctgaactcgatctccgcctcagactttgcttcgatctaatcttctttcccgatgctgatattaccaaatttggttgttaacatggtggtgtgagatgcaagcggctgggtggcggcgacgattcaacgtcccggttatcgccaaaggaacctcctctccatggatctccttccctgctaaggttagattcctgttttggtcgactgggcttggtggctggaggaacagggtggtggttcgaattcggcgatggtcattgtgtactagatgggaaagcgctagtgaaagccttgcatggcctttggctggcgtcgacaccgttaggcattattcccttccttggaagggtctttatggtgttttctatgtctctaccaatctccaagtgaaaagcttgatccagtcgctggccgacgagcggttgtagcatttcacgtcatgtcctccatggggatgctgttttggagagatctacccatgcaacgatggccgttgatggactcttgtgcttccgaagcactgtacacctaggtgtttggaatggccttagccgtcttggctactttcttgttcgtggtgggcatccagctctcttcgttcgtctttgctaggtggagtcgaagttgttacattgttacagtgcgatgaagcttggcaacgataacacattgcagtctctttctggggggtactggtgttagccgggtggaggaaatggtgcgtcgttttgttgttttggtgatgcctttgccaacgatgacgtgatctctatggagtcaaacctgttgcgtcactaggcagcaagctcaggcctcggcaacattgacacttgctttgcgaagttgaagctgtttgccgcttttttagctagcttgacattgatgtccaccgttgggtttcatcgttgtttagttggtagttggttagagttgtgtggtattccatgtgttgggttattctactagctgcgattgaggtgcttttggcgagtctcttcttgttgagagattgtttttttcttttccttgtaaagtgtctgggttttactcttgcttaattaattgaaatgaaattgacatttctcctatcggtttagtttttctttaaaaatatatcactttcacccctttctataatttttatagaaattctgaaaacttataaactaagtgagagtttcagaaatggccgtttcccccctgtaatccacggtcaaactttctatgcgctagacggctagagcctagatgtctaaaaaacaagggatagaatgacgcaccgcttggtgaagaactgaagttaatggcttccttcttccttcactacactggacaaggtcaccagtgacgggcccaaaccctcacctttgatggctttaggcttggtcagtgatcagtggtcactagtgagttcggtcacctttgacgggtggaagaccattactgatgacagtcacctctgacgtgctagaactctacggcccgtcagaggtaagtgtctgtgctaacccatgccattttgcaacccgtcatagatgactcacctgtgacggctcagagtaaaaaactatgtcacttgtgacgacatgtatgtgcaaaaccgtcactggtatggtcacctgtgacggcttttgcaatatgaaccatcagtggtgagcttacatctagaaaaaaaaataatttcccctaggatttgctaaccatgcctctggaaaaacagaacatacacatgcaatatatatgtctccagtttcagcccattgcattaaaagtttcaaactaacatcacatgaattccaagttgtcaccgaaaatccatagacattcacacacatgcattgcaagttctcaaattgagccaagccgatgcttcaaagcaccagaaataaatccagaaaaaaaagagaacatacttcgatgccaaaatactgaaaaatgagaaatacagcctaagtgccacaaacttgaacatagcatttccatctttggtttctgagcctgacgaatatggtatgacatacaaacttacaattagatcagcataagtacagcccccagtgcctgtaatgacatcattcagagaagtttaatgcaacaatatcctaacagcctaacaaccagatatatgttacagatgggatgacagtagcaggaacagcttcgatatgttacaaatgcatataactatgcaagaatagcctaacagctagataatcagcataagctgctccaaaacaacaaattaaaatggggtcactctgactgagaaggcaaaaataagtttacctcagattagtattcattagctagcttttcaaccatccttgatagtcatccatatgcatgtcagtagttaaatattatctgaaagaaacggaaatagatcaactggcagaggaagctcaccatttgtagaaagaactagcgtctaatttgttcagctagtatagaaattgggggatttgtagagtatgcaagaacacaaccaaaagaaacttctggtaagaggtctaacaaggaaaataaaaacagatttagtgatgcatcaacttaaatagaacaagaaaacaaagcgaaacaacatgcatgcccactatccaaacaaaatactagtacacaaagagcatctaactaatgatccaatagctcatgatttttgatggggttaaagctagatgcatccttggacaaggatttagccacaggaaccacaggagacgccggaattggttgactgcaagctcagatgtgaatgcaaggaaagaaaagggtgacttctgcttagcactaaactgagtaaaataaatgaggggacgggtgactaccgaagaatgggggaaggggacagctgaagcttgctctccccacggcaggttgaccttgacaacgtggtgtggtgtggacggcggaccgcttacctcacgaacggatctggtatcggtgaagctaggtccgcaggatctgaagcacccaaactcgggatggttggatccgcgacctgtgagttcagggtgtccggatctggagcccccgagttcatggttgctgggaccgtcagggggaggctgggggatgtagaagctcgtcgtcgaccggaga

SEQ ID NO: 69190 - DNA, 8231 bp, Oryza sativa
attcctgcagcccgtcctggcaccggcgttgtcttcgtctttggctcgatttgacctggatctggcgtggtggaggcggaaaggaggcggcgaccgtgggtggtgggcgaaggaggcagcgacccggaggcggtaggcgaaggagccatgacggggtggcggagagacggcggcggcgaccatggggcggagggcgaaggaggcggcgacctttggaggtgggcgaaggaggccggcggtcggtgggaagaagagaagagagactgagaggaggaggagagagactgagcaggtggcggtgggccccatgggtggggggtgggggttccttttttatatgtcaaaattgatcacctttgacgggtgcaaacttaaaatcaatgacgggccagaagtcatatccgtcacaggtgacggcccatcacctgtgacgggttgtaactccctggcccatcacaaatgaggtcataccagtgacgggttggaagtcaaacttgtcactgtcttacctgtgacggcttaaaattctggcccgtcacaggtgaggtgatacctgtgacgggccacggctagatgcctcaccaatgacggtaaacctaacgacccgtcaaaggtgacggtcatctgtgaccaatttataaacccgtcactaatgtgccgtcatagatgtagggttctggcgtagtgcttaatcttcgctctcagctgtgatcaatgacaggaacacacacacatcatcagcccctaaaaccagcaaccatgcatgcctactctacactcaacaaataaatatacaaatcatgcatgcatgttcttcatatcggttatctggtcaatcacacaatcaccatcaaacaatgtgtgagattctcttgttacttaggtaccaagaagttatgcaagaacaagctagatcacacacataattaattatgtagctagctagccgccatgcgagcgttcaaagctatatccacgtactggatcatccacagcgcgaattcagaaatcgcaataatttaaaatattctcacgcaaaatcgtctataaattcgcatcaaaatctgaacccaaaacattccatcatcgcatgctttgcattgctctcccttctaaaaaacaatcagaagtcgcagacaagaaagagacgaaaatgtctaacacctacgtgtcccatgtcgctgtcgttgtaatcctggcaatggcttcccagtgcttcgctgccaccaccggcgccggcaatggcgtctcgggcgcggacgccggacgccgcgcgcgtgccgcgcagacggtggcggggatcctggcggtgcacaacgaggcgcggcgcgcggtgggcgtggcgccactggcgtggagcgcgggcatcgcccggtacgcgaaggggtacgcagcgtcgcggcgcggcgactgcgcgccgcggcgctcgccgctgttcaacttcggcgagaacgcgttcgtcgggaaggggcggcggtggaacgcgccggcgctggcggcggcgtgggtggacgagggccggcggcggtacgactacggcagcaacacgtgcgccggcgcggcggcggccgcgtcgtccgggtcgtcgtcgccgtgcacgcggtacacgcaggtggtgtggcggaacacgacgcaggtcgggtgcggccgcatcgtgtgcgactccggcgactcgctgctcgtctgcgactacttcccgccggggaactacggcaccggccgaccatactgatcgtgttatacatatagtgccgtgccccggagaataatcacatactcactccgtcctaaaaaaaatcaatttatacggacaaatttgaaccaatatatgtatgtgttcatctttacaagttattttttttatgggacagagagtgtaggtcgttgtgcatgcgagtgaattactattctgcccaataagccgttgtgctctaatgcttgtgcattatatatattttcttcaaatataatttaattttgaattagtacaatttgatctgtaatgtcttgagctaaattgtgaagattatgctctcgtattcatttttctgaaaaacaacgaaccaaacaatattcaaagcatagaatatcaatatatattttaaatactttagactagatatatacatgacaatttatgtttagaataggcatgaaacagtataattttatcatcaggttttgtgaagaatgtatatctatggatattattgctatactgaaggctttgtaaatgttcaaaacgatacgtttacacgacaggatgaagtaaattagaggcaatcagacagactagcatatttgtttgcaccagcgagagcggtggtgtcagacatggctgtgcctcgacgcaacctggggtatgcacagacctagcgttgccccacgaggccacgacacaaaactcaaagagatgccaaggacaaatacaagatgttacgtgtattcgaatggagattcataaatagaatgagttttttattttgtattattttgtattggtgtctattagtctgtgattgcttatgttatgtcagcatgtgggtaaggttgtttgtgagcatcatcattgggccatggatttttgacctgaagatacaaagccagaacatgatgaccataacaaccacaaacatgaaattagaggatatatcattataaacctggtagaacatttaccttgcctatctcatggaggattggaggcacaacttcatacaactttgagacctgaaaggaaataatatcaacagctcataactcccctaccctcactcttttcacagttacatgaatttattttggcttctcggattggttgtcatatagtttttttggagttgggcaaggggaaccggtggcacgccgttccagcgaccatggcattgtttcccttgtgcatggtgatcccctcgtgtccggttctgtcaactggatatgggcggtgagggcatgcatgtaggacacgcacacatgtttttttcgtaaaatcccctaataatcggagaaatcgtgaaacaatacttccaccatttacgagaaatataacataaagaaaagaatatgccgtttttagagatggcgctgaaatcctattaagaatgtccgcattattgtcattacgaacttgttcgtctcaacagtttcgactttcgagtctagtttgctcgtaaccacgagcgatcaatccaagtaataaacaacttattaacagtcattaatcaatcgaaattaacactcccccttgcataaccccggtaataaatcccatgagttaactatacaaagtaaaattcaaaagccaaacccccacaaaattaacagcagcaattaattaatcaatcaccgcagtatataataaccccgagttcaccacaacttctccacaaacaaattaatcaaccaacacaccatgtctcccttctactgctgcctcgccgccgtcctgtcgctggcgtcggcgtcgccggccgcggcgtccatctcggtgtccgccgccgcggagcctccggccaacagtttgttgccggcggagcagttcctgcgggctcacaacgaggcccgcgcggcggtgggcgtgccgccgctggcgtggaacgcgacgatcgcgctggacgcgcagcggtacgccggcgagctccgggcgagctgcgaggcgcggccggtgtgggcgtggggcaccgacggcttgtacgggcggaacctgtacagggggagcggcccgcgggtgcgcgcgggcgcggacgcgtcggcgcactgggcggagggcgcgcggtggtacgaccgcgacggcgactcgtgcgcggcgccgccggggcggtgctgcggcgagtacacgcagatggtgtggcgcgccacgacgcagatcgggtgcgcgcgctggttgtgccgctgcctgggcgacacgtgccctctcgtgttggacaccgtcgccgtctgcgagtactacccgccgggcaacatcgccggccagcgcccttactaacgcatatatatgccgcggtatatatatgtagcacatgcacgtgcgagctcataaaatgttgtggtgtaataacacgtgcgtgatcaactttcaagaacgtttttgttcttgcattggaacaaatgtttgacaaattaatactacatataaagccgtcaaaaaactgagaagcacgttctaattgttgaagaactctactccctgtttttttatatattattaaagcacagtacaagcgtggacgtttttaatgaaatgattgttacggttcgtattcctcacgccactacttaatgttctcaacgacattcaaaacaatcggtttttgcgtggacgctgccatgctggtcacttcctcctcggaagatgaaccgctatacgccgatcacgtcctccactaccatggctcgcctctctatctcccatgccacatatttttattctaataaataggggactgaggacaatgggagttttatcgccacccacttgtgctctcacttactgcgcctcatgacctcctccccattcactctagccatacagggtttcaccactccatctgcagagcatgaaaactagttaggaggataacaacagcgacaacatctcagataaaattttcaaaactttggaaattattattgtggacggcttctacagataaccgtctgcaaaattcttttttacggacaactagtccgctagtttaaatattttgaactatttaaaaacaaaccggggcccaccgatttatacaggtgacgctctgacacatctacctatgaaaagagttttcgtaggtggttattgaagacattcacttttgagaacttttttacagatgggtgtttcagacatcacttacgaaaaatcatttaaccataataatagatagtctcaagtacttcatagttctaattcctcgagtttaatccactggaaatgaccagtgctagcattatattacccgccatatctagcagtgccgccatgggtgcttggtagatacgcactctacctactcttccgctacgcctcctccacctgcactaaagcaaaggcaacgtctccacatctaggtgagggctgttttatcggatctgcacttatgtgcgcctgtacggttgggccctgtgcaatgcgatgtcatttgtcgagttgcctatgacgctgcaactcctctcgtctctcgggcatttctgcttctaggtaggccataggcagatactagactactagtattaggtgttggccccccaccatcatgggcccccagcgatcgcctcggctacatagccccagggccggccctggcttttcctgatccatcctgattctgcttttatcagagtatcaagcttgcttgtatgatgatagtacattgctttgttacctttttgctcgctgcctagtgctgcaatacatcgattcagtttcttgcttctatatgcttgtttatattaaatgcatgggaggaattaggaaattacggaggaaatcaattaaaggaaaaaaaatatttcactgcattttatatcttttatttggtcggtcggccacatgtgcttaataagttatgaaaatcttattgcttctacgtatgtgtatgttgtgtggatgtgataataaggttgtgatacgtgtactagcgaatcatcgtgcctaaactcttcggatattccggaattccatccctaggtcccgacattaattttattttctcctcttttattactatatctttgcgaggcaactacgaatcgggcgtcggatttttgagagaaaaatcgggtccccctcctgtgcgctcccctctacacattcattgcatgaatgctgcatgccagctacttgcttcctatgcctacatctcagctacatgcaatatccaatactaccctcactttcccctatcgatgcatatctagcttttcttaacatgtttaaattattttttctcttaaattattaatcccatatacaaataatgcaatatgattgcatagttgtatttttttaattaaatctttacaacaagatctaacataactatattttaatgaaaataattaattgatgctttatcacttataaaaaattgtttcaatttgcttcataagatgttccagagagatgcaacattcaaaatataataactgcaagaccgtcaaccattgcatatgaaagctattcacactttcacagtcggtgtagcataactcccctagtaaaaaaccatgagttaaaagtacaaattaaaagccaaaggactcacaaaacggcagccattaattaataagaacccccgctatatatatacaatcgcgagttcaccacaacttcaccccgaaaccaccatgtctccactctactgctgtctcgtcgccgtcctgtgcctcccgcgggcctccgcatcgccggtggcggcggcatccatctccgtctccgccgtgcagacccccgtcgagccgacgccggtgcagttcctgcgggtgcacaacgaggcacgcgcggcggtgggcgtgccgccgctgtcgtggaacgggacgctgcagctggatgcggcgcggtacgccggcgagctccggacggaatgcagcctgcggccgccgccgcccaccgcggcgcggggcaccggcgacggcgccgccgtctacggccggaacctgttcaaggcgtacggccggcgccacaccggcgcggaggtggcggcgttctgggcggacggccggcggtggtacgaccgcgacgccggccggtgcgcggcgccgcccggccggacctgcggcgcgtacacgcaggtggtgtggcgcgccacgacgcagctcggctgcgcgcgccgcacctgccgcaacggcgtcgacaccgtcgccgtctgcgactactacccgccgggcaacatcgtcggccagcggccatattgacaatgatctcatctgtttctgcgacacacgacacgcaatgaaatgtagtacatacgatcgatggttctggtgagtgattgagtttttggaacaaatgtttggagaaatatatgaaacatgctccaaagaaaattaaagggatactctaagataattaaatatggagatttaatgatggcagctgcgatgaggattcaaatatgtattgtcatcggagctagatttgttcgacctctccatttcccataatcttgccgaacaactctactctctcccaagtccgacccaaacacggataaatgaactttttttacaaggttatattttacctggcctctacatccaatcggatgcatgtgagcctttttaaattggaaacttaacccctcaaaacaactcaatctgaaatttactcatatggagatttgaattcagataacatttttacattaggaacttagcctatcaaacaacccaatataaaattcgctcatataaagatttgaactcagagccttgaggtgctactcaggtcacatgcccttccgcccgataaaagaacctggtgatcggtgttgcagacaccttatcactgttgcttgaataagtaggaacaacaatcttgacaaaattaaaaaaatacattttttaaaaaattggcctttttttcttttgtttggcacaaatgcaaggtagttgtgtggtttgtagcgaatccagaaattttcttatgatgtagaaggagcagctggaccagacttggcatgggccagttttcacattgaacactcatttttcacgaaaataaaacaaaacaaaatgaaattctgatggtcggtgatggctgagttaaaaatacagttatggtaatacatcattctacacattttaagggggcaaatcacacgaattccctaccttccattatgcttctagattcattgtacgtcctctatctgttgagctccgacgagtgatgaacttggcaaattttgtacatattcctcaatcttaaataaatttggttggtctatcttgaccggcccgacaaaaaaatgaacttggaagaggaagtaggaggtgttcccgacttagagggataagaggtgaggatgagagtaagggatggtgggctggtggccatggtggagtggcaaggcggtggtaccagtagcctcgacagtgggagagaaggtcggtggacttgtgttggcggggacgtgggatctagagtggttagggcgaatcgttaaggacggggaagaaggtgcaggggcactctactactgttcggaggaaagtgaagctaggggaagagg

SEQ ID NO: 69191 - DNA, 16707 bp, Oryza sativa
cttgtccgtttgtgctagccattggcaaacaacagtgtggctagggtgtagtccacctgggaagggccatgagttcattgaactcatgtacacgtctacatagcagatctaggggtggtcctcattgtccccgtgctcccaggaccacctaaaaaaatcctagctcaatgcatatatatgtatatatatatgtgaaaataaaattttgaaaaaagaaaaaaaagcttctttattaatgtattatgatgcatatttgatcaatttatacttctaacttggaccatccatatatagatacgccggcctttgcatatctactagaggttgcggtgtgcaagaggaggcgagagagcgagaggggtgcagcaattggctcgatgtgggtctatggccccaggcatcattgacaagggtggatataagaagtgactgaaatattagatgtgaaatggatgaaaacatatggcaggttcttccactcatgcgctacctgtacatacattgctgttaattttactataagggcaggaggtcacagtgaacacacatggtgaacacatgataaaaattgcatagccgtgtatggttgtattctacatttaaccttactaacaaatttaaataggcaccaatgtatttgacaaaattatataatttgtgcagatggctatatggatgctacttcatactccctctatccaaaattcttaagcatattttattttttggttttttttccaattgagatggtcagatttgtagttttcatgtgcatagttaaattgttgactagaacccaagcaactatctgcaaatacttcattagtttgttacgtggaggatgagttaattcctccatgattttggtgacaaaagaaatatgacttttgggtggatggagtatttattagaatgtttatgaaattttgcattgtgctgaaatgataaatatttttttcaagtcttagctatttacatgcaaataaatttattaatgcaaaaaaaatagaaaccaggctaggataaattcataaaaggaagccattaatactcacatcgtccaaccatatcataattagacaataggctatattagattcttataaggaagcaattaatactcacatcggccaaccatatcataattagaaaataggctaggataaattcatataaggaagcaattaatactcacatcggccaaccatatcataattagaaaatagactaggataaattcatataaggaagcaattaatactcacatcgtccaactatatcataattagaaaataggctaggataaattcatataaggaaacaattaattctcacatcgtccaaccatttcacatttgtgaaccatgaatgaaaaatctttaaaaatagaggcaattaatgcatagcaaaaacagaggcaattaatgtagagccaactagtcccagtgaagaataaataaatgcaaaattttgtcacttacccccttcttttatattaaaattgaagataaaacctattggcttatatgtcagtgaccttatatgactcatatatcgatgatataggagggtatgtccaagaattataaattaagggagggtgtatgaccaaatctttcataataaattagatgtatccgaggcatgttgaacatgtttgcctttcttgaaagcataaaaccaccccccctcccctttcccacctcacatgtcccacctcttccccaccccatccccttctcctctcacttcagatcgacaaagagttctatatagtagagagagatagagagaaagctagggatattgagagtctgacatctgaaaattagctatttgaaatctagagagttgagaagttcaggagagtagagggggagagaaccgcgtaatcagatggcttcgtcatcaaatccatcaaatcttccctgctctagtgatggtgtatgcatgttatgcaaggtgcttacaacagaggtagagcagctgcgttgtagcacctgtgctacgccatggcatactccctgcctctccagcataccgccccttacagatgtggcccactgggtctgtccagattgctccggtgatgtcacagccagctacccgccatctgatgttgttcgtccggagagcagcctcatcgctgcgattcgtgtgattgaggctgatccggtgctgtccatccaagagaaggctcgtcgtcgccaggaacttcttggccatgccggtgatgcaggggctgcaataactgaagctgttggggaaaacgtagaggacagtgagagcaacaatcctttgtctatgctgaacaagaacatcaactgctcattttgtatgctgcttccagagcgacctgtcactgtaagtatgattgctcttttgccaaccctgtcaacctttgctttggaacagcctagaaaaatatagaaatgtttccatgaggcactacatgtcataatatgtaagctcataaagtgtaagtttgtaccattacttagatctcagatcacactgaagataggctcctattagcacacaaataaattatgattaagttgttctgattttatttgaattgatctacaattgctgtacttctactgcaaattacatcaagtatgatatatacatgaaaatacagggagctactggattgttggtttctccatctatttagcctgttttactgctctgagatatgcctctgtggatgcaattgatctcctttgacttttgccagtatctcctcttccttctcgacagttgtgtcctctcttcagcagcacccaccttcccgatgtttcttgccaactttataattttcaccttgttaagaacctttctctcttgattatcaggctataggatcttccagttaggaaagagctatgtatagttttcttctatagggacagtgatcattacatgcatggcatctcgttgcttatatgctagccctcctcctatgagcttaatttatgttgccatcgatctgtctcaacctggaaaatttacattacaaaaatgtcatgcacatattcgtagccaaagtcacatatgatcgcctcctattgccttgcatagctaatagttctgcattcagtataactttctaatacaatacctattgccatttgcacccactatgaaccatgcacaactaagtcgaatcaaccatgcacatatgtgttttggatatttgtattatctcgacaatttttaatctgctccttgttagcaagaacgcctcgtttcatagcatatgcatttgtctggtaccataatttatcacagtgaaatgactaatgatctcacaaaaagtggttttgttcatgttactttttatctccgtcctttatttaaatattgaaatttgtggaagcttcatttattgtttacaaaggatatatttccatggacagactagtcggctgagactcattattatctggctagttcattttcatgttatttttcatgtaactacattattatcctatgaagataatgctaattaaccgaatacataggaatttgaacaccatttatacctgtgtttcagaatattttactttgctgaacatcaaattccattattatagcatccatgtccatcaattgtcatcacataatattttcctttgcttacatgtattgtgcagacaccatgtggccacaacttctgcctgaaatgcttccgaaggtggattgaaaatggtaaaagagcttgtgtgatctgccgagcacctattacacaaaaagtagcacaagatctaagaattaacttggcactagtccaagctatccgcatggccaaggctgcaaacaatgctagcacaactggtgaaacaacggtttatcattataaagaaaatgaagataaacctgacagagctttcactactgaaagagcaaagagagctggaatggcaaatgcttcaagtggacaaatatttgtgactattgcaccagactattttggtccaattcttgaagatcatgacccaaggaggaaccgcggtgttcgagtcggggaccattggaaagatagaatggaaggtagacagtggggtgctcatttccctcatattgctgggattgccggccaatctacacatggggctcaatcagttgccctctcaggaggttatttagatgatgaagatcatggagagtggttcctctatactggaaggtttaatattactacctgaccttacattgcgatttgtttctgtggtttatcaaaaactagttaatccattattttctacatttggcagtggaggaagggatctaagtggaaacaagcgaacaagcaaggagcagtcttttgatcagaagtttgagaagctgaatgctgcattacgtgttagctgcttaaatggctatcccgtgagagttgtacggtaatgtttttttttctctatgtgcatccatgacaaatttagtgttagtttatgtaaaatcatcattatattatttcctatgggttgcttccgggaccatcacaaaaaatcaaagccatcacagaaggacgttcttctggtaatgcacggagaatatatgtagacctctatatgttgcaagatattatttgttccattattgttatgtaattatgatacgttgcgaataactgtactcacacaaggttattgtcttttaaggctttcagtgttacgtttagtatgtttccactacatctaatacgaacaatcttgtttcatttctttggaaaaagtaatcccaatttttgtttttgtatatgttgttctgtttgtttattaaaaggtcttttaaagagaagcgctcaccatatgctccagagtctggtgttaggtatgatggaatctataggattgagaaatgctggaggaaaactggagttcaggtatttatagttttcatgaaacattacagatattttttgtgtaggctgcaatgattttttttttagatttacaaaactgaatgtatccaaaattatagtttatcaacttatcaatataagtgatgattgttggagtttttgttttttggcctcagggtacattcaaagtgtgcaggtatctctttgtgcggtgcgacaacgagccagcaccatggactaggtttcttatacatcccttatctcatgtatacagggctattgttattctatttatttacttttccatttaattttctatatttacttgaagtgatgaacatggagaccatccaaggccattaccagatattgaagagctgaaaaacgcaattgatattactgagaggaaaggaaacccagcatgggattttgatgtaagttgttgtattatgttctcagaaaaaatattagcttgcacatattgtgacatctcctttttcttgttataggcaacagatggatggaagtggatgattactccacccatcagcaggaaggctgtcgtaactggagatcctagaggcaagaaaatgcaaggagcagcaaggcatacaaataacttgtcaatgagagaaaggctgttgaaaggttttttttttttttgtctatgaattgcagttcatagtagtggctgcttggcattgcatttccactgatttcagtcatatattttctttattatagaattcagatgctccatatgtaggaacgtgatggaagagccagtgacaacaccgtgtgctcacaacttctgcaagaaatgcctgcttgggtcatatgataatctttcccttacagaggagagaagccgtggtggtcggaccctccgggcacgaaagattgttaaaaagtgcccttcttgtccaagtgatatcgctgatttcgtacagaatcctcaggtacagtaaaatagtagcaaaaattaattttgtatagattttagtcatttttttgcgagggatttcagtcatctttcccattcttagatgatgtattctttgttgtaaggtaaaccgtgacattatgaacgttattgaatcactccaaaaagaagctgagaaggaagatcatgctagggtgagtggagaaggcagcagtgcagcacttgtagattctgatgatgaaaatgacactgcttgggagaaccaagatgatggtaatctggatgagggaggttgcaacaatcctgaggacatgataactgaatctgttgatttgaattctgttactaatgttgataatactgaaaacaaggtggaagttcagcagcctcacaagcgtaccgccggtgccgggaaggggaaaggtggcaaatgggctaggacaagctctgcaccaggtgatgcagatgccaggaatgttgtgacttcaactgaaacattggatggaatagctgctgagaatgtggctgatttagtacaaattgaggattgcactttcactggtgtggaaagagccgaccccaatgcgttagaagttgatggcaagaatatgattccagacttttcagaagctgagaaggttaaccctaaacaggatcaagaagttcttccatgatgtgtttccttgcatacttgggatgtttaaaagtttttaagaagtagtattatcttattatctttggtgacattcagattgggatgatatcatttaatttgggaataattgaactcatagtgggggtgcaactttcacttcctcaggttcaaacattaagctgctgcattattgaaacttgaaacatatgcaaattgcttgtgaagttttttttgtattcttcctcttttgttatccctttttctttgattatatttttttttgcttgccctgtttactttgcaaaaactagcttggactgaaatgattcatgggtcgtgaaatggaagaaatagtggtgatatatattgttgttgcattgattcccagtttctttcacggtataatgcagtggtggatttaccacccggcttgggcaggcagttgtccaggctatatgaacgcaaactatcaaactggactgatttctctacggtaaaatccatggatttaattacttcctgcacaaaccaagtagattagatttaactactctagttgggctgtacaagcagcaagccttataggcttacagccctgtagcatgcaattgagccctatcacaatgaataacatatggcatgctcaagcttatacgaatcatcttgtctttcaactattgaaaattttacatgcattttgaactaacaaaattgttttgcctttaattagtagtaaaatgagcgtataggcattacacatgtgggtagcggatttggttagactttcccatgctttgtgaaattcctggctccttcactggtataatgcattactagataagggaaggctcctatatgctaagttctaattgatgttattgggtgttcctctcaacacctgggaacttagtggtcgtatcaacagatattctcgataacatctggtgcataacgtgtgctacaaatgaagaagaggcagaggtttttaaccctctcatgagtagcacgcccaaccaggttgatatggtaggacagagaggtagagctgaagtgactttcttggaagttgaattgagttgcaggtttgcttgaagtttcctcaaggctgtagtgctccaaagtgagtacaaaaattactgtgtgatggataccatgatgattgatgagcttatgataaaaaaaatatcgaaattttacagtgcatggtttattggttttgggtgcagaaatttggctgctattttattcgaatttctattgagcttgattgttttgactgaattaattggggtaccaactcaagtgataaaatcatcaatcttttattgcaggctattcatgccacctagtatttgtgttggtgtttccataattttttcaaacattagatggcatttaatttatttttccaagttaaaataatgcatgcaaatgcaattaggaatgcgagaaaaaaaaacagccaaaaccaactaaaagaacatatattcaaaggcaagcatccacagctcatcatactgttttgaggactttgtttcggtttcttacattaagagtgaatttaaactggatttgaaatgtaacatggaattggatggttttggtgatattccagctcaatctatttaatattaggatagtggaccatgttatgatgtactccataaaatattcacatttcattccattggtggttttgctacggaataacgaaaaaaatcattggtttaaatcttaattgaaaattctaccgttgactgagctaaccctatcttgaataaaataatatttcttctgaaaactgttgattttcgtttcgtacgacaagtttagctttatctatgatcaaattttcctagtccgatatgttttatagtgtatcccgcacatgaaggtcagtaaaggatgtttgctttttaaatgttgttggtatattttgatagctctagaagagttagaaaatctatttgtaattaattttattacttgtaatcatgacaataaaccttgatataacaaatatgagttttatattccctcttattttggttgcatttaatgcggttacttggttgaattatttgtgactgacgtttgatttatctcttcttgtatgtactattttgaaactcttttatgcaccggaatcataaaggaaagcttatataatatatttcaacactataagagtaatttaacatcaagagctaaaacttgggtaagttataatgctcaccttcattgagtgaaaccattgccgctataaagatagccaattttgcttcacgacattcaaagtttatataatttactggtgaacattgaaaaaaatatccacggttagaggagacgtcaaaactaataatttgatggaaaacatgcaatcaatattttattattttttcaccaaaaggatagagaaacccattataatgataaatttgtccctcgggccaacatatgttactatgattggtttggtcgaactagaccaaaccaaaccaggccatgagtatattttgcaacctttcccccttttttaaaaaaaataggttttcattttttaccctaaatatattgctaccatatatcatattccttcttcattctagagatagcttagaagcttctagcccgaggggcaatatcgtccttttgaaatatatctcgccgattggactggaaataacaaaataatggatgtggtgtcgacctttggcaaattaccagtttttgaaggtgttctcccaccttttgctatgtttaccaacaaacaagctatgtttaagtgacctgtgtcaatattttaccaaatgataatgacaatacctataactttcacttatacatgtaacttgatctatcacctatgtctgacagttgagaagatggttaggagatatgttccatagaataatatactgatccttctcttcatgggccaatcggcctagagtatatatgtgccatcatctacttaacaccgtcatcaaactcaagatgagagcagaggatctgaaacattgaatttgagcaagtgaagttaatgttatttctcaagtctatgcattaggatgctcatcagaataagcggttctcaagatctttataaaaaagcatcaacatctacaataacaaataaatgcactatcaagacataatattgtggattgaatgaaactaaattgatgtatatattgatgcacttatttataaactcagttaatgttagaaaacaaaatgcagatcacctagcatgatgaggtctactgcatcctcatcaatgcccccttttgtgactaagaagacgagaccattcaacatcccctttttatcttatgtgtgtctagacagatgtggttctcccttttgcatcaagttgtcccttgggctcttgaaccacaacctgtggttgtgaactttgatgaatggtggaaccgaatcaatggtatggtttgtgcaagtaccaggaagggtataaacaggttgatcatgcaaggagcttggtctatatgaacgattgcgtcttcaatggagtacctccaagattatcaaccacttgtggagtttggcagggactaaggggctttttgtaattatagacctcagctagggccttttatttttaagttccttttggtcgtgtaacaagttcgtgtacttcttagtgcttggtgtgtttggacgccttatttcttctcctattgacgcaatgatacgcttcttgcgtcttcaagaaaataaacttagaacaaaactatatgacttatattataaaactgagggagtactagttaaatagattctattccaccatgaatacaaattgccatgcatagtttccttgtttttgttgagaatataggcatataatgatttaatatattccataaataaatcatgacattacagatgtatactagcattaacgcatcattagatctacacatgtaaactaagcaataaaacatgaacagatcaaatatgcgcaacatatcgaacacgtaccgagatggcggaaagaccggttgctcggcaggaactactcgcggtagcgagcgtcgacgaaggcgcgcaggacgcgagcggagaggaaggcgagccgttgcggacgaaaagggagcagtcgcgcgaagcgcttcccaaaaaccttattgctgccttctcccggtgcaggacgtcgaaggcagaggttccggagacctgctctcccgatcgccggtgcacgctggcaagcgggatggagtagtccacaagcgacggcgcaacacagagtaggaggcaaaccctagattgatttcgtgtattttgcgtgaatgcggcggctcggtttatatagagataggtcgcttgatcagggcgcccggacgatctccattccgcgtaaccgaaccggataagtcgcgcgtaacttatccggatttttcggaatgtttccaaaacaaaacaaatccgaattttcgccaagggtgatgagccaattttgtggatcattcgacgcgtaacatcgtgcacgcgcgccgcaaggtaggcacgcgcgccgcctgccctaccttgccaggcgagcgagcgcgcgtgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgggtcttagcccatctattaattccaacagttttcaccatagttgacagtaacatttttccatggacatgctcccctaccaccatcactgttgaggcagcattgccaatcaaatctgatttcgcattgaaatcaacattagccattgatattaatttatttacactaatcagtgtggttttatggtgtattgttaattgcacatcagttcacaagctagaagtcattaaggaaacactctacactatttaaaatttatgtgaaaaattcttcatagtgtgtgaatattctctacttcacagtggtgtacattgcaaccaaggagtttctatattgggccgacatcagtttattaatcatcatacatagttttcacaagtatcttcatattttagtactttctagctagcgttgggttggaatccattaggaacccacctctcgaactcaaataatagcaggtatcagtacacaaagtaattgagggttggaagaaccaaagtactttatgtacagtagtggagttggtgttagaagatggaaggagtacaaggccaaaagtttgttcaattcctttgaaaaagcagttgttgttgcctttgttctcttccttgtgcttgcttgggccagccatagtgagttaatacaacaactcaacttgtattgacctgttgctagccaccggtcctagcaatcccctttgctttaaattcaggttgttcccaagccaataagttgaaacctcctagatctaatgactgaacatgaagtgtcatggcataaaaagttaccttcacatttaacaaatcactttcatcattccggccgggtgatttgcttccaggcatggtttcattcatgatattatcataaaaatggttcttatagtccatgtctccactctgcttcgtgctaggaagtaggaacatgatagaagtgttgggatattgatttgtctttgcagttacaacccattttttatagcgcaatatccgtgagcatattttcagcaaagcatcacaattgcatttaggatatgggcatagtgttgacttcatttctcctgtgatgtccctttgcttgtattactcccttccttccatttggacagcacctgaacaacggccccaaaaattcagtggatggtaactgcgaagcaaaatcaagatccaaacacttttgcatttcctgctcaaagctagcatcaattgcaatactcctattttcgtccactcatttcaaatctatatccttgaaattttagccgattccttctatgcccctgaattttcttcactcctttatatacctctgaattttgatttggatccctttcgtacccttgccatcaattgaccattagttgaccgtttaataggtatagaaaagttagttttacccttcaatatgtgagaaataagtagaaatttgtaaactgtattgttggaagtataaaatttgttgtgtgattatcatatgcataagtttgttgtacataaaaaataatatatattaaaaagtatgtgtagcactttttaaaatgataaatatagttttggaaaacattcctatataatatatacaactggagaaaatatgttgaactatcataaaaaaaagctacatatactgttttaataagtaaataaatattagttttatgtcattatataaaattaaactttttcataaaaaatacctggtataataaagtcataaatataatagtcttatattatatagatactatactacatatgaggtgtaggcgttaaaacacaccccccgcagcaacccccccccccccctcctcgtatagtaatcgtcaactgtggccccaccccagaacccgcccctgctttttccccgcgctctccattattttcggatctagccctcccgtacaccgcagttagccaagccgctccgcctcgtttccatagccgccaccaccgcctccccgtccgcctgccgccgccgccgtgtgggaggggataccagacttgggaggtgacggcgacgaagcagagaaggcgcccaccctctcccctgcggctgtggcttgtgctcggggatggatgcggcgacgggcgacggcgacgcactgcggcaatggcgagcgacgggctcggcggggctgtcccccgctcgaatccggtgacgacggtcgtcctccgcccggatccagtggcggcgggcgtccctcgcctgacctcgcacggatccaccggcggcggtgggaggagagcagcgtgcggcaggccaccttgcagtcctctcctcctcttcctcctcccgcttcttcctgcccgctgccgtcatcgtggttgtcctccaccagcttgccgcgtggccgccgccgtctgccgatggacgtcgactctgacccggccgccaagggcaagcccacccagatggacctcgaggaccaggtacgccgcagccgctcgactcgtccccacgggaattcttccttcagttttttattgtgactgcctaagcttggagagcatctcaatttctgttgaaacacttcagggaagcatttagctctcagagcattcatgagacttccatctataatcctactaaacttctggctggttcgttagttctatgtgatctggatttggtttgtgtaacactagcatccattgatattctgaatttttcaggcttctatacatctacaggtttctgtaattgataggttaagggcccctttgaatcacagggtagaaaaaacattggaataggaaaaacacaggattctgacaggaattaaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatccacatgtaatgtgccattccataagaatttcataggatttgaaaagcttcaatcctttgaatcaaagggccaaataggaaaatttcctataggatttaaatcctatgaaattcctatataaattctttgattcaaaggggccctaacaagcttttctaatttatttattttttggtgattgctgcttttgctggatcaagcatcatgagtgaatagtcctgatagccgagttttttttttttttgcaacgcatgaagaaccatatgctctcattttaattttcatttgttcagtcatgaattgttattgcaatatattcagaaaagtgctcccatctgaatttcatttgttcagtgatatatttgtgtgtgcaatatttggaaaactgccaatagcatcatcatcaggttctctgatattttttataaataaaaactctagaagcttgattcaatagcagttcactgaaattttgtggttcaacagagcatatcaattgattttctctgaactgctctctacatatgatcctttcgatcatagtttttcgctgaatattttggttgaacaaagcagttgtagtcccctatgagcttctttctgctgtagatgtagttcatgttctgatttttttttttttgttgatgaacagatttctcaattttggtctacttgatttttcatctatagactacaggaatgctctgaatttgtggagttttctgcacctcagctgacgatcatgggggaggctgcaactccagagaggcaggaggatgttgtccaggtggcgggtcacgcctcgtcgacagcatagatcacacatgggcagaggaagctgtggatagcatgatgggtctgctagctgcaaggttcgttgggttgcagctgagctatgcatttttttagctccttttatttttctcaagcaattatctttgtggttcaacaaagcagatcgatacatgttttcctcaactgctcaatgcatatggtcccgttgattaggctcttgattttcttgtaaaaatgcgtacaacctgtcaatccattgaattttctgcaattttatggttcaacagagcatatggattcatttttctgaagcactcactgcatatagtcatgttgatcagggtcttgatttgttctacaattgtgtagaatctgtcgatccatcgaattcttttttatactgctcttgattttgtacagttcattgggtggagctttctcttggggggtgcttttgcctgccatggcaaggccagcaagatgggatgaggcttcagctggctagtgaggatggagatgaaatcagaaatttactacctgtgagctgaactcaggatttactgccttttgtagttaataatcagcgtcgtcggccctgatctacgttgctatattagtgctggcatcgatcggtattggcatatgtattagcgggtggtgttgatttgattttgtttattagttttgtgtttttctgccgatgtatcattgcgtgcattatcagattgttgatgtaacaccgacactggatcaaacaattcatgtttgtaaagaaattattaaattgtggttaggttaataatatgaatcataattttttaccttcatttgttttgtcactaaatactccagcggccttgtgcaatctgcaatatatttactcctgtatcaggactaacttattttactaagagaagtccaatgacgtgcaaatattaatttatttactaagagaagatttgcaaaccaattgggagtactaatgaagagctgagaacgatctgagagtaatttatttacttaaaggagtaaccaaattgggaagggctgaaaataacctaggagtaattcatttactaagagaagaaatcaatttggaagtgcggaagtgttagtaactcatttactcttagaccgaaagacacaataatattgttactaatgggccaatcaccaaaaaaggtgcgggaggaaggaaaaaaaaggtgcggggaatattttgatagtaacttgtttacttatcgaacaaaaacaactgatagtaattgatttagttagggaaagagtaagttcgagagagagggaagaggtagagggtacggtggtggggtgggtgggttggggcggaggggtacggtgcgtcgagcgttttagttataacgcaccctgggtgcagtttagcgcgtcccagtcttatataacaaaattatacacttccaagagtatagctagtctacaatttccagatttccttcatgtctaagggcaaaaaggtccttttcattgaaattaaacattcaactaatggaatgagtatgaaagggatcaaaatcaaaattcaggggcatacaagggagtggacaaaactcgagggcatagatggattgggtaagctttcaggggtatagaagaaatttttcccaacactcccttttatagcttgaaagggaaccaattagaaacttgcttgttgtggtggagggtatggtcaaatcggttgtggccatggtggcaccaattgttctgtggcccaacatg

SEQ ID NO: 69192 - DNA, 106692 bp, Oryza sativa
  unsure (1)..(106692): unsure at all n locations
nnnnnnnnnnnnnnnnnnnnnnnnnnnnnnnnnnnnnnnnnnnnnnnaatcaatcatgtacctgcttgttgctcctgctggagttcgtgtacggctcacttagcaactgcacacatagtataagaaaaggaagatgagaggaaggataatcagcacggcttgagagctcaaaaggggtcgttttgcgaaatgattgcaacatgcatgctgatgctgtatacacgtactgtccttttctcatgttttcgtggctgttgagaggcagtacaagttgagaaacattctctactttgctcttgggtgtgactaggaagcccactgacgaaagggagcactaccgggtcaatttttcatatatggaaccagctaaacagtcactgcaaatgatccattgcatctctgaagataccacacgcgaggatttgtgtgtgtatgtacgctgctcacctgtagtacacttccgttttactactaatgtcacggtggtcacaaaaatcatgtgcttttctggaagatttatagctaggtcaaaatataggagctagtacctaacctttttaatccgtgaggtcaaggacctgctatcaggagatagggagattaaattcatcgagggccataggagccaaaacagtattagccatattttagtaaataaggcttggtgcgagtctgtttcggagctctggcctgaaaattcttgtaacttaatttgtctcagatatggtgtgtgaggaagcttctcatgagtaatatattccttatttccccgaaaaaaaaatataggagctaatacataatttgcatgtcgggatggttgcaggaacggaattttacctgtacttgttcgtgcagaaacttgatatacttgatcgtttcaaacagtaccgatgctgtatccgtctggtcatgtggtgcaatgcatagggagctgagttagattatacagaagaattgcagtttcacactatttgcagaagaaaaatcaatgtagtaattgcagacatatgtaacctacataccttcccaaacggcgaaacgatttgctgaagtgctgtgatcttctcccctagctttactttaggcactggttgctgcatttggttccaaattaaaacgatcagttcgttcaaatactgaatatatggtcggacgatttcagagataatatcaaatactccatttgtcttctatgtgttgttaccttaggaggtgatgctttggaagcctcttgcttggacttcttgacagtgctttcctgcctttcctctgacttcctcttcttacgatcagtcgccgccgctccactgccgctgctactactccttgcctgaaacgagataattaattagcacaacgccacaaacatgattcaaaatccacgcgcacatatgcagatacaaaactgcatatattcagttatttagtactacgtactacaagcaggcgttttagtactacgtataggactactttgcacttattcagttattctcactggcctatttatgttgggggtatgaaatggcacgtgaatcttaccgggacagtctcctgttcttgtcgattgctgtcagacgaattggcgcatctcatgtacggttgcaccgacgtcgactcgatggccggcgtgtagccggcgaatgacccaagatccggcaagctcctcatgccaaaaggactagcctccatttcccggccgtcctggcagcaaatcttgtcaggctgatctcctaagcctgaataatccaggctactgttgtgcacgccaacgctagcactgccggagcttatttgctgcagaaatgaggccatggggctaatcgcaagctcgtgctgctcctgctgctgatggttgcagctgccttccttcgtcagctgatgatggtggtggtggtggtgttcgccgtagcatgctggcgtgctactcatcatggtcatgtcctggacctggaggacggtgttagtgccacccaagtacagcggcgagccggcgatctcgtacttgatcggcgagacgtcggagcgagcatgatgatcgaacgaccgtgccgtcgtcgtcagggtcgtccccgcgggtgcgacattgtagtgctcggaggcggggacttcctcgaacatttccggcgtcacgttcttcgacgcgagcagatcgaggaagttctccctgtagccgccgccggtggtgctgttgcttctgaaaggaggaattcaccggcgttggaattgcgatcatttacacaaagcatgaaatatatagagctagacagagctgttaattagaggactcacagttcgccgtggctccagccgtgtccgtgggcgtgctcgccggcagccgggagacgcatgacgtcggtcgacgacgaggaggagtcggcggcgaaggccgagccggcgagcgccgtcgacccggagtaggggctccagtaactgtagggaaaagaggacgagggctgcaaggccgcgtgcgtcgacagctggtgatgatactcccacatggtggcggcggcggcggccggcgaagtggaggcgctgcacgcggtagccgagtcggcctggtggtggtcggcggcggcggcggcggtggctccctgctggggcatgaaatactggagttgcactgcgccggcgtgcagacgcatcgcatgggttcggagctgaggattggaatgtggagtggaccaaagttggtgctggggcctatttgtaggcgcttggaatattttccggtggggttatcgaggaggatatgtgcttacgtcggcgtgatgcaagcatgctgcaagacatcattgatgagtttttttttttttgcttcttttcttttcaatttataatatgcacgctatgaagcagccatagttaaaatgcgttagtgtaagcatataatttttatagctaacttgtatagggtagcgaccctgtcctttctcagaagtatacctttttttcttttttttgcaaatcttgaagcaatctggttgttggtggtggtacttctgaatttgaaagtgctacttgaagggcctttcaatcagtctacttgagaattgagatgttatgtggttcatcctgggaggttcaatttactacctatccattcgttagctagctggagtatcaatgagtaaaattcaccggcagttcttaaactaattgcattgtcatatatgtccctacacttcaaaaatacaaatcaaggtctcaaaactcgttaaaagtatgtcatctagatccaaaactcttcaggtgcttgcatggttgattgacatttcactctcttaatgacactcaaaaggtgtatgtgacagtttcacgtcagcaccatgtggacttgaaggggtatgcggagttttggacatagatgacatacttaacaagtggcccggaacttgcttgctatgcattttgaaggggccaaaatgacatagcatggtaagttttaaggaccgtcactatactttatgagtttacattcacgaacgctttacttgacaacttattggattggatttaattctatgccaggtaatggtttgaggacgacaagagagttttgggattctaaaatctatctattatattattaagacagctcgacaaggaggcaccacgtttgttgtggaggctagaaattcccacattaatcggagaaaaagagaaaaagaaaaggagagtccaaataggaatacaatctaaaaataggtgaaattcggaattaaaaataagcaatattaaaagaagtttccatatacgaacccaatatgagattaatcaaaattcgaaataaaaataaaataaaatccaaaattagaaaaggaaaggagaatccaagtaggaatacaatctaaaaatagctgaaattcgaaattaaaaataagcaatattgaaagaagtttccatataaaaacccaatacaagattaatcaaaattcgaaataaaaaaataaaatccaaaattataaaaggaaaggagagttcaagtagcaatacaatctaaaaatagctgaaattcgaaattaaaaataagcaatattgaagaagtttccatataataacccaatacgagattaatcaaaattcaaaataaaaataaaataaaatccaagattagaaaaggaaaggagagtccaagtaggaatacaatctaaaaatggctgaaattcggaattaaaaataagcaatattgaaagaagtttccatataagaacccaacacgagattaatcaaaattcgaaataaaaaaaataaaatccaaaattagaaaaggaaaggagagtccaagtagcaatacaatttaaaaatagctgaaattcgaaattaaaaataagcaatattgaagaagtttccatataagaacccaatacgagattaatcaaaattcgaaataaaaataaaataaaatataaaattagaaaaggaaaggagagttcaagtagatatacaatttaaaaataactgaaattcagaattaaaaataagcaatattgaaataagtttccatataagaacccaatacgagattaatcaaaatttgaaataaaaataaaataaaatccaaaattagaaaaggaaagaagagtccaagtaggaatacaaattaaaaatatctgaaattagaaattaaaaataaagaatattagcaaaagaaaataaaaaaagagttcaagtgggaatacaatttaaaattagctgaaattcggaattaaaattaagcaatattaaaagaaaaatccatataagaacccaatacgagattaattaaaatttcgaataaaaaataaaataatatccaaaattagaaaaattaaaagagagttcaagtatgaatacaatttttaaacaactgaaattgaaaataaaaaataaaaacattaaaagaacacaatacggtattaactaatttttttaaaaaataaattctgaaattagaaaaagaaaaataagattttaattaggaatacaatttataaataactaaaatttgtgataaaaataaagactattgaaagaaaagaccatctaaaacacatgacgagataaattaagtaacatgcctataaaggagtagagtggtggcggttgatacgacatataaaaattgttaataaaacaccaaatagaatcctaatgacgattaaaaggagggacatcaggcaggccgtgaagcaaacaagtaaggcagttgctgggacttctagaaagtaaaaaaaaaataaaccccattgataatcatattcaatttttaaaatctcaatgacaataaaaaggagaagcagcgggcggggtgtataagagtgtagctgcagagccgccgacggttgacgggacttctagaaaataaaaaaatgaattccaatgatagttatgttcgatttttagaatcacaatgacaataaagagtaggcgaacaggctgtagagggcatagtggcatcgtttgataggacttctaaaaattataaaaaataaaactacaagtccaatttttaaaggttcggaacttccaaaaattaaaaaaacccaatgataatcatgttcgattttaaaatctcaatgacaataaaaaagggaggcagcgagcgagccgtagaggagtacaatgagaaagccgctgatgatttggcaggacttctagaaagtaaaaataaacccaaacaataattatgttcgattttaaaaatctcaatgacaataaagaaaagaaacagtggacgggccgtagaggagtataatggcaacgtttgacggggcatctagaaattataaaaacgaaacccaacgtgataataaactctaaaaactataaaatccaatttttaaaggttccaagaataatgaatagaaatagtggtatatcgagcaagcaaataaagaaggagatgacataaggggtagcaactggtgtgacttttaaaaactatataattagaaatacgaggatgataaggtttggttttttaaagtctcaagacaatgagatagttatttaaaaaaatttaagtaaaatcatataaaaaatatatgattttatttgggtgctagccgcgcaattgcgcgggccgcccaactagtttagttaatgagaatctagagaggttgcatttccccacttctgcctattaattggttcatttgttcattttctgaattatgaattatgtagcttttgattcttagaatctagaatctaggtgaaaatccaaattgttcgacagagttagagattaactagagctgtcaaaagctctttcaaatagaactaatacttttggggattatgtaggtctaagagcttagctgtggctccaattggtcttgcatgtgcgacaaacccaataagatagcctagatgctgtttcaacttctagcggaaacaaatgcttactccaaaaattttcacattagcaaaaaacattgtttaatcaatgcattgttagttaaactattatttttctccttgttccgtacgctctctcgtgatacaagtggcattgcatggcatttaattggttgaattgctcatgcttgtgttggagcgcgagtgcagctagtgcttaaatagttgcccggtgatatactctctcacctccaactcactgctaaaactgatgtggcaggcttatcgctagtatactacttatactactttctccgtttcagaatgtatgcattttaaaggtagatagagatgattaaaagaaagtatatagagatgattaaaagaaggctacgattgatggagaagagaatgtaggtgaagagaatggttgtaattggttgagaggaaaggataggtcaagaaatagctttattttgaaacacgattgtgctaaaaatagctatattttgggaaggagacagtacatcacttaagataacatgatgtgcatatatatagttttacttctaaaggtaaaaattagaggcaggacaaaagcttcttaattacaaggttttatagatgcagaagaaatgggcataggttaattcagaaacttgaattgtcagtacgagacacggtgataacctgccaaccttctcactgagactgctgccacgttattcggtgatgggcgattggtccatgaaaggtgcctgtcacaactcgcacggagtaagcagcacccggcttcttgcgcatcaagagcatcactctgtcctaatagtgttctttcgtagtggtaaacactgaaaaaaaaactcacagtcacacaatagtcccaacaactcaaccgtcttcggggcataaagcaagccaaatctaggaagtaattaatcagatgtgtgcaccaaagatgtagtaccgcaaacaccggaaactcgagcatctctgtgtaccagccttgtgcttctgcaaaacccgtcgcacgctcagcagcctgcttgatatgattctggaaatgatatggacgtgctgcttagtctgctgatagtatgtcttccagatggtgaagatctgcagcatacaagtaaaagaagccactcaacttcgagacgtcatatcacgtcactttggagttctacagtggagtacattttactaacctaagctgacttttttcatcaactttactttaccatgaccatgtcaggtaacttatcattacaaaatgaagccatgggaaatcacacagctatggccgacgagggaggaatattctcagaaacagtaagaagagctactttgctccatggtcttcttccacttgagtgggtcagttgactgtgtctcagtgtcatgaatccctctgctgtttagttccctgcttactgcaccaccttgtcttgtttactctttgttctcttgctgctcggccaacaatggagcagagactgcatttgcagggccattgaacaaagagctcgccctagggttggtgagtgacggtgatggctttggtggtagtgggcttggggacaaaggcttcaagaatgcaattcattgcttcctgacgctttgcgtcacataagatgatgtgtgaatgccaggaaagtatcagcctgaaatctgaacacagattaaaatcagcggcaggtcagatgcagaaagagaagcagggaaacagcataatgtgttggctgcctttccttaattgaggataaggcatctcttcccagtgaggtactccggtaaaaatgcaaataaactgttgattaaaatactttagtatcttcattagcatgacaaatagatgtagaactatagggtaatatgctaagaaacctagggagatgaaatttccaagacaaaactgaaagggaaagctacagaatgagaccggtgactaaagcagacagttttttttttatcagggtaacaaaacgggcatcatatgtagtataacagatatctcaaatacagaaagtaacatatgagcaaatatatagcatactgatgtaactcaatatgtactctgtgattttctttccttcgcaaagcagtagtttacatgttccagcaagagaagaaagtggcacttacagctacaggagcgccccaataacagagtgatttcacactatattcaagtcagcaaattgttagcttggactgagaattactgctgtacaaaatgctgggctgctggcacagtttttttaatacataatcatggatatgagaaggttataagcactaggctagtgcaaatttaaaaaggaatacatgaaaaatagcactcatattcaaaactaagattagcaatgagcccatgatatgaataaatactcaaattagctattgacaagaactcacaatggatcacaccttggcacgtgtaaaaggggcatagtggagtataagcttaaaatgtgtcccatcacaagcagcatgcctcaaatagcctttcttcaaatcaataatatcctggggacccgcacagattatagaacaaaataaagacgagcttgaaatttaataacaggacttcagtggaaactgggattgctcataacacttgtcagcatatgatcatctggtccacactcaaatggttgagcaaatggcctccaatcagtaacactaaataaatacaaataatttatttcctgtgctttagacttgccacagcggtggttcctgctgacaattatgtgaactccacttccactatttaattctcagaaaactcatccctgatcacttgcctgatctgacccaaaaaaactggtaatcttagcagttaaattaagaggaggaggaagcgtgccctaataatactcagtaacctaattgtcatctgggatcagctgactgaaattggttgtctcatcgagctaaaggaatgttgtgaaaggaacagcaggcacttttcgtcaggttcttgtttataaggggatgactaactttggatatcatcgaacaaagaatatggtttccaatgccgccaccctgtctccattcgtgcagtacaccaagtctgcactctgggtagctaactacacaagcatggactggagaaatttcctttcgcgtgctcaaagttagcagtgtcaaatagcaattaggttgagatgtcaacccaagtgcggtggcaaagttttcaacttgagctttgacaagagacaggaagaataaccagtcgtatcctatccatgtatttacaacatgcttaagatttaagaagaccataaacaagcattgcaggggcatcacgcctacacataaagtttttcaagtggttatatataatatctaaaggaatgactacacacggaccctccacctttaggaaagggagagagacaaaacaaggataggcagcattaagcacgcgcatcacatattctaatagaagaggaaaagcacaccaggaggaggctctgtgtacggtgaacttaatgacaggcaattgaaggagtagctttgtttactccaagttgactctcagtgaaatgtgtcaaccactagaataatataagaaaagaagcttggaggcaaggacagacagctcattctccctcaatttgaaagatgtcgagcgtgaagcttccccactaacgaccttagtaggttggtggaggatgacagcgatcagtgaaaatagcattttgcaatgagaaaaatagctgacctctagagacaaccgtgtgataatactgcattcatgcatgacaaactatgagatggatgtaagcagagttttggactcttcttgagcctccaaatctcttcctgtcgtgacatgctcacaggtacaagatcactctggttaagtcaaagacgttaagcacttggaataggaagatggtcaaaagaagagtcatgtctcttgaaaggtctcacggtggatatcatgctacacacttacaccgaggtcactatacaaattggtgcaggagctagtgacttcatcaccaactgtagttagcttagagcctagaggtgaatttgactacaggacaaaatagtaattcatacattattagaaatgtcagttcataaatatgaaaagatactccggatggacatgttgagacatatacagaatacaaaataaaatatgtggatgcagatttactgagtcactaatgataactgaagatataaaatatgacagaactagaaaaggacagaggaataaaaggttacctggacacagcagtatgctgtagctcttttgtagccagctcaaatgcatcctctggagtcaagaacatctcaatgtacctaaaaatggtttcagacatatcgatattcttcttaaaagagggcaatggtggtggcagattcactgcctccacctcaccaagtatagtaacttcttatttaccatctactccatcatgttttataccaactaccccatgtacttttatgttataaaataatccctttacatatatgattatatcatatttcacctgtacaatataacatctacaggtacaaaattgtcccaaaaacctcactattaatttgttttaatccgtagcaaagcatgggtatctggctagttataaactaaagttgatgcagatagtaaaagatactatatgcagattcatttggcaaagaatatgcattaatattagaggcaatcaagaagatttacagtgtcaaaagggccctaacattgatcaaatatatagtatttgacatttaagtgcaactgcatgattagtcctccacagttgagaatctaggcttaggttacaacgttcagttggaacttggaagtgtctgatgactgatggcatacaaaacaaatactcttaatcttcataggatccaaagagcaagtcagaattccgactccatacttgttcttttttccaccggcccagcaaaggagtttttttttcaatgctttcatactgctgcattgaaaattaagagttaaatagaggacaaataaagaaaggtgcactttagtaatactctctctatttcaggttataagatgttttgactttggtcaaagtcaaattgctttaattttgactaagttcatagacaaatatagcaatatttacattaccaaattagttttattaaattaataattaaaaaaatnnnnaaaataaannnattnggggaaaaaaanannannannnnnntnnaaaaacnnggtcaaannngaagcannnngnnnnngnccanagtcnnnncatcttataacctaaaacggagggagtagtatgaatcaaaacaaaattccatggcatcacaagaaaatcactacacctgagaaaaaagaaagaaaatagcatctagttaggttacctccaaaaacctatttaaccaaacaaggagacatcaagatagtgctgagtgccatattgttgctgattcctgatatgtacacctccagagggcagtacccgtgctaagagaatacacgccccactacaaaacaaaaatgtgtatattccacattgcctatccgagggcttaacactggcttcaatcatcagctgaactatcaattcaccaccagcataacagccatcttgcatccaccacacatttcatagtcactaacactggaccaccctaacataacaccatcggtgacagcaatcacacaaaaccatccaaacagcagcatatacagtccgcaattctacaccacaaaaagaatacgaggtacctacttagcatagggcccctatgtaggaagaaaagtagtggacagggatgaatgtggcggtacgcagcctacacatcctcacaacctaatagcataatacagcataaatggcagtagctattccatacctaacggtgcaaagccatcattttggttataccatgaataatacaagctgcggagaacattgcaattttgaattaaaaatccaaactgcaatcacatcacaagtttgcttaccttctaacgattgccaaaccaatcacgcatcattatgtgctcaagtgaattgcccaaccaatcacgcatcattatgtgcccaagtgaattgctagagaagagaccaaataaagtgctgatctcgtaggccctcatctcaatccttcttccatacagatgatgtggtaatgtatttctgtactgaatcgactcattacgttccccaaactaaataaatcagctctctaaattaggataggttcagagtaaggatcaataaatcagttctctaaattaggataggttcagagtaaggatcaaatcgtctacttcctcgaaccgaaccagtaccaaacgcaccaaaaggggatgaactggatctagtcatcatcaaagctaacatcgtgggtaacatcaacccccgtttcaaacgattcgtccgactggccccgaaaccagcgacttgagaaagagcctcacctcacctcacttgccgcagccgccgcccggggtacctcgcgcggctgcgcctttgggtggcgccgcgggaggaacctggactcggtgggagccactggtcgacggccggtcggctgctcgtccggcaccgtcggcgcggcgcaactgtgctgccctcgatgcctccgggggcgtggccacggtgggttcgtcggctgacgcagcgcgggccgtggcggtggtggtggtctctcgtagcccagctttctgtaagataagtggcccggttgagcgtgcggcggtgcgggtgggtgtgcacgcgctcggaggtgtgaaaacacgcccgagtaccaagcggcagcgtctgtactacttgggcccgataatttgaaggtatttgggccgaaagactgttacggcggtaacaccaattcgatgaggaataagttcaccttactcgagttttgatcgtaatcttaaactaatataacacgtccttcaacttatataaaactaaattatcaaaatcacacgatagtattgtgtccgattttgactgatgagacaacttggtaagcagtgagacccatgtgagacctcatatgttagtggctagcgctttgttcctcctctttcttccctttctgctaatgggagttgtagagggagcaaacgggggatgttgaggatgaagacgacatggacgtgcgccgagtaggagcgcttgatatcgccaccgttgatgcaaccggctactcggggatactagagctatggcacgacccatagaagacgacctatgccacctgtcttcttcgacacgatgggaggatggagctatggagctatgccagtatgccacccatgcctcgattgttgcctctctccctatatcccgttggcctgctacctgcaggctaggaagagggagaaggggaaagaggaggaagaaagctaggaggggagaaaaggtgaaaggaggagaaagctaacatgtggggttcatacaggttccacgctgactcagccgccacatcaacaaaaatatagaactatactggctgggatcttagctagctacaccggtattataagttgaaggacatgttatatatgttattgtggtttagggatgtgattcaaactcgtcgttaacatgttatatatattattttattttgtggaaagatttacaatacatatccgaaagacgtgatcaagtcttcaaaaaaagaaagacgagatcaaagctaagggaaagaagcgtggctgaacatgaatcgatcaatcgcgtagagaaaaaaaatcactgcttcgggccagcctcatccgcgcctttattttttttttcatgaaaccacagatgcagcctctgccatcgatgtccagagccagtccacgacacaacatcgggtcccgttcgtcggcgtacggatcggtcgagttggaggtggccagcctcaacacggctgcgcagcgtgtctcgcccacggttttgtttctcgatcgacaagtcggcaagacgggaatcgtcgcatcgtggacaagattgtgaggcgcttcggtcttcctgggccatgcttcgtttgggcattgtgcggcccacggtggtgttcccgggcgcaacatgctccctccacttcttgctttccgggccacaggccacagttgttctttctcgaaagggatgtgtgttgtgatcatcattcatactaagaagatctaatcgtcagtccgttgttgtgtactggggtttatcccctaatatctgttcttgcttaataaagttggttgtgtttaaaaaaaaaggttatgaagaaaaaggtagttcgacaaagcatatgatactctttgtcgtgtcaaagagaccaagataagtacaggagtaatcgtacagctgcccaacctaatcagcaccggtgaccgagaaaagctcgttctacctctcgacagatcgccgttagctagctaccgagcatagtcgcccatcgtaagtactagtacttcccattcacgcatacataaggacattcggaatcattttctttctcttgaacttcgatcgtgcgactgttgaaacctcctttgttgcatgctagctccatctgtcacgctctggctgccgcgtaggctggtgcatacatctggaggaatctttgccctgcggtgattattagtggggtgacaaaaatgggctccgttctgatggcattggttggaaccgcccgtgacccctccagcagtccagttcatggtacgtgatctgttttataggctgcttttcctttccagagaatatcacgcgttcagcccgcttgttgcactgtaacgcggtcagtgccaccatcggagagggacatcgacatgttacctgtacggctgtgctcaatatataaacccgtgtgccgtggtatgtataaaagatctacggtaagtactggtttcatggcaattaatcgttgtttaggattttttttaccttttcgaaatgtaaataaaatagagggactggaattaggttttttttttggaagtttcgaactaaattaccacacaaaacctggaaattgggccttttgttaaatttaaacaaattctaaagctggaaagtagaatcgtcgttgatgacgtatgttctcattggtgatcgacgtaaggcaacagaaatcggtcattggtctccgtgtatggctgtatgcatatgcaagccccctgcaaaaaggcgcaaaagagtgtatagtacggtgaaggaacggcccagcgcaggcgcatgcagcacatgcatgttttccaacagcgctcgcgctggaaagtagtacgcgttcgtacagtatcctgtttgacattctagttgtcgggtggttgcttcggcctcttgctgtccctcggtccctaatccttcgcgtacgttgatccgcgatcgctcgtcgactagcggaagaacaggttttcaatcgatggagtacgcgcgcgcggtaccatctgctactgtagctagcactcgatcgatcgatcgattggcgcggcggttgctagctgcgcatatgcttagatgcaggctgccgatcgaaagcctgaaacaacgttacttgcgttgcaacttgcaaggacgtcatgcgcgtactcggttcttcaattgccgtgtactgcatcctagtgtcggccactttttagccgattttatctgcatggacggacttgaattgtgtgtttatgtgtccccgtgtttcgttgggacttaggacactaccgtgtttttttcttccttgtttgcgaagcttttggatgcagtatcaatctcttccggaacaccggcccgtgaatacgcactgagtttcggaagagagagagattaaagtgtcgcataattgggtttcagatagcagtacaagttactactgaaaagattggatttaacgtggatacctctctcggtcctccacggttgcgtgttaaatatgcacaggaacagcccctggcgtggcacgattacagcggagagattacaacaaatcttatcaagattaagagataaacacaggagactaacaaccatgatctatccctcaaagttaggaagctaatcctatcactaaccgtgactagatagaacaaatcttaacacccccacacaatcacaacacaggcaacaagttgagattgcgcctgaaagcatccatttgttgagcagtgaggactttggtgaaaccatcagcaagttgatcccttgtagagataaacctgatctctaatagcttttgtgcaactcgctctcgcacaaaatgaaagtctatctcaatatgtttggttcttgcatgaaacacacactacactggccaaggtcacctgtgacgggcccaaaccctcatctttgacggcttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttgaggtctccgtagttagaagctgtcacaggtgatctacctgtgacagccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcacccccccaatataacatcacagatccccaacaacacatatatgcagttcaaatgccaccattttgcacagcaaattcacaccccttgaaagccacaatttcggtcgttgctcatagaaccgcatatatacttaccaaatggattaaagccataatgtcatcgacctgcacaacctgtcaataaggaaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctacatttctgtttaataaataagaggttaattagcacgttttgaatagcaatgtagatattgaaatgagcttattcgccattagcaacaacctcagggtcgaaatctttcacctctcttagaagtgttgacatgttgttcacacgtggaaaccacattggtctccgatctgttgtgcgcatgcaaacttggtgtcatgataaagttcattcttgccctccttgtgcctaccacccttttccacatatgggccccaagccatatttaagggcttggtgatttcactgaaatcataatctttggacttattggagttaaggtaggtaaccctactccacttaggtacaatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccaggagaatgaggtactgacaatgccggtccacggggagcctcaattgatagcttacacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcagccttcaaacgagcgtccctctcttccttggagactttccgtttcctgtattgggagctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgctggattccctaaactcttgggtggtcttgagagagcagaattcctcccacaccgcttcggttatttgatggtattcatcgaacggcgtatgattgccgggcgggttgacatactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatagaggatcccgaagttctcacgtgccactagcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatgctataaattaccatgaatttcgggttgttggaccgccgttgtcccgggatgaccttcggcaattgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcagctactaggagaaaaaagcaacccaaagaaaatagaacaagtgtagttcatctgttcttatcaataaaatagaacaagtgtagttcatctgttcttatccataaggaaaagagcaagtgcaggaaattaaagtagtagcaacagcatggccatataatagcagcaataagagcagtagcagggccatataacagcagtaggggtatatatgccacaggggcagcaacagcagggggagattcacataaacagcaacagcagggtggaaattgacataaacagtaacagcagggtggaaattcacataaacagcaacagcagagggaaattcacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttcttatgcataaaaaaagaacaagtgtagaggtatataaccactctacactggccatttaataaggaacaagtgaacaagtgtaggggcagtagcaggggtgtagataaaaaaggagacagtactactaacttcatgtaaacagcaattcatccattcaattcaagcaagtctagataataaaacagcccacaatcattgtggcagcagcagcaagggtatataaatcatgtatataaacaacaattcatacaattgacctattcatagacaaaaagggtatataaatcaacaagtttagataatctgcaaagcctccttaatcatcaaattatgacagaaaacaaaatgcatggagaattttggtgtctaggtcggttccgtccatggactacactggcctatccaccaaaattccccatgcattttgtattctgtgatggtttgataacctcggaactacattaaatctgcggccaatctatcaattcttcccttgtaactagatttcaaaccctacacctaataaaggtccttaattatcaaagacactccatgaatggttatatgtccaaatggctcttaaatccacatccaagttgcaaactagctacacattcaagttttaactaacagttgcaaccataggcagcagcatgggcaaacatagacagcaaggggcaagtgtagataataaaacagcctacaataatttatgtggcagcagcagcaggggtatataaatcatgtatataaacaacaattcaactattcatagaccacaagggtatataaatcaataagtgtagataatctgttcttatccataaagaaaagaacatccactgcagcaaaattcatgctaagatcctctattgatgctaagattcactgcaccaaaatcatgtatataaaatctagcccctacattcatccaaaacatccatagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcagaccgtagtcgtcctggatcctggtggcggcggcggaaaggcagtggcgaagaggtcgaggcggtcggcggtggtcggggatcccggcgtcggggaggtcagggtcggggaggtcggggaagtcgatggacggacggcggagaggacgaccggcggcgagggcggcggtggagacggcggcggagatggcggtggagaggacggcggagatggcggcagagagggcagcggagatggcggcggagagggcggaggagaggttgaggcggcgacggtggagatggcggtggagannnggacggcggcggtcntgangagagtgagtgaggaggcggcggtggagaaggaggcggcgagggcggcggagaggcggagatggcggcagagagggcggcggcgaggagggtctggatcgagagagagagaggcggtggcgaggaggtggagatggcggtggagatggatggcggcggtcgagagagtgagtgccgcggcggtggtgcaggccggcgtcgggaaggtcggcggagagggtgagcggcagagaggtcggcagtggagaggtcgaggcggtggtggggaggtcgaggcagcggtggagaggagggcgtaagggtggcggagaggtcgagagggcggcggatttggcggcggcgaggacggcggtggagaggcgaggcggcggtcgagagagtgagtgagtgagagtgggcgccggatctggatcgatctagaagatgtccaaccctaggtcaaccctagtcaaactcacctgtgacgggctccaactatgtggccgtcacaggtggcctcacctgtgacgggcgccaaccgtggagccgtcacaggtaagaccacctgtgacgggcccaacactctgggccgtcacaggtgaggtcacctgtgacggccctacagatagagcccgtcacaggtgagtttgcctagagcaattttattttattttatttcactagttcttttattttccttaacatattttcacatacactacatattttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagtagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcacaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatcctttcagtatggtagtctccagaatattgacttctttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattcgttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgcactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacaaatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgtcatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagctgtcacaggtggcggcccatcacctctgacggcttctaatgtatcggcccgtcacaggtgaggggataccagtgacgggttggaagaaaaactcgtcactggtatacctctgacgggttttcctttcggcccgtcacaggtgaggggatacctgtgacgggccacggccagatgcctcaccggtgacggcatcccgtataacccgtcaaaggtaatggtcactactgaccaattcgtttgcccgtcacaggtatcccgtcagaggtgtgaggatctggcgtagtgacaggatttgatgacaaatacttagctcccaaattatcacaccaaagacaagcagtagttgggtgactaatttttaactcatcaagcactttttgtacccacattacctttgctgtagcattagccaaagacttatactctgcttctgtactagaccgagagaccgtggcttgcttgcgtgcactccatgaaataagattctttccaagaaacacagcaaaacctcctgttgatcttctgtcatctagacatcctgcccaatctgtatcggagaaagcactgacaagcatagatgaattcttacttatcttaagaccaacatttcttgtaccatgtacataccgaagaattcttttaactgctgaccaatgagtagtagtagtaggagcatgtaaaaactgacaaaccttgttaacagagaaagaaatatctggacgagtcaaggtgagatactgtagtgctccaactacattccgataccgagtggagtccaatggccctagctgttctccactagtaatagacagcttttctaacactgataaaggagatgtgactgacttacagttggtcatccctacacgctgaagtaaattagttgcatatctttcttgtctcattgtgagaccatcatctgttctctgtacttcaatgccaagaaagtagtgcaagtctccaagatcttttaaggcaaaatctgcttcaagaccctttaataaagcatctgtagcactttgtgaagaactggcaactataatatcatccacatatactaaaacaaacatggttaaatgtcctttgttaaggaaaaagagagaagcgtcagctttagagggaataaaaccaagctactgcaatttctgactcaagcgtgaataccatgctgtcggtgacatgggaccgggggtatcttgactagaggtttggggtagctgcagtcacccacgtggcctaaccccctcgggggggtcgggcccgagggtgatgtggccgcccctccttctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcggaatgatgagagcctctaggcactcgtccctagccggagccggcgtgctgactcctggagttagcacgtcagtcccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtggtcccatgttgcgcctgcttccggcggagtggaggtaggtatggcccatcccatcagagggtcattcggacaacagccatggcaaatctctgcccattaatgagggagtaacagggagatccccggtgtcaggcgagtgatgacgctgggcctcactcaaagacaagctgtgatttagcttccaggcgaaggcgcaagccagttttttcttttttgggaagatagggtgagtccccacccaaaagaagagtaggtagaagtggtgcatgtgggatccccttgagatataaaaggaggaccttgcccacttaagaaggggggagctggggaaagaggggggagaagacctgagctcgtagaggagagaaagaggaagagggtttctagagtttgaactctcttgctctccagctctttgtaactccttcatacacagatccaccagaacacaggagtagggtattacgcttctcagcggcccgaacctatctacatcgcccatgtcttgcgcatttgctctctcgcgaaacattccacagatcgagtgcttagaacctcacctagcgcccccggccgaaccggcaaaggggggcccgcgcggtctcccggtgaggagccccacgctccgtcacatgctctaggcacttgtttgagaccatataaagctttatcaagtttgcaaagataatgtggatgatatttatcttcatacccaggaggttgccgcatgtatacctcttcctccagaactccataaaggaatgcgttctgtacgtccagctggcgtaagctccatcctcttgtaactgcaactgacaacacaagacgaatagtggcagctttgactacaggactgaaggtgtcctcatagtcaatttcatatctctgtttaaaacctttagcaacaagacgagccttgtatctatctatagttccatcagccttctgtttaattttatagacccacttacaatctattatattcttcccttttgtaggagggactaaatgccatgttttgtttttctgcaatgctagaaattcattgtccatggctagcttccaatttttactattcaaagcatcattcaaagtatcaggttctgactcagcagtaattaaatttgcccaacgaactgtaccgtctgtgtaaaccttgggtttacgaattccctgttgtagacgagtggctggtcgttgaggctgagtcagggcagcttcgctggatgtggtagagttgttcgccgtagagttggtcgccatggacgatcttgacgacgagctgtccgagagaggctccgacgagcccccgtcgatcggaacagccaaggagtcatcgccgcgtggaggagacgccggctcgggcgcactgtcggagacacgcgacgaggaatggctggtggatggcgatcggctgagagaagagccggctgcagcgcctatatccccaggatgatgcgccgcagttgcgtcagaagtcgcagcgtcgtcaggggctgcgtgagtgttaggagccgcggagtgcccgggccgcccgccgagcagaaaaccatgggtgttttgctccaaaatttgccctgttcgcccagaaatttcagcagcagcatctgcactcgtagcaacatcaactggagactcatgagcagggttagtagaagaattaatcacatattggtcaacatgttcgtcccgagaaggattcaaaagatgttctgggaggagaagaatttcagcccggagacaatgaccagcatttggatgaaggtcagaaaatgggtagatatgttcatcaaaaaccacatcacgagaaatataaacccgaccacttaaaccctttgtgcattacactgtaaccaaggaaaacacaccgtttcaagcggaattggagtttgtgagaattgtaagggcgtaaatttggccagcacgcgcagccaaaggtgcggagggaggtgtaatcaggtttgatatgaaagagcatttctagaggtgtggagccttggagaacaggagtgggaagccgattaataaggtaagtacctgtaaggaatgcctcatcccaaaacttgagaggcatctgagcataggctagaagggatagcccaacttcaacaatatgatggtgcttacgttcggcagacccgttttgttgatgtgcatatggacatgacacacggtgagaaataccgatgcgttgaaaaaaggaattgagtttgtgatattcaccacccaatcagtttgcatagctaatatcttgcgatcaaagagtcgttctacaggattctgaaaattatggaaacattgaaacacatcggatttatgtttaaggagatatatccaagaaaatttgctgaaatcatccacaaaactcacataataattattcttcccaaccgaggttggtgcaggaccccaaacatctgaatgaataagctctaaaggagcactagaacgactcaaagacttagaataaggaagttgatgactcttccctttctgacaagcatcacaaaccgaatgcttgtttgactcactaacacaaggtaaattattatgactcaagacttgttgaacaatgactgaggacgggtggcctaggcgacaatgccactgcgaaggagaaagcttgatagctgcaaaaacttgtttatttgggaatgatttcagaggataaaggcctcgctcacatctgccttggtgaagtagtttcctcgttacctgatccttgatagaaaaataacgagggaaaagctctaagaaagcttggttatcaaatgcaaggcgatgagcagagattaaacttttgtttgcttcgggaacataaagaatattttttagtataagatcacggtgttgggtgcgaacaatagattgaccaatttgattaatcttcatacctgaaccactggcagtatgaacttgatcacctccattgtacttctcccgcaccgtcagcttgtcaagatcgctggtgatgtggtccgtcgccccggtgtcaatataccaattggtaccaacaccgtaggaggaggtagcagcagcagcactcttctcttcgccagtgaaggaagcatcaaacctcttgtagcacttgaccaccgtatggcccaatttgtcacacagctgacacttggggtgatctcctccttggttgttggtgaagccaccacggccgcggccttggccgccgcgaccacggttcagattttggccctggtttggctgaccatggccgcgacctcctccattgccgccgcgagaagcagagttggtggacgactgaatgccaccctgtcgaagttccaatcgctgctcaaaagtaacaagctgtgaaaacaactcaccgactgagattggctcagaacgttgggcgactgcagagacaaccgggtcaaaatcatcatcgagcccagccaggatgtcggagacgatgtcgtcgtcgtcgagcttctttcctgccgaggccatgtcatcagcaagaccccgcatcttggccacgtactcggcaaccttcagattgcccttcttcgtggccgtcagagccatgcgtgtgttcatcacacgcgcacgggagtgagatgcaaacatcccacttatggcatcccaaaccccaacagcagtgggaattgagaccacctggatgaggacatcacgtgagagggagagcaacaggtagctgagaacctgctgctcttgcgccacccactcggtatgcgcgggattggtgacccgcacatccttgtcgtccttcttggtgatgatggtggccggcggctcctcctttgtgccgtcgatgtatccagccatctgagctcccctgagcgcagcaagaacttgcgcctttcagagaggatagttgctgcgggagagtttctctgtgaccgcgtgcgcgagagaaggagcagcgccaccggctagcgaggatgaagacgacgctataatcacgacgtcgaggaagcaggctctgataccatgaaaagattggatttaacgtggatacctctctcggtcctccacggttgcgtgttaaatatgcacaggaacagcccctggcgtggcacgattacagcggagagattacaacaaatcttatcaagattaagagataaacacaggagactaacaaccatgatctatccctcaaagttaggaagctaatcctatcactaactgtgactagatagaacaaaccttaacaactactatacttatacgcataaatatctataggtatgaattgagtgctatctttatcttaaactagtactttatcataaaatatactccctcgttccctaaatgtttgacgtcgttgactttttaaaacatgtttgaccgttcgtcttattcaaaaactttttgtggaatgtgaaaaactatatgcatacataaaaatatatttaacaataaatcaaatgataggaaaagaattaataattacttaatttttttaataaaacgaaggtcaaacatttttttaaaaaaatcaacggcgtcaaacattttgggatgaatggagtagtaacttttaaatataaatataaatatgcccttatctagatttatagttaaaagttattatattaatttgaagataaatggagtaattattttcgcacaacgtgtacatcgcttgatctgtgttcagtgccgtcgatggccatgtgccaagtgatcgaccgcacaggggcccccaaaatcaagggccccaaaattctcatatttaaatacaagacactaatttccaatatgtttttatcctattcattttatttttttttaaaagttcccctcatcttgacgtactgatttggctagaacatatttattttctttgcattcaatagatgttcaataataattatggcaaactcaaagaaatatagtttatagcggcgccatgaacgtgcattctagatactaaacattcaatttttacgattagtaaagaaaatcgaataactacattaagaagcacttatttttcttacttaaggaggtgtaagccaccatttacgtaatattttttctgaacaatttagtatcccttttgttgatattttctaaatataaggtctcattttaagtttcacactggggcctaaaattgctaggtacggccctgtctgtgttaatgtttttgggggcatatgggaccacgtcaagagtgcccaatgtgtcgaggaaaaaaatgtccaatctacgatactactcaaaactaacacattcctcttgaaaacacacgctaaaaaagtttgagatcagcgacaaatttctacctcactaaattcatattcaagtcatacataaatgactccatataccgtaccaaaaacatcttctggaaaaaaaaatatctgcactactacataacatcataaaaggactagggctgtgtttagttcgtgtgccatttttttaaaatatacggacacacatttaaagtattaaacgtagactaataacaaaacaaattacagattccgcctgtaaactgcgagacaaatttattaagcctaattaatccgtcattagcaaatatttactgtagcaccacattgtcaaatcatggtataattaggctcaaaagattcgtctcgcgatttacatgcaatctgtgcaattggtttattttttcacatttaatgcttcatgcatgtgtccaaacatttgatgtgatcgaaaaagttgaaagtttgaagaaaaaaattgaatctaaagacgacctagcactatatataccgaaaatgttaaaactgttaaaactgacatatataaacctttttcctatctacatgggttaaaaataatatacaactagttcctttgaacaactatagatgccggttctaagaaaaaccgacaccaattttataggtgccgccttcaatatattatagatgttagttaattaaaaaaaggcattgtaagaatcgagccaaaaatgggagatatttttttagcaaagtcaacatagatcatccttatcccttcgctcgttccacccctttctctctcgcccacgccatcccttcactctcgccctgccataccctttatctctttgctctcgccctgccgctttctcctcccatcctcctcagcatgtggcagcatcccccttccccttccccaggttgttgttttctcctcaatccaaggcaatgatgggggctcgagcaaagatgacggcggcaatggtttggttggtgtgataacgactcccactccccctcgccctctttgtttctcgggcgtcgatgcatcgatggcgtcacctccaactcaggggtcgttggatgtgccccccccctccaacagcgatggtgatggcggtccgactacggcgagcagtggccctccctttgaccctgcctccctgtgagcaatgactagcaggtaggtatccctcctctccttccccatccatccctcccaaaaaaaaaatcccctcactatgtattctggatttgacagtggtggtgagcggtaatgccttggcctccaataaacagcggcggtggcggcagtggtttttgtgagaatttgttatttggtttcttcttattggatctgtgagaatttttattcagcttttgtccctgttgttcttggcctgaagcattgagtacccgaagcatcaactcgatttgagccgatgcgagcctcttttttttttattcctataaccatcaaaggtactgattcttaaacccgtacctttaattgttcacatcggtattgtctagaggatgcgggtaggaaatccggtgcttatggactgttcccaaccggtaccaataagatttttttaaagcagtgctgggaaccatattggtccaggtttgtctgcatcagttatgcatgggggcgaacaaaggcgttgatatttcgtaacatcttaacagatgactgttttcattttggcgaaaaaaatggttcgtccaacccggccgaaagcgcaaaacactatcttgatctttgacagcatattttgctgcagaaaccccagaaatcacgtacggcagcccagtgcaagagttaagatattgtcaggagactcaggatgctcagcacgaacacaggagactgccggtagtgcggccaactatatcagcgcgctgccgctgcctgtctatatcagctcatcagactccatcactccacagcaggagccagccagccaagccggggtacctggagctgcatgggcccatggcatgcatgcagctttcgcaccgagagcgcggcacagcgatatcacgagccggcccggcgcgctttccccctgtacagtacaccgaggccctgcactgcgcgcgcgcctggcctgctataccgatcgacggcccgacgggccccggcgacgccgcgccccccgctgcggcccttccctgtatgcatggcatctgcgcgcggatcgcgctatacctccatcgatcacccaaccaacccggcatgcatatggcagcgtaagcgttcgtgaaaaggcggtggcgcgcgcggtcctcgtggcacgacgcgaagacagcaagcggcgcgtgcgtacgagcgtgcgcggcgttttgtgctggcgtgaggtgtgtcggagcggtatgcatggccgggccccgatgatcgatcggtcggtcgatcgacctgcggtgcggggtgcgggagccggccgggcttgtactgtagtagcgtagtgccgtggctgtgcatgcgctgcaccgctgcagggtgagacagacagaccgggttcgatcgaggtggtcacatacatatatatgtagccagggtggccacaggctacactacgcgtgcatgtgacgggccagcatatatagcactgtgatattgcgagtatatatatgattaaaacacgtacgtctgttattgacttattgtacagtagtttttttagatacagtagtgtgcagtagctaaggtaggtactatacgtacgaatacgatgttgctcccctttaccttcggttccttggagtagtatacataggaaatgagatattttttccccaaacaaacaagaaagaagaattgaaggtcttcaagtaaagggcagataggaattgaagaaaagtctactccaaataaccaatccttggagtagtactccgtactgatgaatgaacggtaagaagtttgatcatctctgaagaaacgcaaattccaccagatgtgtgcaagctgattgcgctgactgctgaccgatggtacgcttggctgcctctgccacatccgaagtttcatcgacttctgaggttgagtgtgacttcacggtccaagatagtactccgatcgagtagattgcctatgtcacatcttatgatatcgactgctagccagtacttgttgataaacaaaatttgaacacgtctgcctttttttcccagcttccggagtttcagagaatactctcagttatccgataacacacagttgctgctacagtattgtttaccgcaagagcgctgagcgttacatgtatacactgataatactattacaaaggagtacacagtcacacgaacagaatacaaagtgtgctgttgctttacagggattgtcaaggagaccacgattgcttgtgagagttgacacgagctggacgggatctctctgagagcagagtgacattcattcgggcgtgaccacgaggagcctttcgtctggtaggcctttgcgtgcatggcttcctctccaagctctcacaggaaaaaggggacgagtactcagtgctgcaggttcttattccctcccagattcttcgtcacgtataccaatcttcagaaagaacacgtacccggggaataactctggccggcatgcgtgtagagacgagcacggcatcgtcgtcatctcactaaccgagagacagtgaggttcgcgtccatgcaaaatatacttcattcgtgtgaaaaatatagtaatctaaaatggaacacattctaggataataaagttagatatatctttgttcaagtttaccattttacattctatcttaagttcttatatattggaatagagggagtaagtatttttttaagttttaacaaaaaataaaatcaagaaaagaaattaattgttatgaatgttactatgaaaattagataaagaaaaccggttgtgatcggttaaaaataaaaaagaaattttaaaaataccatcagcaaggtagatgaagatataaattgttatatttttagtcgaacggagtactcatctttttttccttttttttaagtcgccgtctcccccgtcacctcgtgaagatagcaggcacgcttactagcacgtgggccgagcgaaatgtattggagacgtctttgttttcctagccataaactctctccatccctaaatacttgacactgttaaccttttaacacatgtttgatcgtttgtcttattcaaaaattttaagtgattattaattctttttctatcatttgattcattgttaaatatacttttatgtatatatagttttacatatttcacaaaagtttttaaataatacgaacggtcaaacatgtttataaaaatcaatggcgttaaatatttagggacggagggagtataatgcatatatatgttcgagaaaaaacatacagttccaatacgtacatatatgcctctttctcacgtgggttccggatgttcatctctctatctagccgtagttttcacccaactcttcacttgttgcttgaaacatagtcctaactaatccaatgcactcaatctggttggaaatgcttccttgaacatattgtcatttcaataattacctcgaaaatcactggataggatttctcattaaaaaaaccattttcgtacatatctcctatttatttttacatgcggtccaaaaaatttacagtgtgtgaaaatgcataggagtctccttatcaagacccgcgtgtaaaaattttgacaggacaccccaaagtgatacggctagtggacaaaaaaaaaagagtaattagctataagatactacggcaattattttattatcttcactccaaatgaagagagaaacatataaagaaatacattttagccgtcatggacgtcgtcgcctcctcctccaaattctatagggttttggagggggatcaggagagggagagtggattagttcaatcaggttacaagcaatctggccctagaggaaaaatagtctttttcacacggtttctctctccatttggaccaaaattaataaaataatgatcacaatatctcatagttgattaccatttttaggattccgatagctatgtcatgtttttggagtgtccttcagcaatgagcataaaaacaacttttctaattaattttcacaaacaatatatagttttaggaggaccgcatataaaaaggatatatttacaggagtcaccctaggagcaccacatgtataaaagcaaataatctattaaaatcgaaggagggtgggccacttctagccgcaagccccttcgcatctctctccgctcctcactctcctctcccgcaccaaactcgatctcctctcctcctaggcgccaccctcgtcatctcttcctttacacacatcccacgttgatgtcgccgcataggcttaacaaggagttcaaagccataagatctgattcaccttggcctttccactggtggcgcgcccaaatcaattttcgtagacggcggtggatcgagccatatgtgaaaatcaactatttttataggtttttaagttataggcgaaccctccaacagcatgtatatatgaaaaaaaaaatctattctagccgtatgtacaaactggttttgtagtagtgattcatgttgaaatgcttattactgagaaaagttagcacatgttgatgggtcaagcagttatatgacttaaaggatgatttcgacgcaatgcagaacacttgaagaatgggcctcggtgaagggcaagagagacaaattttttactatgctcatgcatgtacgaactagtagaacagaacagcatactcagaacatggataatctgcgcaggaaaccataattaatgccatctacagtacgcaggtgcgcgattaagttaaacgcgattgtatgtccgcatcaacgaaaacaaccgcaatgaggccaaagcagggagaatctcagcgtataggctggggccccagccccccaactcagcagatgaggcatgcagccatattcctctgcctggctctcactctcactcgatcacctcccggtaaaatccaaacggcgcggcataattctgccgcataaaaccaagcgaccaaattcccctcctctcaccgtgtcacacgggaacagaacttactactcggcctctgcagctatatagctctcgatcgattctgttctaagctctagtaatctagcctattgcatgccgttcccaaggttagcgaatgtttttagactaagccgtgatctatcatctgatagtatcaggctatcagccatgaattaatatatatatataaatactactatatggatgcatatatatgtctgatgtgacctatagctttgacgcaatttcctcacctaatgcttgtgatatctatgggttgttgtcacgacactcgttataggttagtgatatctaaaactaattttgattacgtttctggagtttactttttgtttatagttaggacatcgaagggtcctgtttaaaaaggtcctccttgacgtacggattagagtatgggtcattgtttgagtatatgcaataatacgtacacaccatttttcccggttgatatatagacgggcagcattacaatactaataatcacactgtaactgccggcctaacaacgtcattggtcgcgtgcgatttgacgcctgcttggcaaatcgatcgatcaggctagcatgccgctagctggggacatgcgtgaaaagattgtaaaatcaccaaaaccagagaaagcacgtttaattattaatgtctgatcttgattcttgtctggatcgatcttcagaaaacatatatatgtgtatatatatatacaactgtcagttagaacatatgatccgtgaatttctcacatggttggcctgttgctacctgtggtcattgaggctacatcaactacttctatttccttgtaatgaaaaaggtgaaatacgcacgtagtttagactcatccgttgcctgctgctgtttattgtagtataatcaagcgatattttgtgattatatggaagaaatatacacacattattacttaaatctcctattgaaagcgtgttcacgtgtaagtaatatttatacgcaccaagatttgaaataatcatacaatcatagtcatatgactttatcgagacgaccggtgcttccctagaatcaagagatataattcgatcccaggaactgtcactactataaaaacgattttcttatacacagagctctttagattttagatggaccgtaactggtcgtgtctgcaacaatcgtcctccattttcgggtgtggatccttaagaggaccacacgggaaaatcgattttcacaaacgggtctcttaagtggaccgcacgcaaaaatacagatttttttatcccatcccctctccctcttttccctctcgctcatttcaaatttttcacctcctctctattcctttcccttttattcactccctcctctctctctctctctctctgcctcacctctcctctcctctcatcccctccgagcgtgcggcacgtgggatgcgggaggcggctggctcggcgccgccgtggccgaggcggccagcaggaggcggcgcggtggctggcgaccggcggttgggcgtcgtggccgggaacaggcggctagcggctcgggagtgacggtgctatctgccgcgcgcgcgcgtgatggccagatctgcgtcgccgcctccaccgagtaagaggtggccgggagcagcgccgccctccccacgcaaggtggcagcggatctggtggtggggtatgcaggcggcggcggatctggcggtggtaaggcgtagcggcagcagatccggctcaggtgacggcgacgggagcgggcagaccaggcgacggcgacgatgaggatggtggcaatggcttctctagggttagggtttcggatatttggattttctttttcggttttttatttttgcgtgcgggcaacataagcacccaccttcagggctatggcggccggggggggcttcctctcaatccaagcacaagactgatggatgcagatccgccttcgccatggtctctctaggcgccgaaaggggatcagattagggcttggcaaccagataagattagttggtgatcaaggagcttggcaaccagataagattggttagcgatctaggattttggccaggctcacatcgacctgctggtgttgtggttaccaccagcatgtgcacaaatttcagcgtttcgacgacagtgcccccatcaacatgggcaataccatggatcgtggtacctactcatgctacgcaatccaaccatccataccatcgtccaatggggatgactgcacatggatgaatgatgttgaacaattctcgcctgccaatggcaaatgatcgacggaaccttcgggtccaagaaaggaaccaccccactctcctcaacttggtagttgttcctttcatgtctagtgcaaccctcattctctaatcgtggggacagccgcctgctaggctactagcgatcaactggagatagctacaagagtagtggctttttgcaggattgggaaaattggtcatgggcaactaaggccgattcggcagtcttggccggtcatgagcatgtcatatccgactgttctcggtgaccactgttgttggaggcatatgtttgttttggtgagctatttggtaatcgaacggggccatgaggtccagtgagataactgcgggtgaaaatcctaatcctatttctagatttggcaatgttgttgattgtatgttgtctcctagttgaaggtgtcgtcttagacttggataaaaatctagttccggttaaagatgatagcggcagacatgcgacagtttcttcttgaaggctttgttttgaagtaggtttatataggtctttgtatttattcggtgactgagaattttttttcctctattctggctatgtgcatcctagtatgatggaagaagatgccatgtgtaatttcatttattaatatttttcttcccattataagaaaagtatcgtcatcctcctccctcactatctagctccccatataaaaaaacaccttatgaaaaacctccccaccaaaaaaccagtattttcacgcgaaaatcaactcgacaagccgcatagaaaaaaaactaaatccattaattccaatcccgtataatgcatgagcatgacaccgggtttggctcggttttatgtggacaatgggcagaatagctatattaaggctattaggttagctagtttggttggaccggcactactaccaaactccacatccataaaaccctcataagtatcggttcacttcaaaccaacacttttgaggaattttccggcgcaaacgagcatttttaactggatcaaattaaaaaccggcacctataatcactcattggtgccgattcataataaaaacccgtaccaatagtcataggtaccagttattataaaaaattggtacctatatataaaacaatagtaccggttttataaaactagcacctatatgtgagagataggtgccggtttttataaaaccgacagctatgaattgagccgagtcgaatgcactgacaaaaatatctcaagtagtaggtggtcggttttctaagtgtggtcgacctcttatctcccacattctcttctcttctggatccatctaggcggcgcgggggggcactgccaggcaacgagcgggggtagtggccggcaggtggcacccctccatcgaggggcgggtggccggtcggggcggtctctgccgcgtcgaggggcggttggtcccggtcgacgggcatcccactacagcttgatgggatcaggagctcgcgcgtgttgtcgctcccggtcgcgctctgcctccctcccgcccccctctcggggccttccaggtacggccgccatgagctcggcacagtatggtggcgagcggcgtcagtggtggcgttgttctcttccttgaagatcttttttcctcgatgttaatctatgcatgttagattctgtaattttgtgctttgatgttcttgaatatctctcaatatcggggtctctatatatgttgttgttattgagtggtggattggtggtgtgtggatgttgatgaatatgttcttggatgggatgttgttgggatgatagggagttgcgcgatgcatcagctcaaatcgaaccgacgcatccatcgagccatttttttttattcgtgagaccttgtttgcgtgatgtgtcgttcctaaacaggcacctatcatttctcctcataagtgccaccttggggatgccggttgagaaaccgacatcaatatgggttttccaattggcacctataggatgttctctagctagtagtgtgggttctagcattttatgcatgatgtgatctatgtaactacatgcaacgaatcaaactccaactaattaagaaaatgtgttagacatcatcgcaaattaaatccacacccatgcatgattcgtatatatatatatatatatatatatatatggaaagattagtccgaaattaatcgttgtttttttccctgcaaagaaaataatcacgcgctgaacattaagcgtggatgtaaataatcgctgagtaatttgtaaagagatcttttagttgtcatataaacaaacaaaaaaataaaatggtttcttcgctgtgtacactactagaaaaatcatttttcccgacgtggaggtctcattttcgcaggcggatatgacccttagagccaaatgaccgcctacgaaaatataaatcggggtgaaatttgatgtccacttaagcggcgcctgcgaaaatcattttcgcagggggagcacttaaggggcgactgcaaaaatcattttcgcaggcaccgcttaagtggtccgcctgcgaaaatagacttaatataaatacacgcgggcggcaattttttctaagtcctcagtcctcccctccacacctctcctcaccactggcccctcccctcccctctcctcctctcccctcccctcacttctactctccctggcggcggctcccggcggcggcggcggtcggtggcggcgaaggggcgactgccaaaatcattttcgcaagcgccgcttaagtggtccgcctgcgaaaatagactttaatataaatgcacgcgggggccatttttttttaggtcttagttcttcccttcaaaccttttcttaacaacgggcccttcccttcccttttcttcttttcccttcccttattttaattttccccgcggcgggttcccgcggcggccgccgttcgttgccgccaaaggccgcaaccgccaagaagaaaagccggcccgcccaaggtggccggcggcggccccgacggcgtggagcggcgacggcgcaggctagccgncgncggcggctcccctgcccccctccctcccagatctggccgaggagggaggggggaggccggtggcggcgccgacagcgtggagcggcggcggcggctcccggtgcgggctggcgtttttttttttcgtttcttctattttcgcaggcgggccgttgccccgactgcaaagatgaatgattttcgcagtcgttatggtgcaggcggacctctctcccgcctgcgaaaattagctttgtctacttgcaaaaatgatttttcagtgatgtccgcaaccatcatgcctcaccgatcgagaggaatgatcgcacgtgaaccgccagtactcgtgttcagttcacgcacacacgaaatatctacgagagaaccgcgtcaaagtaagaaggcccccaaggcaataattgactatggaaaacaacatcactagattatttcctgtataacaatgccatgtactaattctataatgctcttgaaattaaggtcaccgttaaattggattaatatatgcacacgtacgtggcccttgatccggattacagccggccggcccatgtctaattgtccatcattgccgacgatatatactactcccgtaaaacgacacaaggttttttttcaaagggttgagttgaatcgaaggccgtgatgcgtgacgccatacgcgacgacggcggcgcggcaggcgtagatagctagcgagcaagcaggaagaatccatggttacgtgcggtacgcgtgccattaatttgacggttgagaactccatccggtctcctgtttgatcgatcgtcggtcgagcatttattatttcttgtaccaatctgcgcacgtacgtacgtaggctgaggcatgcatctatatatggctcgtgcgcatatatacagcacctacaaaggtgacaatcgtacgtgcgtatgtgcgggtggaccttagtcaaacagtgaactcagcatatatatatgcacaagaatttttcccttgcttgatttgtttatacgtacaagctagtgtgtacacgccgcaacacatgcacaattgcacaaacacaaataaagaaataacatacgttggcatatagtataagtcaagttttgatataagctattagtaaatatttatgcttgaaacatttttttctactattatctcgcagtagcactaacagagccaagagcactaaaaaataaggcaacaagtagattctactgaataatgattatgttcaaggtaaattatttcagcggtggaccatgatatatgctacctaagtatttagttcgatcgggtggcctcccacctacctatgaggtgtgcctctactattgtgtttgttatcttttgtggagatagaaaaacatatatatggattgtcgacctagttgtgttggtcgtataggaactatttatattgcgttgagaagtgttcttaattttagtagtcttcctcacctacctgacattaagtacaacctccaaaatctttttatatttgtacacaacataatctctttacatttttttcccaacgtgcactccgtctgccttgctaatgttgggccaccagttgacgcctttgaaacatcaccttcctcactttcacttccatctacctcaaacccctccatgcaatctgcctctccggcccgttcccctctatgcttgatcatctttgtcgatcgagcctttcgtcacattgcaccttcctaatctccatcattttttaggaaataagcgtcatcattcacatcctcgcaccatttaactttcctacctacgtcacgaaacatatatacatcctcttcttttatgctgccaagatggtgacaaacaaagcctcttgtatctaaagcccgtccttcctcccttttacacatctagaacactaatttaatgttgtgctaccacttcgtagctatttgcaataagggatcttttaaagcattggcggaaccaaaactttctagagcccggacaaatctaactgtgccaaagatttattgtgaacttactattatctctctccataaccgcgattaaacttggcggtttaaccgcaaaaaaaatcaggtggccgccaagaaaatttcggattcttgtagtgtttgccaagcggtgaactcaccactgttgtgaggagcgctcatcagagaagccacaccattgtcactggtaagcatatccttcccctccaatggttagagggatgaagaagcatggtaatttttccctatttttaatataatttatttaccgtatggatttctcctacaatgttttccttaagaaaaaaacgaagcatagtaagtaagccgtttgattgggatcgaacagccatcatcaatctgcttatattttctcatcaacagctaattaaaaaaacatgagaaacataatgccttctcgccacctcctagccaggggcggatccagcataggggcagcggggtctcgagccctcactacttgcatgaagattatgagagcccccacgaagataccactaaatttttttaccatatatagttagaaggagggctataactctatctagtttattcagatcccactgctatttatttctgtatcagtcactgctcctgcctccctgagtagcttaattagaaatgccctcgtacttatgcttgcaggctgtagcactgtaggtcacaatagcgaaaattttcttgtcccaatccaaaagtaagtcggcttatgtgaatggtatctcgtgtgctcacagtgcacacagcacatatacacatgcgccgctgatcggcgagggagagatggatgcggtaagcccccgcagtctgtggacccaatccacagccgcttgacgacaccggccgctctcgcctgcgtgagcatttctcccccatcaactctaccggagttatacactcctcttttctataattctactacgaccctcacttgtctcactctgtacatcagactgtacatttctgtacatgtgaaccctgatagatacgtatgcgtaggcatcggaaaaggggtaaataaattaaatcgacttgtcccctgaataaacctaaggtaaaaaggctgtttaaaaatatatagtagcagagaggagagagcatatagtagagtgtggaaagaaggaagcaaaagggggagagagaaaagtatgacaaggagatgaaagaaatcagacaacaaccttcttagcctcctcctctccactagcttcttctcccttgccatgagttccctagtagaccaggactagcaggcaagagcaagcagctggaagagtattagcagcatgcagctctagagacgacaggcacagaggaggggagaggtatggagaagaagctaagcaaagctcttgtttttgctttggttctttagtttatatacgtcttgggtttgggtgtttgcgagctttttttttcttcttttcctttgtttctgagtgtaactgtttgtttggatttccctgcgcactttgttcttttgttcatctcggacgagccctaaccctttggagtttttccccagcttcttgtcgattcctttgttgttgtttcagatcgattccaagcagatacttacataagtattgagaggtattctcatccctttctgtttctcctttctgctcttttcttttggttttatccccatcctccttttgctagagaactttctgacatcttctcatctttgtgtgcttgcatgatgtgtagtgtcaatcttggttgttcttgcttgagtttgttatcgccatgtctcactcggacactacagcttcttgcagtgacgggaaatcaagaaaagaaagctgctactagcccaagccaaagctctacaagaagggaaaagattcccttctgttcttgagtagctagcttcgctcgagggtaattaaatctgagagcggccatggcatccaactcatcagcggcagctgtggcggcgttgtttggaattagggatggcgaccatgaggaccagattaagccgctatttgcccagcagcagcaacaccaccaccaccagccacctatggcgccatccaacgccgcggcggcggcttctgcggcagggtcggcggccggtcaagcggccgtggcggcgccaccagcgaagaagaagagaaccttaccaggtaatccatgcaaagtttatccctttttttttgttcagtttcagactttcagtcatgcatgcatggatgccagcatagcattcttctatctccttgctgatcttgtctcgatttatcggttggagcgagtttcaattcctttgttttagcatgcacaagaagacagctagctactgctagcttgtccaagattcacatggtttttgtatcgattttaccgtgtttgtctagtgattttttttcttggttttgaaatttttgattcacatgcataatgtcttttttggaagggatttgtacgctagcatagagtccaagatttggttcccttggatttaaattacatgaaatggtcctatatcttcttcggtttctaatttctctctcttctctagcttggtccaatgaatttcttacgcacctggattgtagtcacccagcactacttcatttaaagcttgtagtctcacctggatgaatagtatagtcctcagttcaggtgaaggtacaaagcacaaaatgatttcttgttttttttttgtttttttttctcatatgtcattataaatcagacttatttttcagtagatagattggttcccctaattatttctttaccgcagtaaagttccttaattcaaatagacaatcaccatcatttaatcatcaattaatcttagagattttttgggcaagattccatgtacgtgagctgttctcctcttcacccttgctggcctcttcctttctcttaccaatcatgagagatgcagatacgggccatgacatatgcacgagcaatgtcaattcatttgttccctacatgcctcttgctgcaaaattaattctcttttgccccccccccctccttcataatctcgtgcaaatattctctttttgccttaatttgtccctggctactaaaatcaaaaggaaaaaaaatcactactccccattacaaatcatccttgcatgcctaaccgatcttcatcaccataaatctactccgattgggaaattctttcgtgttaagaaacatgcatgcgtttgtcatcatcagccacactgcaatttggttttgtcatcagtagtgcggcaagctgtactccttatttctctctcttctaatccccacataatgttaaaaccaccgtgcatctatatctatatatcgatctaaattaaccattcacatatatgcatctaatatttatgttgaactaacattttgatcaggtagtgcagcgcatgcatatgtatatactcctatcttctaattaatactactttgcactagtactaataagctgtacttgcatgcattgcatgcgcagacccggacgcggaggtgatagcgctgtcgccgaagacgctgctggcgacgaaccggttcgtgtgcgaggtgtgcaacaaggggttccagcgggagcagaacctgcagctgcaccggcgcgggcacaacctgccgtggaagctgaagcagaagaacccgctgcaggcgcagcgccgccgggtgtacctgtgcccggagccgacgtgcgtccaccacgacccctcccgcgccctcggcgacctcaccggcatcaagaagcacttctgccgcaagcacggcgagaagaagtggaagtgcgacaagtgctccaagcgctacgccgtccagtccgactggaaggcccactccaagatctgcggcacccgcgagtaccgctgcgactgcggcaccctcttctcccggtaagcccacactctacccatctctctactacgtatatatgtatggtgtttttcgcagcttgatttctccatctgcatgagacgttgcatgtgtgtgcgtgctagctagcgaagaatgtttagtagtgtgcgcacaaaaatggcagcatgcacgttcggccggggttagggttttgtctgggtggtatagtgtagtactttaactaatctgttcacgagggttaatggctagtgggaggagaagaattatcgatgtcgtacacacgtgtacgtaccgcgtggtctgcaggatgcatatgcatatgtatgggcgaagagcattagggctactgctcgcacgtgatcttgccattgtcttgctgatgcaaatgtttccaagcgttcttgtgctggcatgcatcgtcgtcaagcctggctgaaaaggcctcccgtctcttcctcatgctatatatattacaagtcacacaaataaacgcgatatgtttatatatgtgtgcgcgtgtgttatactgattcatggccccaattcgggatcgatatgcccggaacgtcgacagctagctagcacattcttaattcgttgggctgtctgtctattcatcagacaactgaattttgaaatatctaagcggtcagaattattccaagatccgtgcaataactatatatatatatatatatacatatgtaagagcatgaccaacagttctctaaatgttaataattaaatatacactgtaagacactctcctacagttttttccttaaaaaaagacaatgctcctaaataaaatccaaccataaaaagatgggtttttctatgaaaattaggatccaacaattcccatgtagagatgataaaaaaaatttagcatccccaactccgtttttatcgttctccacatctagggaatggcacacccaaaaaactgatcatgcgtgggatgagagctatcgagatagcggcatggaaggtgggcgagggagatcgcccatgaggagagaagggcccctttttattttaggaaattaagtttagactatctgttatagagatcaaggtatattttatatccttaaattcttattagagatttcaaataagatatttattagaggagaatattggacatttgttggggatgcaataaaccacttcgatgcccggaatcctgatccatctctcgcctccgctagctcttcgatcgatctccaccttattggaaggcgccagaaattccagctagttgtcctctccatatcaaatcctccatccacaccatagcgttattattggggtatatatagcttcatctatgatatacagctcatgcagctgaagttcggatgtcgctggtgccaagagggcttaccaatgaagtcactagtgatgttcttagtgagtcatcctgttgcctccctctcttcctcgcacctctctcggtcggctagaggtagaagatgcttgccacttgtcgaatcgtcggatcaagatcttcatagatcaattggccaagatttaagaaacaaaatcccagtggactagtaaatagaaaaattgtcgtccatatatataaaaatataattaaacaagcttatatgtgtggcactacacgtctgcactatatttttattttaatgaatcagcgagccgtcaattttattgaatatagaaggagtaaattgtacaaaagaaatgagctgtacacgtctgcattatacacccccatatgatcgtaattggctaatctgttttgagctgccatatagaagagtatggatatatatagtctttcgctgtgtatatccacccgtggattgagccgactttctatttatatctaaaaataatataatgcaaactataacttatatcatgcagaatatgatatgtgaatgtgtgtgagctggccggctagatagatgtgcggtgcagggcctttcgttggccttacgtgtcagaagagcctgtggttcacgcttcacacggcttagatttccctcggatacatgcatactccgatccaggcccttacatctgatctcacgagtcacatgggtgcaacttcgcttgctagcagcagtgtcacgcatactgcagactctctctctctctctctctctctctctctctctctctctctctctctctctctctccagaatagcagcaagtgttcacccctatctttcacaactcgagcattttcctctctggcttcatggcatgacctctgcatgcagagttcttagcatcaataattttgatgcaatgggggcctagccctatatatatgtgtaggcttttgtagttttgcatgtgttttttcatccatatatattcttgttggatcaccctttggttccttggaaaatgagctttttacaaagtcttctcatgtctccgggcgagttggcgtgtgcgtgtgctactgctctctaccatggcgatgtccaatatgtctactactagtactagctagtagtagaatttcttttcccagccctttctccttggaagcttcttgcaccatatatattaattaagaacctatatatatcggtgacgccatgctatatcaatctgcctactcttttcctcgttttcatccctgattgacatgagtttctgggatctcgagcttcaattgagtgtgatagaagtcaagtgatgaaacgaacaggttttagtcaaccccacacttgaaaacatgtagaatcactggtagatttagattttttttctaaaaaaaagatttataattttttaaagtacatgcaaacacaagtacgaacaattatatatcaatgttattgaacacttcaaatacaagacattataaaaatgtgattcattgacaaccctgggtggcctaggagctacccggggtcgctaggcatttatctgcaccttggtagaagttgtacatattttgagcctttaaaggtcattctaaaataagaaggtcattgccctccttttgcgtgtcgcttacataatcaataaaacattaataacgtatattgggttgtcatatagttaccctacaaatatgtatgttcaaacttaatttgaacaagtgggaaaaaatataactgcgggaaatacacacacacactactttaatttcatagttaattaggtttgttttttctttgatgtaaatgaatttggtcgtggatgtctgtacagtaatacatgcatgtgacggcataatctatatggccaaatcttgttagcttataactatttagatttcatacatgaaacgagggcgcgcacgacacacattcttgatttaatatagcttaaaatacttctcccaagattttttttttcggaatactaacagtaggagttgttacacgcaatagataaaattcacttacttgtagaagaaagaattaaagatatttcaacgatagtatatcacacagttctactgtttagacgaccattatttctcgtacccacctcaagtcatacgcacagtgtacacacattcatgcatccttgccaattactgtactagctagtactccagcttgtaactttttccgtacaaatatatggtcgtcctgtgtatggaacttggaatcttatcggttcaaggcaagaatggaacgtacgtactacgtctcctaaaagatgcaaatatataattcttgaatacacattgcatctaattattatagtgcttttttgcatggatttctgtactgttgtgcttaacatgcaattgattagagaaaaataatcattttctcgggagtggattttaaactctcgagaggatatcccctcgttatttgcatgcaattcaaatagttacgaaaaaaatctaaataaaatatgagaagatgtattaatatgtgatatatcgctccacaaacatgcaagttaaaattcaacttttacatgtcgtaacgaaaaaaaataaatttaaccatgaatatgcattaactagctataatttaattttttttcgttgtgagatatagaagtcgaatttgagcttcatgtttgtggagtgatatatcccatattaatatatcttttcatttttttaaaaaaaacaactagactatttgagtgacatgcaaacaattatgggacatccttctaagagtttagaataaaaatactattttctcaactctctttgagagtttgaggagagggggattgagaagattgggaagatacacaaaacgaggtgagctattagcgcatgattaattgagtattaactattttaaattttaaaaatggattaatatgattttttaaagcaactttcctataaaaaatttttacaaaaaatacaccgtctagtagtttgggaagcgtgcacgcggaatacgatgtccttttctcacccaatcccccagaactcatcacaaagaacgcagccttagttgttagtatcgatatgatcaatgccttctttccaatatatagtaaactagtcgatacaccgctttttgctgcggaatatgtcgatgaatgcatgttatatatcatagaaatggtaatgtatatgtttaaataatgtaaaaataatgtggagatattgatttgacattgtttgcatattgagttctaaaaatacaacaaaattgtataagtcttttgtttttttctagtcaacttatttaattttgaccaagtttatagaaaaatataatagtatttaaaaaataaacatattattagaatatatcaaatgttagatttaataaaattaatttgatattttagatgtcgctaaatttttctatacatttaaaagaaattgacgagggaaaaaaaatcaaataacttaccgtataaaatagagagagtactactacatttgcacggatgacacagcaaaaattttgcatctagctgtctagctgatgagcaccacttcacgtgatttctgtatcagtacccgatactgtagtgacatgcactgtccttcgagttatcttcacttttgcgtcgtacaatttcacgtgcaaacttgtgccgcacggacagtgatcagtttgatggtacatcgcatgtgtccgtcgtcgtccatgcaaatgcaggagggacagcttcatcacccaccgcgccttctgcgacgccctcgcccaggagagcgcgcggctgccacccgccgccgccggccacctctacggctccgccggcgccgccaacatggcgctcagcctctcccaggtcggctcccacctcgcctccaccctccaggaccacggccaccaccaccaccatcacggcgcctccccggacctcctccgcttcggcggcagcggcggtggcgccatggctgcacgcctcgagcacctcctgtcgtcgtccagcgcctccgcgttccggcccctgccgccgccgcagcagcagcctccggcgccgttcctcctcggcgcggcgccgcaggggttcggcgacggcggcgacggcagtggtccgcacggattcttgcagggtaagccgttccatggcctcatgcagctccctgacctccaagggaatggcaccggcgggccgtcgccgtcgggtccgggtctctacaacctcggctacatcgccaacagcgcgaacagctcgggtacttccagccatggccacgcgagccagggacagatgacgaacaccgaccagttcagcgaaggagggggtggtggcggcggcggcggcggttcagagacatcggcggcggcgctgttcggcgccggtgggaacttctccggcggcgaccaccaccaggtttctcctgccgggatgtacgcgaatgatcaggccatgatgctgccgcagatgtcggcgaccgcgctgctccagaaggcggcgcagatgggctcgagcacgtcgagcgcgaacggcgccggcgcgtccgtgttcggcggcggcttcgccggctcgtcggcgccgtcgtccatcccgcacggccgcgggacgaccatggtcgaccaggggcagatgcacctccagagcctgatgaactcgctcgccggcggtggcaacgccgaccaccagggcatgtttgggagtggcagcatgattgacccgaggctgtacgacatggaccagcacgaggtgaagttcagcctgcagcgcggcggcggcggcggcggcgacggcgacgtgacgcgtgacttcctcggcgtcggcggcggcggtttcatgagggggatgtcgatggcgagaggggagcaccatggcggtggcggcagcgacatgcatggcaccttggaggccgagatgaagtcggcgtcgtcgtccttcaacggaggcaggatgcaatgatctcttaagcatatatacgtggcacgttggcatcaacatgcatggcaggaataagttgttgatttgcaggttgcaatacaatgctgtgacttgtgacacatgtgatagatgtttttgcatgcatccatgcaaaaggataaagccagctttgatgatgatacaatcttagcgagagacatggtgagcagaagagcttctcctagactcctactaatgcatgatgaagctagatcaacaggaatcatgagacttgagctgaagttaggcgttattactgcaatatactattctgttcctgatagatcttattgctaaatttcatttgaaagaataggtcttgctaaatgtaattgggttaattgtactggatcagggataactgcaatgagactgtattatcttcttctttcttttctgtcagacgaattataggtctgtgggggataatgagacttaattaccctactgatcttttctattttttgtcctctttcagtcattcagttaaccctctagagcaaaaatattgttcttgcaattaatgcagttaatcatgatatatagtccatgttgtggtgtatgtcgtttcatgttaattatgtcatcaacgtgtcggctgtgttgctaatatagatgggttatgtttactgagctcgaaattttaaaaagtagccgatgagaaactactagatctttctataacttctgttgctagtttatttcgaaggtatatagctacaatttccaatataactttttttgctagtttattcttgggttctatctatagctactaacattcacaatcaagacgaataatttaggttgttttgggagctagctggagattcttgaagtagctacaattcgccaaaaagcttcctaaaacaggtccataatccctgaagaagaacaagaaagaaaacaaagctaatatatttttatttttctccctgattataatcgattttttttatctttgtactattgttttcattatatatatacgggatggataaacaaacttaataaaaaatgattccaaccttttttttttccatttcctgcaactacatttaggtaattgttccaatatattcaaggggttgcaaaagggcctgtaacctagtggtttccagtatttaacggctttgtgtttttagtggtaggcgatgtacccgttgacagcgagacgtctgtggtgacttcgtcaatctccaggatttgccggtccagtcttcaaagatgctcataggggtagggtttacgtgcgtgcgttcatggggtgagtgtgcgtgcgttgtactgtgtaattctcaaaaatatatatatacatatatatattcaaggggttaattattttgcgactcattttcatttttatatagttagtatgatattcttttacccgtgtgtgtgcgcctatatatgtgattttgtaagattgataaattatgttaacacctagataacttgcaccaaaaggatctcttgaaaacaggagggcggtgcatgagtgtgatctaaagtgttgttgaataaaaatgcaccagtagaaatcatcacccaactcaggccatgtttcattttttgtttttgattctgccccaacaattaattttgaagaaaaacaaatagcttgattccggaaacagattagcaaaatcaaatcctgttttttttcttctaaaatccaaaagcaggatattgagctatttgtggattttgggtaatgatgttcacggcgagtattgcgactatttccaaatccacaatcaatttaagaacttctaaaaatcacaatccagaaaccggattatgtgaatcaaaagaaaaagaatcagggcctcaatttgctttaaaatagcttgagatttcctatcttatatactacaatttcaaagtatttttataaatttgtaataaacatataaatcattaatgatcacatcattcaaaactgcaattataactttctacattggaacatatataattgatttcacctagtacaaatctagccaacgttgttaagttattaaatattttgggataacgattgggttacatgtatatgagatatatataaaaccattgaaaagttataatagatatgcgattgatcaatatgaaatgtgatttttaagtcctggaaataacatttcaaaccattatccttttctgaaaaattgtgagagaattatatggtctatatattaattttaatattatttgggatttgaagtatttcaaaattgagtggatttcatagcctcaattaattctcaaaaagttggtgctttctgtgcagatctggtcaaattattaaaaactagagccactttcgacctatatattaattccccctctcaattatatgtttgacttctgtctcatagcgcatcactcaactaattaatgttcgaatttttttttggtccaaatgaaaattgaatgattccgattttcaacttgggatttaagtttcaaagagtgttttgcaacaacctcaaagacagcacgccaagcgggaaattcttctgacatgaaggttttgcttggggtgagggcacttgataggttctcgcatacacttggctatatatgtagcgagcaggggaactaagaagaatatatagctcatggtcatgcaatgacgagtttggcggctagctctatcatttgtctctaattagcttatcagttatgcaaaaaaaataaatctaattattttagagttgtttttattgtgtttgtttttatgcattaccttttaaatcgctaattaagaacacaaattaatatacaaattttacccataataacttttagttttattgcgttgttcattttccacggatgaaccgtagagtaaatgatgggtgatcgtacgtctgggcttggtactgccacaaatgattggctgcttgttgtggcgtccgcgagctagcaaccttacagctttatccataaaatagcgaaagcgtatctagtgagatgttatccacaacttaatttgccaactagactagttcatcataccgttgattggtttctctataatgtgatctcactgtctcggagtactcctggtatttttctttcaaccggtcaaagaaagtgcatatattcaaatttaattaaaattttgttcagattttgaatttatctcgatgagattttgctcaagatagaggccggttagctcttcgctggcactcctcaattaggttttgaagagagggcaaggagaaaaatgaaaaaaccgtggttcctatcgctatcttgcatactacggcaaccgtgtgacgcagggcgtatacaggacgtgacagcgatgattccccgtggtggggggacaaggtgttcgatcgttcggtacatgcctgcctcgatcgacgttgatatttcacaggagaacggaattagacaaagtcctcgagtacattctcttcttaattataaagtagggcatatacatatgcatgagtacgtccctaattccatttgtgcattaaaaaagttcagcacctagacggcaaaattaattagtcaacaatctgcaagcctcgatggcgatctctgcacgtacttttcgttggtaattaaagggtagcgcccaagttaatatatacttatagggtttgcttgcacgaagctcgcgttccattctgatgataattctgagggaaaacaagtgaatgtttggtagctggtgaaagcgacctttcgagatcgtctgtcgccacaggccacctagtggcgtcgtgttgcctgtatgtgtcgtgtccgtgacagaatactaatgatacagatgatgacgagcttaagatttggcacagtatacagttggtaccatatatgctttcaaacggaaggataaaaagatcaaaagagtagagtcttgtgtaaacagcatgctagaataatagcagacagctagaagagttctgcttgataaattgtttgtccttaatgactaatgcacttgtgtgtacttaagtgaaacaatcatggatatcatcggacgtttgtaatggccctcataatgtctaatcgatcttcaggaaaatgatggatatgctgtaccttttgtactagaagcagtacgcaatgtactatacaataattatggtgattgcaattctgtgttagtgttctggaagctctcagagctacagaaccaaattataattacattgcccagcccaactgccgggaacaaattaagctgttgctaaacttcctttttactaactgcatgaacctgtagaaagcttttgctcacctaacacttgtcattagcttgtgccaggttaacaactctgcacacacacatctgcactgctgctgatgtggcgcctgttttgtttgtagcgttgtcgcagcgtgccttggcctggatgcacggcgagatccttcgcctatagccaccggctgataattgcgcatctatactactataatatatcgcccacggtcacgggcgtgttctagtttctgagggccatatggccgggagaatccaatgtgtgaatatatgctggttaacatatagctttccagtaagcaaatcatagtgcaggagaagggagctgtgtgatcgctgtggcttcttctgtaggccgttttggtgttatgctcatgaaaacttcagaaacaattccagccgtgggtgcaaagcaggtgttgggtttgtaccaggtaggggtctgtctggacgagcggctggaataaattagtagaatataccatgcctttgccgtgtaggtagatgtagcaaagcaacatagctagtgtagagcgctcaggtacagaactattacatgttgactaggaaaatgtcctgtggcactgtataggatagttgctctgcatgctcagacaaactatttggaatgtatgtctttggaaaaaaagaataaaaatgaaagcaatcatacttagagctgtctaccatcaaacaactatttcaaccttgacattatttgagcaaaagtgggctaaactgcttaatgcaaatctagattctatgtaccaggagccaactaagcaataattttgtccgagacaaaaggctaataatccttgcgaatcaaggtgcgcatccaacaagtggaaaggaaccgcagtagctgagatcagcttgtcctggaaacatggcagcaatgtaattgtcaattattacatttcttcgacgatatgatttgagtagccacactgaaagagtctagaatcctcaacttctagtgttgataatagataaacaaccagatcatggtcgatagttcacagcaccacaatcattaacgtacacacactataggtcgttccgtcttagataacagggggcgactcaaaccgtcagacgttttcccccatacacaaatattcccaaacttagcagtagaacatgacacgtttgacattttccttcagatcaggaagcggccttacagcaacattcccagcaggcttagtgctgcgtgcaccaggaagggggccaccgccacgggtatgggcaccgctcgccatcgacccactatctgaagtatccggctccatgtaaaatcgagctcgaaatgccgcgagatgggcataatatgcaggaggaactgcagaaatcaaatccattgtaagaatatgtagccacaccgagggaccaaggggttaacgttttctaatcaggttaaatagaggagtcatctgcttaccgattgatacggaacgggtgcaccttgcatagctgcaataatagggttacagggacaatggttagcttactagtcttgtaataatgtactcctaaatagcaatatataatgacatgaaagaaaattacgtgtagcacaagttgtttgtcagagtttgcaaaccatcagcagtgaacttgttctcatcccacagaacatgataatgtgcagggcgacttgttccctaaaaatagcataaagtaaaatcaagtccatttcatcttgtaaaagaatgttttttttgttgcggagaagtaatatttgtaagtgcagaaaagctgacctgaatgcccgcatggctacacaggtagaaatcaaactcagtaggatggcatatctttgaatcaaccacggtgcctgaaatcagatgaacataaagaaattaaattcaggtaaagaaatgaggtgtcaatcatagggttaacaagatatacaaaataactaaaattacaggaaggcgacaaattacctggtagtatatttccacttctgtcaacagtgcgctggtccttgtggttattagcaaacagccttgtgtgatgacgcttctggaccaccacaaaggtaacgggtggctgataatcggcttccaaagatgcacatgcctagtttttattgaactgttagtcggggactagagagataacttcatggtgagaagaaaagtagataaattaaaatcacctttctaatggcatcaagctcataaaacagaacctgataaaactgtccttcactgacaccatccctgaaatgagagatgttaaatatgtggaaaaacagtaccaactgaatatgcagttgtgcacaaatgaagaaaattacctgtaaaatataatcctctggggtttctgtccagttgccctcttgaaagaaatgagaagctctctgcatatttaactaatagaatttatatatgtactactaccaagaaatattcaggttcaatgcgaactaggacatatatacctgatcattccaccacttacagttcctctttgaggatctttccatactttaaaaagatcctgtatcaattcctgacgatgggcctgtgcactcactaatccggcatatttggtgacctcaggccagtcttgagaagcaacaacctgcatgaagcatgaaatcaccaaaaacaatcagaaggcaacgcaagacataaaaaaggtcattgttctatcatatgataataaagagacggtatgcgtaacattgaaaagctatgcacttacagctgcaatggaagggctagaatcttctccaggatggggatgtgtaacatcagcaccaaaaatgatcgttggcctatcactcacaaggggaatcctccttgtcaaagcatcaacaagtactgtatttcttcctcccacctataaattaaaggaatataaattactacaaaataaaggtaaaaaactacaaaatcgggcaaaaataattggtagaacatttccgaaccttaacattgattttaagggcaacgtttgctaaatactgtttgctcatcttaaaaacatgcttcgtaagacagcattgcgagaccaatccaagatcagtctcacatatccttttgagatcgcctgaggattgacaagcatattaataaagacttttttatcagataacaatcaagtgttgttttgaaataaaaaggcataccataaagagaaccattattgtcaggcaatattgcaatcagcaggtcaagctccccgccctgtggtttcagtatattcatggcctcttgatagcgtgccttgagcgctctttccacatgttcaggtcttgcagtcactagaggaaccacaggatcaattgagaagtcctacaacgagaggatatgaagcatgtgaaaggatgttatggtccaagaatatacagagtcaaatagcaacactgaaagagatgtctggaggcaccattagatggaagaaaaacttaccatcccagatatttggcacataatagcaagctcgcgacagaaactcctagcagcattatcttggacatgacgagaaaaattgatgcatgtccagttgttaactctaccaccattgaccattttctgcaacaagcacattaaagaaaactaattgtcgcaactgtacgcaattatagttgggagacatcttgaaagacggcaaagcaacagttattgaagaacagaagaaaaccaatttttttgttggaaaagaaaaaaaggatagcctaatactgtttttaggggatgcttcgtataggtttgttttctaataactcacttctaaaaccataccttattcatcatattccattggccaattcttggcaagacatccttctctctgccactatcgtggtacttaagctgcaaagaatattagtcaaatattgaggcataacatacaaaaggcatgagatattgacaaatgtcagccatgtcttgaactttgatcttacccaggggggtggtagaacacgagcttcaacagatgcaagtcgctcatcgatccttatgccaaactcctgtgcatatggatcctgatggtatgcattgtgatgcacagtctggtcatcaaagacaaaacaataaaattataaaacttagaagccgattctgatgttccaatagggaacccgattaatggttatatatccaagtaacacaaatagatggtgagctacatttgaaatgtgttttggcataacaattgacatgaatcaaaccaccttaatatgtaaaaacatatagaaacagtttaaatccaaaattaaaatataacgaggactcaactgtgggtacaatagcaaagcattggatatttgagtaagaactaaaaaaacttgttttagagttcagacccacaaaaaattgaaataaggaaaccacaaaacctttacaaataaagggcttgccaatacataaggcaatacaaactctagatacaataacaagtgtttatacatactcaaatactcagtccaaaaagagtagataaaaattttacatgatattggaagaacttatatgcatggcctaaaatgcatatggcttaataaagaaatagatcaccaaggcatgaaacaatgaaatagcacagttttatagtacaacaatgttatagggcagttggaagtaatctgccaacaaaatgcacccataattacctgcaaaatgtccagctcacgctcttgagggcgctggcaggtcactttaagaagagcagttatctgcttctcatttagtctttttgagtaacgctgtccctccacaatcttacagacctgaaagttaagagtgatatgaaacacttttctgatatcataaaggtgcctatagcatttctgaccttaatgggtgttgaacaaaaggaggtttcatacttcataaagatggcattttaggacactaacctccattggtagataatttggcctttgttgattgcccacttgcaagcaaggcaaagttgtgtgcttaatgttaaatccatatgtctcctggaagtattgcaccaccgtcttcacagtaccatgattatcaatgggaaaactatacaggacaaaccaagcaagtgaaatcagcaaattatccaatcagacacacatctgcaaccacatgatagagaggcttcagatatgagcaaagcagactacgtacgacaactctcgtgttgcttgcgaggtaaggccagaaatgcgatacttcctgcgcatattgcctctatgtgtgacctcaacctttacaccccttagggccttcttgatctgaccaatgggacagtaaggaagcatgtaaagcaaacacagagaacacaaatatacaaataaagtagtcaataggataacctaaccttcacacgatcagcatcagataatggtctaactgagatgtctctgttcaaaagctgtgcaacaaagtcaatcacaggtagaggctcaatgaatgctgtcgatgacatatctgcaggacaaaatatcaggttaccccccagatgcaagagaaaagagacgtggtttgatgatctttaccaatatatgacaatgtacacacattctagatgattatcaaccataaccagtgacagataaatattgaatacaacatctaagattcaaggtttcccaatacaagtgattcctaatattggctgctattgtaccataacattagattatgataatttgctttgcaaccaacaagctcaattaatcgaaatttgtaatttatgtagataacttccacagatgtgcatgtaatttatgcagcttagataaactttcttactatcagcctacaacagaaagtggtgtaagtaggaaaaatactaggaaatgaaatattaaaaaagaattagcagttaagagttccatgtatcatagaaatctcctaagttattgtttccaaaacacaaatgatatttatcaatagtcagtcaaatagatcattcaatgagaacacagacctacaggttagtctaaagggggcaaaaaaaagtagctattctaaattataaggaattattatttttcttcgagtagtaacatggaacatgaaaacgaggacttggaatctgaccaatattcagagaaagtcccatctgcgtgggtcgtatgctttggtaaaaaccacgccaactttccaggccctcgccaagttgttggcgccttcctaagttaggcgaataaaatgaccttgcaactggagagtacctacatataaaaaatatagaaatgttcaaaagcttgctaacatgataatgatatagcaacaaatggcagggtaaatttaccttgcagtaggcaattcacgtagaacaatgtcaagaacttgaagagcttcttgaggagcatccgcttgccttccagctaaaaacatggctaaatggtggagatcagcgcgtgcagcaaatttgatcacgaccttaaatggtctctcacgcctgaagacaagcagatgaatcattggaagatgaatttatcaaattgttgaatgttgatatgtccagagagtacctctgtgcaccttgcccaacagcaaggctctcttcctcatcctgcagaataacgtcaaaggtcctagaagtaaatggtaatggaccagctgtgtataagctcttccttccatcatagactggaagacggccacccaaatgagactgcctatattgtgttacaatttctccaatgacagcacgattgacaccacgtgaaggaacctcaggagttatagacacctgaaagcatgttaaatgaaagctcatgaaaaacaacaaaagttacaaagcttcatatgtataagtataacaaggcaacacataaacaagatcttacatcatactggtgaaggtctttgtcaggcaattcagcaaagaaatggttggctttcacgatgcacctatcaccaaatgtacccttgccagggcgcattggaaatctcactgatttgctcgatggtggtgctggttgaatggcctggctagtggggctttgaccctggatggcaagttcctgaaactgatgttggacttcttcgctgctggcctcaacaggcagcgaagatgggccagttcttgatggtgatggtgcaaccaccgtagcttggtactggtcttgtgaggcttggtgcagctcgggaactgttcttgatggactggcaggaactccatgtccaccactgccactcctgtgttgtggcattcctccttgccgttggacaccacggccatagtactcatgtgcttgatattcaaccggaccaccacctggttgatgtgatgttggccctccacgaccctggtaacgtccaccacgtccctggtgttgtccaccaccacgaccagcttgttgagcatattgaggattggcaggttgccaaccaccacctccatgctgttgagctctctcaggtcgctgtgaaggaccccgtccaggagctccagtggcttgttgagttccagaactttccccagcattacggggttcagtttttttctttctcatcatggctaaagctgcaatgcaaggtgcagttatagctttagtattattattatcataggctaatacaaatctaaagagtgatggaggcccaaggcacaaaatcaagtgcaaaacagataagaaagtagaatgaccaggcaaatactataataaatagaaagagggaaatccatcattgccatacaatcgaagatactacatctgccacattgaatgacctgaattacaacatggtttataatctttcaggcaacggcggtacagcacataatattacatagtctttgccaccatattaatgatactatctttgttatgtccccaaatacccccaaaaattcaaagtatctttacaaagtgcagctgctcccagattcatgcattaaaagaaaaagaggagttacaagcaacaagataaacttttttctttttccacatgagatgcagtgatcgacagtagtcaatactcaggtcagcatgctaaaaagtcagagaaagtgagcgagaatcattgtgaatactgaataggacgaaattcgacaaggtaattaaacaagtcacatcatcctaattcccttgacaatgttagaaagccacacaaatatgacatgcatgatcaagtgggagtaattttgctaaagaagaaaagtaaataatagggaaatgggagagatgggaacttggaaatcccttgacaatgttagaaagccacaaacaaatatgacatgcgtgatcaagtgggagtaattttgggaaatgggagagatgggaacttggaaatgaaatggaagtttgatgagcaatgtagtggaagtaattttgctgaggaagaaaagtaaataatagggaaatgcaaaagaaaagaaaaataaatgggtgcagcatcatcttgcatcttaagtactcattaggttttccactttcagaccacgccagcatcatcttgcctgtaagtactatgtttatacaaagtattaggttttccactttcagaccacgccagcatcatcttgcatgtaagtactatgtttatacaaagtattaggttttccattttcagaccacgccagcatcatcttgtatcttgcatctttaacttaagtactatgtttatatatatcggatggattgcatatatggttgcttatccagcatcatctttctttgcatcctaaatactatgtttaacgaagtatatatcggatggattgcatatatggttgcttatccagcatcatctttgcatcctaaatactatgtttaacgaaggattaggtatatatcagaaggattgcattgattaggttcttttccaaataaatactatgtttaacgaaggattaggtatatatcggaaggattgcattgattaggttcttttccaaataaatactacagatcgtgtataacaatctgcattgtaaacatcgaggtaaatcaggtagcaatagcatagaacaacatcgcatcaaccaacaaacaaaggaaatcaggtagcaatagcatataacaacatcgcatcaaccaacaaacaaattacaggatattgcagatcaaccccaacactaacacgtctcactcacgcggggcacctacctcggggcacctaccttacaaatcgagacagatggcccgacagggattgctgggtaggggaacgattagagcgctggaaccggtgactctcccccttcgtcggcgccggcgccggcgcaagagccggtgcggacgagcgcgggcacgacgcggcgccccgggccgatggaggaaaacgggcggcgacggcgggcgagcgcctagcggtagcggaaccgaggaagaaggcggcggctgcggaggggggtcgagggctcggtgcgggtgcgggtgcgcgtgcgcggcgaaggggactaggggtaggggaggcgaggggcgagcgaaccggggtgaggacgagggtgacgggagagcggttttgggcgaggtcggtcgtgcactcgtgggctgcgtgtggagacacttttatcctttctgctttattttcgtgtcaatcttctccctgttttcctccgtattttaaggagtctgaaaaaccgaatggtaattgataaggagaaacatccgttttataatcttaattgctttcctaaatagatttctaagagcaccagcacattagcgataatctatacccaaaatttgatttttttagtttcctaaactaaatagggagtgaaaaagctcaaagatagcctaaatttaatcccaaaattaaaagtggatcttttgttaaactaccaatagaaatttctgtttttttcattccacacccagcatgctcccaacataaattttcagcgctcgcacacgtaccagagattgagagtcgctctctcaccctcaaaatccatggggaaggagagagaaacacaccaactagagatggggagttgctctcttacctttaaatccacatagcaagatatatggggatagaaaatccaaaactactgcagtgctttttggatctgttggatcggattttttcactgaaatctctcgaaatcaattttgggaataaaataggatgattgttggtgatattaatcccttgaatttgttcgcttctacaccctcgtatttcaaaataaatacatctatcgaaaaggttattctagttaaactcttctagtacttcttgtatgaaagttagacccaacaatggatcggagggtatgtataatagatactaccaaaattttatatttttgttaagacttatcaaattttgatttggtattaagagcgaaacgtccttgaatttttaaacactttaatagcggaagttgagtgttttaactatatctagtctattatcttaaaaaaaggtaaaattgaaaacttcaaggaccaaaacgtgcataggtacttggtataacattgagccacgatgctagtaaagcacgattttagactgttattttcgctattttattagactgtttgttccacgcgtttaaacatatgttttcccaaaaatattttcttcctttccattatttagataactcgttaataaactgtttgctaagcctatttaaaaagtaataatttatctttataataagtagagaatccgctctcaaacttgacctaaacgttgctgtggaagccgacagtgtagcctatcaagtctataaggacaacaagtccatggtcaagagctttcggaggataaaaccagtcactccagcatcgtatagaagcgaatgcgacgtatacaagtttgaagtacaaacatgaaaatctcaagaccacaactgccatgtactgttgtactaacacgtactacttcaagtcatccagtacgtagtggtacttttttatggatggtttttactcctggttaaactttttttgaggcctcgtagaagatatacttttcttgagatgtgcaagtcaatctgcacatgttagactagtctatctgtttatgcaaccggtttgatctatgcacaaggaagaacaagcaatcgccaggtttactggtaaaccgtccatacatatagacagctgcttctagtagatttggttgtgttataataatcgttgttaaaggaaatgcgtactaggagcagtacacatataatgtagggaaaaataaaaggaaaatggagtacacatcgaaagatgccaagtggggagtgggccggcccgctgacgcctccctacatgtcagcagctagccagtgggccagaggcggcttcggcccactgatggaaaaaaaaaacctggaccgctaaagcctcgaaacgtgtcaggtggggtccacctgcaaggcccccaccgcacgcacctggtgcggcacccacgacctggcccgcggggcccttcctcggtcagtgtggcttccgttaaacaagatcgcgcgggccccaccaacctccgtggctatttcggtttcacgtggattagaaacaagctttgtcttcccattggttattccactattattgtccttggcttatctgccaaatcgcgagtcaaatttcctgctcacctgtcgtatttggtacatttcatttttcctaatccttctcatcgaagttgcaagcatattgttcatctgtcaaattcgttctcctgttcattgatttgattggctaatgttctggcagtgcgaaggtttgctggactcaccgagagaacgccagaacggcagcatgtcgacactcccggtccagattaacccagctccgccgatcgaacattcgacggcagaagagcctgtgctagcaatcattatccctaacctgatcgatcagccgatcctctcaatccgtctcccggcccaggccgcccccctaatttggccgtatcccggtgcacgtcaaatcaagatcaagaacgacaaaagggggagctgcatccaccagcgacaggggaacaggttggaaaacaactgctttgttacaacatgcacgggagactatttagtaactgtagcactaacaccaaccgcaacagtctaatgggcatctcacgtacgtacagttcgatcgacaggcaaaaactgtgttcacagaagcaaagaagggaagaagaatcaaataggaagaagaagaactgaagaagcgaggatcgaggaagaaacagcgatcgcgatcggagaggcaactaaaagcgggaatgcgtgcgtaccttgatgggagtagtacccgttgtccaactggaaggccatgtgcaagaagcttcgacaccgcggtcaaagccgcagcgcaaaggagctagcccctgatcacttcgtcgatcgccaatggcggatcgattgagatatatatgatatatcccgcagacagagtggaaactttctccttttgcttcctagggacggacgacgaatcaggaggaggagaacaaagaaataattggaggaggtggaggcgagagagagaggggtgcgtccttatagataaagaaccggtgtttgatttggcggtgggtgtggtggccgctcgcgcgcgagaaagcgacaccgggggaatcggcgatggtgtatgtgtagtattggcggacgacgcagcagcaacgcacggtcgctacctgcaaaccagattgctatctaatctagctattatctcgctgctggtgaagtggtggcaatggacttaatggtgaggcaccacacgcactgttcggaaacagggaggccattggcacccatttgcagctgtgccttagctagctagcttgccctgcagattatattgtggctaatgaagtagcttgatttggccatgctttctgctcctgctagcaagatcaaactggcgatgattaatgttattagccgggagttgtctagctaggacagtgcgttgccttcggggttaattaggaggtgacaatgacatgtggggccctggacgggaggaaggccaattccagtacagtagcccggtactccatgtcactatttatcagggtcgttgtgagtggtttcgagcctcgaatatgtgatatagtacgcaggaaagagacggatcactggattgacgctttatgtggctctgccgcttcgcgccaccaattggttgttttcagaggcaagtggccagtttggtttggtgcttatccttttgcaactaaacaattacggagaccttaattccatggcctatctatacgactatactgtatctgctttacatattcaggggtttgtttaacgcatagagcgcctagctagtcacacgccacaatggccgtgcacaaaagcatcggttaatttccggcaatcgcatgcaaaggcaaaggaggttagggggaggaaagcgagcattaagccattaattcccctgtgattgttgtgccctgtttcgtgatcaagttgcaatgagacgggaatatgccgtgcactcgtgcaaccctcggcttttgcacctactcgagaacaattaagaaaaggcaagtgtctgtctggaggcactagtagatagcgtactcgttgcgtgcgcaggtgtaaagcgcaacggagaccaatctgggtgtgcgagcgagcggcagcgactgcgaggcagcatcaggatcgcagagttacaagttgcaaagttgcaaggcctttccgagctccggcggcttctctcggttcgcctgcgagtgcgaggcagctcatgcacgcgttgtgttccccctgtctcgagagggtgttgtactgggcctctagtgggcttctttaggctacaattcatttcgtcggcgaatttcctataggaataagtccactttgactcccttaaaagtggctcgaatgtaatccatgaccctaaaccgcaaaaccggatatctcgactccgaactattgaaaccggggcaatttgactcccttggtggtttggagggcggtttcgctgacgtggcgctgacgtggcaatgttgacttagtatgtgggttgacatggcgcttaggtggcatttgaattaaaaacgcatacgtgggacccgtttgtcattcacacatattaaaaattgtggggcccactgatcttcctcccttccctctttctttctctttctcttctcgccccttcggccggccgcgggggtcacatgacaggttgtagcggcggcgggcgggggcagagcggcggcagcgagctcaccttccacgacgaccgcgtcgacctgcctcgccacgacggcgggcgggggcagagcggcggcggcgagctcaccttccacgacgaccgagtcgacctgccgcgcgctggtcaccgcccaacgccccggcgctgtccatggcgcgtaccgcgcaggccaacggcgtgtggatgtggagctcacgggagagtccttcacctcactcgccgcatttcatgccctaggaggctgccgtctcggccccccatggccggaaccctccacgaccccaactccgggtcaggaggcgaaaaatggcgcccactcctactactactcccatggtcgcgccgttcgcccagtatgtagccgactcctcctccacattgcaatccgccgccgccgctctggcccccacccaccgccgttgtagcctattcccccgcggccggccgtaaggggagagaagagaaagagaaagaaagaggggaggaagaagaaagagagaggggatgacatgtggggcccacatgtcagtgggccctacaattttcaatatgtgtgaatgacaaacgggtcccacgtatacgtttttaattcaaatgccacttaagtgccacgtcaacccacatactaggtcaacattgccacgtcagcgccacgtcagcgaaaccaccctccaaaaccaccaagggagtcaaattgcaccggtttcaatagttcaggtgtcgagatattcggttttacggtttagggtcatgaattaaattcgggtcacttttaagggagtcaaagtggacttattcctttgctatatatatgccgttttgttttttttccttaaaaatcatacgttttattttgacatatgattttcactggatttcaattttttaccgatcaagctgtcaagttagacctaatttcatcctttactcatttactccctctgtttcataaaaaatcaacgtagtacacatctagtattaggttggttttttatggaacgaaatgagtacattgatatagtccagctacacgcatgtatgggttggtttgattattcaaaaaagtaacgattgaatgaaattacattacaatttaaatgtagttataatgtaattaaattatctttatatttgtaattgcatttgtgtgattttgagtgatatataactagtctctttcgttagagccgacatgcctaggtgtgtattcggttagactgataaattcagtctaggtattcgttctttagtagatttctgtcaatggaaattaaagcatgatcagctctgaacaatagaattaaagaccgagcaattcagtcttggtcatgaccagattggacaatagaccctatgagtgagaattgaggagcataggcattttgcaaaaatctagctataaacaaacatcagatcagctgggtgggtgcaggattcacaattccgatgaaaaccaatcgaatttcgcgaaatttcgaggtttcgacgaggctttttcctatttttctagtcaccaattgaaatttcggttatttcgctcggaatttcaccaaagccgactggttttcgcgagctaatcagtaaactcagagaatttgtattcaaattttggtttataaaatttattcggaatctaccgacttttcaccggattttgcgaaaaatcgtcattctgtgagagcccgaaacggaaggttatctcggaatcgtaaaccccatgtgggtggggccgtgaggagaggaatacagagagagttggctgtattctttaacttgaggttcccaacctcaccccctcgtttactatatatattgttgggctggtggtgggtctactatcaaatttctatttgttaaagtatttcagttaaccatgaaagtggccgaatggaccgaataaaaattgcttagatccagtgattgaattaggttttatttgaaatacaaaatgggtctaaagtttgtaagttaaattataaggggtttaaaatgttataatttctttgaaatataaacaaaatgatcaatccaaatattaaaaattattcacggtcacagacccacgattatttgaagttaagtaacaagttctaaaaaatttttagatctgaaaaagtatgccaaacaggataaagtcagcggcggagctagcgtgggggcgggggctcgagccccgctaccccgctggactccatggaaatatgagggaggaggggggggggaagagggagaggaagaagaaaatgggggagagagggggctggaggaggaatgaaagggttgagcccccctctcctccaaacctagctccgcctctggataaagtgaccaaatttctcggtccgagtcttttccgtttacgagttatgttccagtatgttttgcacagtacacgcctaccgatcgacgtgagctgtgtgcccgtgtctccggtcccttgtgctgttcgttcgaccgaacgacgtacgcgagctagctactagtatgccgttgtgccccgccggcacgccgccctctcgtgcactgcgaaaagcatctactacggagtacatggtacgcaggccacacacgcatgggccgtgatgcgcgcaggcagaagcgcgcgcgcggttgctaaatttcatgtacgtactccccggtggtccagtgggaattctggtcgatcgcgattgggtcgcgcctggacgcgcgacggctcgtgtcgtactgatcatagcgtatgtcaattgtccagattcatatcatagtttaaaattgctatattttgagatgaaggtagtacgtcatagcgcttgcgggcggcgtgccggtgcctagaacggaagaaaccaacaacgggcaacgtgcaacgagcggtagtgcgagaatcgcgtctgtgtctctcaggttttccgagtaacgacgcgattctcgcatgctagccacagggccacatcacaccatgatcgaccatgtacgtttcgatcgagcagtcaaagccggatcgtcggaggctcggagctagctagccatgtcacctactacctagctagctctcgatgcctatatgtacgtttcctccacgcagcaaggggtgaggtcccggccgttctgaatgtgcctgatatattcttccatctgcgccgtaactgcttactgcaatgccatcaaacagctctggccacgtaggctcacatgtactcgtgcaggtatgcataaacacacactggtaagcacgtacttgtacaagctagctagtagcctgggacgaatctaacatgaagacggtgatgactctaagcctccactattaacgcgagggccataggagtcgccacgaaacccctactaaacttttttacagaaaagctaggagagttgcagttttatctagtctgcttagtcctcctctcttcccttatacgtcactgggagtaactaactacgttagctccaccgtagctagctagctagcgcaatgtacagcggcaattatatacactgtgcatcccatcgatcgatcggtcgacaaaacgtgcagcgcgtttcctgtcgtccgtccgcccgcgcgcgctttctgagctgagccgagcagcagcagctagctagccatcgatcccattgaattcccgctaatgatggccgcgccatgcatctcgcgtctcgtctcgtgatgcggggcgtggttgcgccgcgcgcgcgcggatccgtcagatcgatcgctattgccgatgcccgccgcctggcacgctgtcgcgaaccctagacggctaccgcacacgtactccgtacgtagtacgcccaacgatcgatatatagcagccatgagcgcatagccatcagccaaagcccacaaggcaaacaccacacgcgcgacgtcagagagagctatagcgcttgcgcgcgcgacggcggcggcgacaagcgaaacggcgtggagagtgggagattgatcgatcgagcgagtggtaaaatgggaattagcggcgagaggaagggagccgcgaggcagtacaacaggtccaaggtgccgaggctgagatggaccgcggagctccaccgcagcttcgtgcgagccatcgactgccttggcggccaacaaagtaatgcctcgatcgatcgtcgatcagatcagtcacttcaattaattcctttctcctgctttcttgctgatctctgcttcgatctctctctggaacgggtgttgtttatccatttgtttgttcaccctcacttacgcgtgcgtacattcatgcgatctctgtcttccaatggcctcatgttctcaatggcgttgtttaactgcagaagcaactcctaagctcattcttcagctcatggatgtcagagggcttaccatatctcacgttaaaagtcacctacaggtcagcttcaattctcccgttcttcaggcgttattttgctatactagtcatcgaccatggaattataagaaagtacaccagaatttactgtttgtttaatttcgacagatgtacagaggcacacggcatggcattggacaaaacggtgaggctttgttaacttagttcttctctttcttgggaattgggattggattatgctttacaggagctgattatagtgtaataattcgacaatgttatacgtgcctaattattgtatactaattacattactctatctgaaacaagagatctaaacttcctgaaacttcccagttctggttggtgtaaattaggacctcactttgtggttgtggacttgtgggggctgtaattcttcagcacacatgtgaattgctaatggaaagctaaaccgactttattcttattcttttctcatgttaccatcagatatgcagccacagctacatctgaagcagcactcattcggcagtgatgagcagagccccaaggaattcatgtgcccacccataaaaaggttttgctgccgctagctttttctagctagctcccaatagtgctaagttaaaaagattatctttagtggcctaatctctttaaggcacaagcaccttttccatactcattctctcgctcttctctttggatgaacagggccaaggtagggacagaagcttcaggcaaatacagatgcatggaagggagcagtgacatgaggagtagtgctcctcctgcaggcacccggtacttcatcgatgattgtatgcgactgcaagaagtgtccatggataggaggagatcagatcaacacgatgctgcagctgccgctcgtgctcgtgctcctgctgctgctgcttcaagccttcatcaggcactgggattttgggtgcagggaagaagagaggagccctttatggtacaccaggtaaaaagaaaagctaaaagaaaccttagctagggcaagaacaaaaggcttatcaaaagaagatacatctagctctcttgtcttaactgctttgccgccactgatctttctcttcacatgtctctcactatctctagtcttttcttcctagctttatgcatattgctgcatggttggcgtaatatttttttcgtataattctcccagatgctagctagatttgctgatacctacctcctttccctcatcgtgcatactataacatgttcacttatatggaactggactagagtgtccaaagatatactaggacactttacctattaggacttgggagtcatatctctgattggcatcgatatgggcatgttcatgcacatcccagcaaaggtcaacaaactccagacgtgtccttcaaaaaagagagagagaagaaaagaacaggattaatagaatttatacatagtatagaaatactaggacagtgtggtacatacactgtcacagttgtactaggcaccagtatatataggacactgccacaaatggcccttgagagccctgttttctgataggaacacgacggtggtgtaactttgcctcagagcattcccttcagctcatcgacaatgataagccaaaagaagtggctttttgcagaactcggttgctatccttgcagttgcacgcagcagtttcatgatggacgatgatggcgcggtgcggacggaaagaacaagatcatgaaagctctctggtgcccctgctccggctgcaaattagtagcaaaagttgactagtgtcaaatattttgctttggaagcacattagctcgatctgtagctccttctgtgtgttacagtttcactgcactcgtatatatgggctatcaacctgcatatcagggaaataaatttgacagttgcagcaggacaaaacaaagcctgtcttgcttgaaatgcagttaaacatttagaacagtttgatatatcttcctaacctttgctgtgtcgttggattttgcagattagtaaacccaaagcacatcaactgaaccatatggtcaggaacatgaagatatcttgcaaggagaaccacgaaagtagattcttcatggtgagaagtgcaactagagatgaacaagtcaagaaacgcgcaccgccgctgtcgctagccgtcgaccagaaagctgcgaacgctatctcctcctggcccagcgaggccagctgcgttatctcgccgtcgccgaggaacttcagtactgactgctctgggcctccagggtgcagctttgttggccggagagttaacctggaactttccctgtcaatatgtggatcataatttagatcattaatattaataattatggtagtttttgttgatcagtccctcgtcatggtgctattactaatttctgctgatctcgtttctcgtgaaacaccctcgaagctgtgattgctgatcgtatggatcaaggtatcagagcaagttcaaacttataagctagctactcgacacacgatttacagacgagtatattacttcctccgtttcacaatataattcattctagcatttcccatattcatattgatgttaataaatttagataaatatatatgtctagattcattaacatcaatatgaatgtgagaaatgctagaatgatttacactgtgaaacggagggagtacacaatagcaggctacacggttcctaaacatgaactcgctccgtcccattttaagagcggacttgagttttcgtgtccaactttaattgtccatcttatttaaattttttttatgattagtaattttattgttattagattgtaaaatatgaatagtactttatgcgtgacttatgtttgacaaatttttttttatgattagtaattttattgttattagattgtaaaatatgaatagtactttatgcgtgacttatgtttgactttggcaaggcctctggtagaagtggctagaatttcaaacgcaaaacagtagcatttcagacatgtacccttttttcccctcatttgagctttgtgtgctagtttggccgcgtttagttcctcctccaattttttcttgacgtatacggacgcacatttgaagtattaaacatagactaacaacaaaacaaattacagattctgcctgtaaactacgagacgaatttatcaagcctaattaatccatcattagcaaatgtttactgtagcaccatattttcaaatcattgcgtaattaggcacaaaagattcgtctcgcaatttacatgcaagttgtgtaattgtttttttttcatccacatttaatgctccatgcatgtgtccagacatttgttgtgacagaatttttagaagtttgaagggaactaaacacaacctttgtccattatctttttcaaaaaaaaaaaattcccttttttcaattcacctccttaaccctagttagacacatcaaggaatgcaaactttgggccctcatgaattcaaatttttcacaagatctttgcaacataccacaaatacagtttaattcatacatgaactatgaaaggtctgcacattttaactagatatagtggaaatgaaatgagggcggcctataagaaaaatcacccattaccagtttgccaccgactttgacagctcctgcatctgcaggaatgtgctgaacaaagaagattcctcctgtcctgaaattgttattccttgtctaaaggcattcagcatatataaaagaatcaggtgataattttgaggttcgcaagtgtatatataaatggaatttcagagtagcatactagcatcagtagtgatagctcacatgttgcacagtatattatgtgtcaggagatcaaacagtagtagcttaaattcaggcttgtatttataagcaatatgtactcatgggtatactgtagtagagctaccatgtgcttttctttcttctccctcgctctgctggaaggaacacaaacagaatgattaaaacatagtcagctcatgtgcgtgcgtgtgttgtctgtttcgagttgttgtttctcaaaagcctaagagaagcaaacatgtcacgtagaccactgatttgctggttaaaagattgacaaatacaacactattctggtcgccaaaagtaaagaaaacatctaaaaaggtggttaggaatatatactcgtcagtttctgtgcttacctttgatactgcgaatggcatcatcttttgtcaaaatcaaaccatttaccacttacccaaaagtttcagactgacagcatctcatctcaagtacacattattaccatgatgagcaccacagtagattgcagggaaaaagtacggtggacgaaacaaaagccatctcagtagctgcttcttcagcaacatgcatgcttttgtctgaactggccataatagataaagttcagaaaacagtagaacaccataatagccagcgacctcatggttttgacatcgcaacatgcaaaaataacgacaagaagtaccctccaagagctgcatgaacgaactctgcagggctgcaacttatacactgacctacccaaaaccagccaaacagcagttggtggggactacagatgatatgatgcgtagaacagcacgcaaccatggaagggtttgatgtttgttaaaccatctcgaccatagaagattcaagctgccgcagagttgtaaacttgaaatgagcagactgatcaaattgtatcatctgtattatgcccatcacggtgccatctgattgatatcaaccaaggaggcatcacttcttctttgccgcttttgcatcaggcaccaaagccttgacacagagacgaggcttagtcgagatgagttcagacgggagaacggacaccccagccactgaagatcccagggataccccagaaatagggagcatctccactagtactgccacctggacattagaatatatcatttattgtgcaaaacagtatgcaagatttatgcacaacagtgcaaagcaatttccaaaaggccatagatctaaaacttaagtttttctctgtatttaaagtaaaagaacagagaatataattgcgtattcaaacatgatagtgcagaagttatctaaaagtgtaagttgtcctctacgcttcaaagtaaaagagcagataagtatacatagaattcaactttacatagttattatgactctggataaatggttccaactttttatctcactagtaaattagtttgtttcattttactctcatcactcctcgtttatattattgaaaagtgaattataacatttggaacccatggtagaagccaaaaaacacgtaaagttgtgaactatcagaaaacctagttggccgttgggtttcaaagttcaaacaaaaagacgtggtgaaagtagaggtatacttagcggaccaaaaagattattattgaacaatcttgatgatgacaactttgatgaaaaatattgacttactgacatctgctgcatccaaaagtaaacgtgctgaaattgcaggatgtcagataatcacgtgtcaatactgtccaaagactcaaaaacttatctcagttgtcatcatgatcgagtggaaaataacacgctaacttcactagtcagcattgataactttgttgtttttccaatttggtgtctttagattatggttctttaaatcctccatgttagctggcaagtaactctgctaaagtattgagaggttcattcaaggaaccgattttacctcaggagatctgagatccacaattgagttctcagcaactgatttgacggcaccagcaacgaccttgaagcattggtccctgtccattaaagtttgttgttttgaaccttcattgccattcttctgccctttcatctctgtttcatcaatgcctcttctattatacccaactgcgaactttaccataggttaacattatatgaaatattaacagttgatatgtttccacgagataatgctgccaatgctaaagcccatgccattttcaagatagatacaattataaaccgttcaaagcatgaagctatttcaatgggtaatgattaggataacagaaatgcgtaattttgttacttgtgcatagcattacagtaccattttagagaactaaaccaaatacaagaaatatttttaactcaacacatgcaatggcaagagaactggatatgagatctgcaatggcaaatatatatcacaaaagaactggacaagagaaatccagctatagaactggattgattggattccatcaacggtttaatccaatcagtaaatgtaagcagtgcaatatgctgtgtaccttgataggctcatcttggtcttccttactctttacaaagtcaagaaataactttgacacagtagtatgtagttctgcttctgacagaacacatgtttcctgaataggaaatatgcgatgacaccatctgcccattgaaggttgaatagtttcaaatcagaaattttccagtgcaactagagtcaatcatggcatacggaattggttggcagaaagacgcactgctgccatatttcttgaacaaatgaatggtaataggttgcataaatcaaatcgctatgatgcaaatctagaatagaaaaggacaaaatgataataatattatcttcttctgctttcttagtgatctggtctacactgcacatcattcacacattcagcatattagcagaaagaagcaagcaagcgtaacatattgcgcagtcactaaacggtaccgaaattaacaagttttgaagttgaaaactgaatcaaggttgacaaacttaactatactcttttaaaagggagtagtggtggtggtgagtggtgaatctgctagtaaaagaaattatgctagacaaagcgtgctctagaaatagtatgttgtaatatgtgggatcgcttattacttttcggcacttccatatgacagctgaagcctgtagttaataaatcaactttgttaacagcattttgagagaatgagtgtctaatgaagttaagaacttactgtggagatttaagcttgccagaatgcagtgaatgaaacatttgtgtaagcatttgaacaacacgaaggcctccgctaggaaacgaaaagaaaagcaagccacttcttgacagtttaaccagtgagagatttgaagtgtcgtcaacatttttacttgttttggagtgaggtgaaactgagtctttttctacactgcctgttacagaaccagaaaagacacagcgttagaaaaaagacaggtaaccaaaccatccaaaatcacaccctttagattgaatgaatgaatgtggctaataagttatgaaatacaattgatgctaaccagttgtttctgaagcatcacccttctcatatgttactgcatctcctgaattttcaatatctggtgtctcggaacatattttccttttctttgctgaaacttccgtatcacttggttctgacttttcagaactatagctgtttgcatgaccaatggactggcgaaaaacagtagcacacccagtatatttcagaatagagtgtaaggaagatgaagtggaaaatggttgcccaaagtatgaataaactaccacaatcaaaggtaaatactacaacttaaagttgctctatacttgcaagatattcagatggtagcaaatgtgctgtaacattaagttttatgtgctagaattatccattgcagaagaacaaccaaagaataaggagcaagacctacattttcaagaatggaaatggcttcctttgttgcgcttttctcacgttctgtaagaagatgatgatcacatcaaatttttgcagtagtgaatagaaattaagtgtatatgtagaatttagctatatttaagatttgttttaataaatatctttgtaagatctgtcacagggtagcagctggattctaaaataacccaatagtaggaataagatcaaaacagggataaaatgtaggataacccagatcactcaagaccagcagaactttccagaataaccgcaacctaagtggtttggctgatgcttcagcacattacatacctaagaacactcctggctacacaagcggttacagattttattcaatccttgactcagtgagcatgttacaatttccagaatgcacatacagcagaccaaacatcattacttatttttttaagacaatacacctttggtctctcaactctttccatggtttaagttttcacccccaactccaaatcgtttgaaatatgtcgataaacttttgaaagcatgcagatatcccttgcaaaaaaaaaagcatcagttttgccatatgtctagttagtgtgtatttggcctacttgtcagccccctctcagcttcatcttctagctggactacatgaggactgaggacactggcaagtatagcgaagttttttcttctcaccatatttttttccttttctcctatactgcattatgacaaataaaagtacaatagttgcaggtgatccaccacaaatttataaactatgccaacattaaacagttgtaaatttgatttacttttcagcacatacaactacagttcatcaactactaactgacaagtcaacagaagaagtgtctggcagggtcgagtatacaaccattgggtaagctaaccgatatccatacaacaatgtactaaaaactcatacaccaaagtcgaagggtaacaaaaaggtagttagttctgcgcctccaatatccacatctaatgatctaaatgctactagtaccttttagcgtcacaggggtcactcgaatgaatccactaacaaatccaccacctgaagtatctagtcttcccctacgtatccatatccaacaaaatagtttttgctaaaatagcacgagtaagtctaaacatggatgaggggcacgcactgatggggcaggtgatgaggaagccggagtgggagcggaggaggagggagcccgacgcgcggtagtcgtagcgcgggaggtttatcaccgccgcgtgctgctcccatggctgcagcggtcggtcgctggctgcggcggcgggggcgggggcggcggctggtggctcagttggaggctcgcgggccggcggtggggtttcgatttcgggcttcggctccggttcctccgccgccgccgccatggagaagcgccgaggatttctctctctctcttcggtcgcactttgggcggcgccgaggtccgaggagggtttggggtttgcagacgtattctgttaacctgttaactcgatccgaaggcgtatttctgttggttcccgtgaactcgaacagaaagcgtattctcttcctttgcgtaaactctcctcacgcgcattgcttataggatcaaaataatcgattagagttacacatggaaaagtctaggaccggaatctgatatagtcacggagcttttcttactaagttgatttcagcagctgccaagtactccatatgtctaaattcattaatacctatatgtatgtgggaatactagaaagtcttacattgtgaaacggataagtacctgagatgatgctagtagatttgcgatggccggtctattcatcttgtttatgaaaagatacatctgggtccaggtatgaaaaaacgtacgcataattggaagactatagacaccaaccttacaatcatgattattgaattattggtatatccatgtcctgtcctgaaagaggctatttttgaacaatttccgtgtttgtgcagatacgatatgcacactgttgtgtgtttagggtgctacttacctttatttcagtgaagcatacacaacaaccacacgatccgactcatgtttttgaaaccttacaaatatataaagagattgatgttgtttatcgttgggtcgatgaagatgccgactgatgtatattaaggagaagggagaaaactttacgaacataccctctctagagggagcgcaaatacagtgcgtcggtacatcgcctttacaacattaagaaattacaataggttgaaatctctctgaaactggtgttgtggcaatactcaacaaactaaagagcctttgattttcaagtttcccactcatcacacatgattgcacacaactaagggaccgacgaggttgttccatcgaatacccacatgttgcgctctttctagatctaccaagttacgaggatgactccggcgtcgaacgtcccacggtcgaccttggaaacggagtgctaggcagtaagccaccaactgggaaagtccgaagacgatggagaacaggagagactcaaacgagtccgaatctgtacccaaacctgttgcgagaagggttgagaaggggcaaccctggaagatgtgttagtatgactggccatcattggagcataggtgacaaattggcgcgagcttccaacctcgccgctacaggttgtcagttgttaaacaagcattgcggacggcaagaaacatgaataacttgtatctcgccggcgcgcgggatttccaaatgatcttgccgagagggcttgtttaacatatcgctaaaatttagcgttaacaggtttcacaaggtgcaaacatatagtgaaatcaaacttcacgaataacaacacaaatatgaaaaatatatgaactatgaatccggcattggccatggacgattaagctcgagattaagatcactttcctatagatactaggaataaaaacttttcctgagatcacattgagtagtaattcaacctgataaacaaattgcactcagcttcgtgggagaggcaggaactccacattgagtagtagttcaacctggcaaataaattgcactcagcttcgtgggaaggatatgcatccgataccgagatctaacgattagttgaagaatcggcgtgtctgccaagattgaagtgcgtgatgtatatgaaccgacccatatcaagatctaacgattggtcggttagggatggagttaccgtcaccactatgttttattttttaaagtgtatatagtattagtataaatatgattctcaacgaaaagattagcatttttttgtccattaatttgcaggacaccaaatatgaacagttacaaactattaattgagatcagagttgctagctagatactacgaataaaaacttctccaggcgcacaccatgttgagtagtaattcagcctgaaattttactcagcgtaaataatccaatctggcggatagcttcggcgcgaatctctgaagcatcggcttacccgcgacagctgcgccggacaggactccgccgaggatgccggcgacgatcatcgaccttgggccggacgcgatgcggtagagcgccccggcgctggcccccgcggcgacggtgttgacccagtcgtcggcgccgtcgcgctggtcgcggacgaagctctcggtcccggcgaagagcatcgcgacgatgccgaaccggttgccgaaggcgcggccgacggagccgctctggttgagggcgcggttgatgcgcagcttggcggactccccgcgctcggcctcggcggcggcgcggcggaggcccacgagcgcgccggacgtggcgccggcgaggtagctgacgccggtgtagaacgtgaggttctcgccccaggtgcgggtctgccggaacttgtcctcctcgaagaggcactccggcgaggtgggcaggtcgtagagcgcgcggtacgaggtggggaaggcgaggccctcggggcgatccggcgagtagaagcggcgcccttccgtgggctcctgctgggcgtcaacggcgcgggacatggctggctgatctagggttgccgtgggctgctgctgccgctgcgtgccttctgggtttctggacgatcggttttggttgccgccgccgtgtgccgggggtttaagagaggggagtggtctccgatctgcagtctgcgccttcgccgtgtcgccgaagaaaagggggagggcggagccgtgcgagatgcggactcgaaacccagtaggaaaaggaaccacaacgcgacgccacggttccgacttccgattgagaaaagagggtgtgggccggtgaggtgggccgtgggtgtcggccttcaagtaagtggtctgccagcgcggcctccctccgcctcctctcggcctccacacaactgtgcacgcaaggggctaggcggaataagtccagtaggactccctcaaaatataagtccagtttatttgaattccttaatcgcaaagatatttgaaactggctccgtcgtggaataagagaacatagtatttgcaaacgaaaaacagtttgtgaataaaatttttatacacgtgtttttagcgatctaaaagtaaagactgaaaaataaacttcgatgaaaaaaaacccaaaaatcaactccaaattgagagttgaaaatttaaattttggctgataagcataagcaaaagaaaaagatgaggctgtggtgtaatttgacttcatagattattgtaagagtggttttcgctgaggtggcaggttaacttgtctgctttcggccagctattgggcccgccaccgcgtcccctttctcaaatgggctcgactttataacaggccgggccgtgcaagcgccacgtagctgcacaaacaaggccgtatcgcgtcgtgtcaagctcgatctagagttgcaagacccccaaacccccgtgacctctccgccgcagccgcaacagcaatggaggcgcaggcggacgccggcggcgacgacctcgccgccatgcgggagcagtgccggagcctggaggaggccatcggcttccgccgggagacgcagatgggcctcgtcgcatcgctccagcgcctcgtccccgacctcgtcccctccctcgaccgctcgctccgcatcatcgccgccttcaacgaccgccccttcgtccccaccccgaaccccgacggcggccacggtaagagccccgccgccctcaagccccaccaccgccgcgccctccctgacccggcgcgctccacccgccgcaagacctcgcccggatcctcccctgcctccgtcgccgctgcccccggcggcctcgacgccgtgcgcaccatggtcgccgtgtgcctcctggagctcgtccccttcgccgagatcgacgccgccgcgctcgcccgccgcctgcaggcggagagctcatccgccagcgaggccgagcggactgctctcgctgacctagccgccgaactcggcggctcggcggcctccgctgtagtcctcgccctccgccgcatagccgaggacaccggcggtgtgcagatcgaggaggccatgattgggggcaagtcgatgacgatggtctgggccatcgaccggaacaagctcctcaaggagctgccagaatccgctactttgccgctactccaacctcctccagccccccagatgcccccctctgagaccgatgccggcagcgcaatgataccaagaacaccgcagcagcagcagccgcagccggatatgtggccgcattcgatgcctccgatattcccacggccaaggggcatgacgatgcaggggatgcagagggtgcccggcgtgccaccagggttgatgccgctgcagcggccattcatgggaccagctggagttatcacaatgggtgggggtgtggggcctagccctaaccagcagaagcagaagagcgaggaggacgaacttaaggatcttgagttgctgctgaacaaaaagacatatagagagaagcagaacaccaagaccggggaggaacttttagatctcattcaccggcccacggcgaaggagacggctgtggcagcgaaggtctgttttcccttcacctatgctagtggttttgttgtttgcactgtgtagttagtgatgctttgggttgctgatttgttattgatgtagtctcacactgttagtcctgtagtagtaaatgagctggcagtggcggacctaggatttgaacccagggtaggcctagcaaaaaaaaaaatctgaatgcaatacaatatgattcgatataaaatgtggtaaacgatacggtatataactctaaatggttcaatacaagtagaaaataacaaataagtttgaatcttacctaaatggtccaaagttggcatggaccttttagaatgtaccctcttctagccgcatcttgatcgttggcatcaaaacttgaaatagaagcccttaagcctggatcatgttcaatatcatcaacatcataaagcagcggcggttcttcttcagtttcaattgacccctgttgagttatgtgtcttagtgaatatgtatatgtttagggactaaatgtaaagaccattgcatacaaggagatgggggacaccaggtccaaatcatccaaaatttacagcatggtatcagagcaggacgatcctgcttgattttcttgcaatccctagcaacacgagttaatgtggaatgctggtttgcagactgcagtgaatcatggtccagaggtagtcctgaagagatgaggttgatccatgtttttttttggtgattagttgcatctggtttgctgcctgctgtctgtaagagtacggtatgttttttgccaaggaaatccatccaagccttgccttgtgatttcgctcctggacttgcattttcttcgttgctgtctcagcctctcaggtggcgttgctgctgttttctttgccgtgtgtgctgtcgagagttgcagcagacctgtgtagttgtgtgaccttgtataagttcagtcttgataaatctatatagaagtttgtgttttgattgggttccaacctgctcactaagaaatgagtgagccaactacagcaggggcggctgggcgctggcggcgtcgggcaggacgccgggaccgcgggagccgggagctcgggaggccgctgggcaacggccggacgtgagacggagagggcgcggccagccggccaggggcagagtcgcggagatggcgcggccgcgggggcgccggcgcggcgcgcgaaggcagcggcgttgccgccacggatgggcgtgcgcctggcgtgagccgggaggccgccgaccgacggacgcggcgggaggagcggcggcgtgagtagcggcctcaccggacggtgggagcgccggagttgcgccggcctcgcggctcgagggagcgctgtcgccgttggtcggtcgggaggggagagtgcacaggagagaacagagaagagacttagggttttttttgtttgttgggccaggcttttttcatgggccaagaaaaaataaatacctgatcttctctaggccaaattctagggtagtcctgggcctacctggactaccctctgggcccgcccctgtgagctggtctacttatgcattgctgttgttaaaactatcataggacgcataacagctagttgtcggaggcacactgctataatgaacggtttatcataaattgcttagattctgcactgaattagtgcgactgtcaaagtaaaactgttaaatgttgtttgacccatctgcattgcctatatattgtcaacctctcgacacttataacttccactcttccagttcttacacatttaattgtaataatatggttgacatgaaaatcattcatcttgttttgttaatatggttttatgttcatgcagtttaaaacaaaaggtggttcccagctgaaggaatattgtaccaacttaactaaagaagattgccgacgccaaagtggatcttttgttgcctgtgataaggtctgtggtgatagtgtcctgcaccccttttcacaatgtgtacttccgcacgttacattttgtctacttttaacaacagtagagcaaaacctgttgtgtttgattcaatcacttaaaatgatgtgcctatccacaatcatggcctctttgacgatgaaattatcctgttaacatattaggccttatttctggttacttgaatttattccaatcaaaatcttcacatttttttccttgaatacttgaatagcttttgttatctggtcttttagctgttcatggtaacaactaatctggaagtaactgtttatatttcattctgagcaggtccatttccgccgtattattgctcctcatactgatacaaacctaggagattgttcttttctcgacacttgccgtcacacaaaggtgactatggcatatacacccttgtattttcctctattatgatgtgtgtttttgtatcttacatatatcctataatctgtagacctgcaagtatgtccactacgagcttgaccaaacaccagatatacctccaatgatggctggtgctcttgcacccccaaggcaaataaggctccagagagctgaatattgttcagaagtagagcttggagaagctcaatggataaactgtgacatccgaaacttcagaatggatatcttaggacagtttggagtaattatggccgatcccccttgggatattcatatggaattgccatatggcacaatggctgatgatgaaatgaggacccttaatgtccctgctttacaaactgatggattaattttcttatgggtcactggtcgtgcaatggaacttggtcgggagtggtaagtttccagaactatatttgattagttgtcttcagcagtaccaacaggttaattaataattgcgtagcattttagcattgttcatatcctaatgccccttactgagtgcagatcatttagatatcccacacttcatactcaaataactcgataggatatagatgctactgtaataacaagttatgtcatattcattcctttactgaattttgtttttacttaatgtctactgccaagtgtaaactttccctgaatgaactttcagcctgaacaattttcttactgacaactatgttgcttgtttttaccattcttcagtttggagctctggggttacaaacgtgtggaggaaattatttgggtgaagaccaatcaacttcaacgtattattcgaactggacgcactggtcattggttgaatcatagtaaagagcattgccttgttggaataaaaggaaaccctttagtcaacaggaacattgacactgatgttattgttgctgaagtccgtgaaacaagcagaaaacctgatgaggtacactcgcttctttgattcatggttctatactcgccgcaaaagcattgtgttttttcttataaaaaaattctaactatagtttataatgtttttcttccctactgtaataataaacatgctcatttcaaggctatactcctacattctttaaatttgttttgctgtgcagatgtaccccatgctagaaagaataagcccaaggacaaggaagctggaactgtttgcaagaatgcataatgcacatgctgggtatgctcctgctgtgtattcttcttcccctagattattttgtcctcaaactagatgctaaccatttacgtaccatttaccctttttctttgtttgctcagatggctttctctgggtaaccagttaaatggagtaaggcttgttgatgaagggttgagagcacggtacaaggctgcctatcctgattcagaggtgcagccaccatcaccgcccagagcaagcgcccctatagatggtgatcaaggcacatcacagaaacctactgtatcagacggcgagaggcctgcctgatgtgaagcagtcggcaccttactttgaggactatgacattgaggaatcatcgtgcaagaatacaaacactttggacgacataagtattttatcactcgtcagctttaactccggttgtaaaattagttaagtcggtttacttagaagttactccagttgtaaaattagtaagtcgattgtttttggtcgcttgaggaatgcaggaggagggaagaattgttgggttttgtaatgttggcagacatccatcttgataatggaacgcgtgagccattactgatcttgttaacatgtcagcacgggcaaatcctgaatgcaacatttgttcccgtcctggaaaaacagcatgtacgttaactcatgctgggatggctaattagcgcaagtgcatcgccacacttttctttagtattttccgacgaaactttttaactcaaatactacaactttttaactccagagcaacattacagtacacaaggtttttctaaaaggttgacataattagagtacaaaactttaacgacagtatcatgtttgctgctaagaatggatttcaggttgacataattagagcacaaaactttaacgaaagtactgcttcatgtttgccgctaagaatgtatttcttgcgtgattcatgaccagtgactatgttaacatgactagagtagagaataagctcaaggcgctgctagatttgatgcttggtcgctcaaggcgctgccaagctgatgcttggtcaggcctcatcctcatcctcggggccttccttcagcgccttgatgaatgcgtccagagattactaacaagaacaataatatattgtttagggtgttaatgaagtatttacctaatgaatcaattatatgttgttcttgatgaaaaaaaaaactagcctcgatgaaaagttgcaaagatcagcgctgaattcatcaatgttcatctcatcaatgataggcattttatcaagcgttgacaaaatgacagtcaaaccttctttcttgtaagaaagtacacatgttagaacacggttggatcaaaggtaactctcaattcctatatttcttctttcttgtaagaaagtacacatcttggaacacgattggatcaaagataactctcaattcctatgtttacttagcatcatgaaacaccggtggaagaccggtgacatatagatcttataagaactcatccctttcaccttgcacgaaagtgcacttataaactttccattttagacaacaccttattgagagctgtcgtaacctttctaatcacaacatacccaaatcaaaacatgcacggcagaaggcttgagagcctttgtaatgtgccataaggtacatgactaaatgaattaaagtggcgggaattaaataaaatcttatttcagcccattactttcgtaactggcccgtcctgtttagcgtgagcgtggcctgtctaccggcaatgacccgacgcagggcgaactaagcgtggcccagttgtattctgcggcccaaagaccacgaggcccaatagcggtggtggccctacgtggggctgatatggtccatccgatttgatggacggctcggatcagtcccgtgccgatgaaatcgccggtcggaggggggaggggttcgaaaaccctaaccctaatcccccttctcccctactctcctgatccaatctctggtgatgcgagagagtggacaacgacgatggtggtgacgacagtccgtcgaggtggagcacgcacgcagcagcgatagcgagtggcaccggcttcaccggctgggaggcgtgcctgagggcagcgccaagccaagccacagcgtcaacagtccaatgaagcgggcgcgcaagtagaaacgggtgccgagataggctgggcttcgacggcggggggtgggggcatagtaaaaaaagccggactggtaagtgacccggccgacctctcggttcagcggtctgccggtctgaccggtgacccgggcggtcgaactgcggttcacaaactacatgtatattacatattcactcatgtaatggctagctctttgctcttgtaactcttggacccgggttcgaatcccatgtagtgcaccatttcttgctatttttgccaaaaaaaagaccaccagctgcaccaaatgggcctttaaacagcccattgtggcccattagtatggctagccggttcaaccagtgccggtttagtgtccggttcgccgaaaaccggccggttcaggcgggcaaaaataagaccaacagctgcaccaaatgggcctttaaacatcccattgtggtccattagtatggctagccggttcaaccagtgccggtttagtgtccggttcgccgaaaaccggccggttcaggcggttcagagcggttcgattgcatgtctggtctttaaaggaaaccgaaccgtggtcacctttggttctggttttttccgatctaaccgccaggaactcctagaaggcgcgcaaacggggagcccaacgcaaccgcgaggaggcgaaggtgcatgtccggtttttaaaggaaactgaaccgtggtcacctctggttctggttttttctggtctaatcgccaggaactcctagaaggcgcgcacacgggaagcccaatgcgaccacgaggaggcgaaggtgtggcagtgtcgcttcccggtgagacccacacaacggtggggtttcccggtagaattagggctccaaatccggtaagaatatgaactcaagcctaattttcttaatttgatttggatttggatttgattcagattttggggtactcttcaatttggggatttcgggaaaattgaaaccagatgggattgtcaggtgctattgggctgcaccttgggccgtgccagctattctccaagttgagcccaagtaagcccaaggagaggggacatatacaaaggcaacggcgacacttgggagggaaggaacataactagcaatcggcggcttcggctacagcagcggcaacgacttggttcggttgaaccttgttgatctctattcctctcccaccctctctcttgttactcttcactaatacttctagaagcttccggaatctagtagcttgcatcctttacatcttctcatcctgtccctattgtattttcctgagattgcattgaattttagttgctcttgagattattgagttgagaagaagaggttgctaacactcctcttctacgcccatgctgctttctcccatcggtcgagcaccctggaaagatatgggggaagagagtggagagggagcaaagggaagtagaagatgtggttacactgatatgtgggatccatctgttcttttttaatttttgtctttggtgccacgtccccatcatgtcatgtaaaatgcttacaatactgatttgggactagggatgacaatttcccccgcggggccgggtcccctgcggggacccgaccctacgggggcaggggccatttctgacccgtgggtgagtcgggggcagggcaccgcatttgggcggggagcggacggagaggatattgaacccgggggatatattacccctcgaaatgtagcccatagaaggcccaacaagcccaacttagcaaaatactgtgatatatgagcaaaaactaaacatgctaaccctaccttatcctctcccgtccatcccatgcagccacacaggcacggaggtggcacactcctctcgcctcgcttttcccttctagatctcgccgctctctctccgtctcttgcggtctcgccgtcgtcagtcgccctcttccctcccctccgacctcctgtcctctccagtctcccctttccctcccatctccccacggtagcgcgcaggacgacgcacgggcggcacgcggggaggcgcacaggcgggcgtggcgagggatgcggcacggcgcataggcgcgacggctggcaaggggacaggcgcggcgagcgggcgacacaggtgacaggcgaggtgaaacacaccgagaggtatttcactaaattggtgaaatgttgtttgtttattgagtgaattgttgtgtcaaagtatttgtgaactttgtggtcatgcatgcattcagatcatggacggaacgatgtatcatggaaatatttgtgttcttgcttgattctatatgatagtcttgaaaaaaaaaatttctgattggatgaaaatactacccaatacggggccctggtcgggttgtgggccggggggtgtcgggggcggggcttaatttgcccccgcatctccactcgtgccaggatcggggacggggccgttctagtctaacccgtccctgccccgccccgttgccatgtctatttgggactatatttctacggttattgcggcattgggatgtaattcgaacggcgtcaagttgagcgaccttgagtgaacttattccttctcaaaattggggagcttgcgactctggccattctgctcacgcagtcacgctaggcccaaggcccaaaaacactatccagtgggctcaaactagaggcttctcttctacccagggtttagcgtcggatccagtctccaccggagcgcggggcggcggattccaaggcggcgatggagttctgcccggggtgcgggatgctgctgcagatccagccggccaccggcgggaaccgcctgcgcttctactgccccacctgcccctacgtctgccccgtcaaaaacaaggcacgcctcttcttagctctctccccccctatcacttcgcctccctacttcgtctgcgactttgcgtattgctgccgcggcctccgcgtttgattgatgcctttcgcagatcgtgaagaaggcgagactagtgaagaaggaggtggagcccatcttcagcgacagcgacgccatgaagaatgcccctaagaccaccagtgagcccttcgcccttaactttcttgttaagacaatacattgggattaattgttgtcttaactttttttgttgagacaattcgttgggaataattgaacttagcttctccattatactgtgtatcatctgtatgtcatgaattgttgattatcttgccatttaaatttaggtgaaaaatcattgctattgccacaccaatgggaaattttgttctaaatgtacttgctgatttttgtactagtaattgtttttttttcttttcttccatccattgaaatgtatagctgggtaatctagccgcagtccaacataaacgaaagtgttttatgcacatattctgtcttctgagtttgtttagcttatgtcgatacaggagacatgattgcttgttcataaaaaaaaaaaagagatgaaaaatatactaaaataaaaggctcaaatttacttcacagccaagcagtgctggtttgaagcataataaattaatatacttcttaagctatgataaaatccaaatagcaccagatttcgtccaagtaccttcaagaaacttgctactcctatgtatttcgttgtttaaagtcatcattgagatgggaatgttcattaggggatgtctggcacatatttattaggaaaccagatgattgaatagttatgggtgcttctagttttgatacattgttaccatggccgtggtatactatcatgcatgtgcgtgcttagttccttgtaaaaaaaaggagtaaaatggtggaccatcagtgctttcttttttcaagcatctattctgtacactttcaacacaagataagattgcttgttgtgttgacagaataagcttgtatcttttgatagtggaaggacaaaaaaaaagcatttttcaaagctgtacctgaatttatttagctgttctgattataatggcatgtctccaacccaacgcaaataagttcaatattttaacaatttccacgtaaagaaccctgacctaacatatggttaaacattttaataaagttctaatggttgtctgaattagtgaccctagaggtgacattctgccatacataatcctaaatacattcaatgattttgattttcagctacatgcccaaggtgccaaaatggagaagcatactacaggcagatgcagattcgatcagctgatgagccaatgtctacattttacaagtgttgcagagaagaatgccaatttgattggagggaggactgactttagtaatatttcttgtttaatgtgtgtggatatttttcctgctaaaactatgtaatcatatgaaaccttttgtaatcagctcatgccgcagcaaagagccaaagaaaacttacacatgggaaaccaacgtaccacaaaatatcgtgatattttggtctaggcgtgtgccaaagtcccaacctatcgtggtgttttgtctaagaatccgaactgaagactggtccattaaggcattaacccaaaaaagaaaaggcttctcacaccctcagaagttagattttggtctttgttgccttgttggtgttagagatgtagattgtcctggtctagaacacgagagcatgaataaacgagaagattgcggccataaggcctcccgctctgccgaatgatctacttaggttatcatcaacaacagcattttgcagcaattacggcatcaaacattcattaacaccatcaaaatatcatgctgtaaactcttgccaaacggcttaataattaccaacaagctggctttacagcattgcagactacagcaacgtttaaactaaaaattattaacgttgctcaattatgtatgaaacacaagaaatgttgaaccaggaagctggaacatgaacatctgaacattctttcttatgatgttcagatgaaacacaaaacttgactttatacatcatcatttatctggtaaccacttcttccgggctccttccaaagcttcttcccgcatccttgttaattcacgaaaccattgctcgtactgagcttcaatcagaccaagctctccatttaacacatctcgattttcagtaattgaaaccgatgcaccgatcaccaactccgagtgatgtgatgcttgatccatctgaaagattgcaaaattacttgaaccattacttaacggatgtctgcagcccagtttatcggttcctttgtacgcaccacattccagtgtcctgtattcgtcaacgccatactcactaagacttttggaactcccatcaagctgaacagaaatgtctgacccttcagagctatttggtcctcctagattggttgcattcaagagagaatcaatataatcacttggtgatgcattggcttctttcgaatgcatcataccttcaactagtacataatcatgtgtcaactccgatggatgctgctgggaagtaattacgtgctcactttcacccattttagattcgctggaagtactcattactgcatcattcatcagctgctgaccagggacaagattcactatcaaaagatcaataaaatcagcaatgaaagtaacatcacagtctgctaactccaactgctcgaccatttcagcagcaacagacatagctgtatcagaatccaagtagaagagaaaatgaatgttccttgcatgtcctgcaaaaataaaaatgatatcgtatcacgagaacacaaaagataaattcaattaacaatagaaagtcgtaccacacaaatcggcaattcgcaaaaccagtgatactgaattgtcatcaagtttctcgcctgttagctttagctctgtgtttttgttagttcgcgtgaactccaacacagatctatgtggaccaccaagatcatttctcttgcatgtgctagtacacatagattcattggtgtcaacatccatggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69193 - DNA, 2341 bp, Oryza sativa
caaacttaactgatgcagcactaagtatgaaaaaaaacataatatctagacaatcaagccattgactgagttttcagggtggtagatgtctaagctaatctaatctagcaacgcgatttagccgatactggcagaaaccctaaaacgagaagcagccgatagagctaaattgagatgctaggactagattaacatagacatatgataaataggtaggcaaatatatcatccaaaccagagtaatccaagaggtcgaatgtcctgatgcagtcttgaacgacgccgacgtagacgatacaattgcctggaccggcggagcattggacttaccccttcgctggagatcgaacaccgatgcaaccccgcgtcaggtgccaagtcccgccggacaataaaataaagtagaaaaggtaaaatgtggcgatgcgccgaattgtatttattgtgaagatagattacatagaccccgggtgtacatatttatacccaggggttgatataagtccttatcggacaagaaagaaactaacctaaagataaaaggaaaatataatgtccttatcggacactaaacacactttcctaaagataaaaggaaactaacaaactattcctaattaatagataaactaccatgccgcatcctctttaaactcggtcacttagggataagctttctttagtagattgatttccttaaccgaatatagcaggaatccaactattggtgacttgataactcccatcggctaattccgagatgctgcagccaataatgattctaagccgatgatgtttttgccgattaccaaatttcactgttaacagaaccaacatttactgttgacatacgtcatacgttgaacatgtgtacgattctaggaaaatcaaataacataagcataggtggacttggtctttgaaaaggcaggcttagagcaactctcatgtgaacacgtattagtaacagatatttgcatgcaggcgtggttagacgtacgagtaagacgaaggttgtcggaaccgttcgcgtgactgtccaatagcgaacattcatatactagaccctcttggtgtgtagtgtcaagtataaccagatctaacgcttggggctttaaaagttgacgctgtatgggacatgaggggtttcatgtaaataattaacttgcagtttctttatgaaaaaacaattcccaaagttggttgtctgcttataatttcctcaaagtaaaactagaatcatagacatcacagttttgaaaactttgaagaatcacatgtcctaaacatggtacgcacctttttccactgataatcaattattgtttcagcctttctaacaatcatgccacaaatacggcatacgtggcctagatcttcatgaatccgaatgtcatgattgcagtcatcatccatctcattttcatcatccacatctttttcattggacatgtcttcatttgtatcaagctggacaaagaatattacgtgagctttattggaaaaagacacaaatcagatagaaataatcaattgaaatgcttcaaaactttgtcataatacacatatttaaatgatttgacaaatgaatgccttttcaaactctatcttatcttataaaatacactttgccatgaaacttactttgtgcacagtggtattcaatcttgaaacaaaaaataaagattatagcatgtatttacgagtacaattagcagtcagatggaaaaagaaccaacaattttataatgctgcagaataaaagtaaaaaaaaaacatctgtgattacaacttgtacctttgtacattcagcagccaatgaaaaatctttccaaagatcctcgagaccttcactttcttttacaggtttctcctcttctatcatagtcctgtagctttgtgaaggaacatcattttgttgcaaatccaagtttgaatcacctgctgcttgattttgatgatttttcctttttctttttcctaggttagttccaccatcaacatctaccagggtggtgggttctgttttccttcgttttctctcagtaggaagagtaggaagagtaaggagaactgtgtttctgctatcttctctgcatggcttgctgcctacagtgagcaacaagagttaaagttcaaatatgggatatttaagcttcaaaagagtatagattcaacaaacatcaaacatttccattctaacattccagacaagaaatatcataatgctcttcagatttatcaaaatacaatcacaagacatgatgcaataaattggtttatcagtgcaggtatgtaatggagtaaaagtaccaatatgtcgaagtggatagtccattga

SEQ ID NO: 69194 - DNA, 20884 bp, Oryza sativa
  unsure (1)..(20884): unsure at all n locations
ttcctgcagcccaaagaatttgcagcgcgttgatgcagtgcagaaagaaaattcatcaactggagtttgcgagcataactagtttcccattcttcgccaacaccgccatatccccaatcatgagccctatttgatgcaggaaatgagataccatttggacccccaggcataaacacattggcgttggcctcagaagaagccttcctttgcctgcggtaatacattcctacaaagacagcagattgattaaatcagaggagatgttggttgtggtttggggtatcaagttataataagagaaaacaacagattaggtccatgaaagaacaggttttggttgggaaggaaaccaaatgatgcttgaatagcccctcagtctgcaaaacattgaaactgtgcaaatgtcaagaagaatggtcagcttaatgcacaactcttaattttagaacagaaagttatttaggatgttctataatataatagcgaacaatactgaaacaacatcaacaagcacataaggcaagtatcacataagagctcgatatgtgaatagagcggctggtctgatctggttgcaaatctcagacacagaacaactatccaataaccatgatgattcaggatgatatggctcaacatgacaagaaaattagtatgaattgaaattcgtagggtcgaatagtttagagtatatagatgtcattaatcataaatcaccatggtttggcataataaactaaaagagtattgtgaaatatactcctctttatatgcaccatctgcaaacgcccacttcccaagtgccatcaacaaacgagaaaattgccattctaccatcatcaaaacggggattcactaaaatgccactccgcatttgggattcgccacaatgccactcaagtgtggggcttcgccgaaatgccattaacttccatttttgagaactacaaattattttgtcctttccctcctatgtttactgaccaaaatacccccgattgaatccaatcaagtgggagctcacacatctaggaagagcgcgtgggagcagttgacgagcgacaagaggggagggacggtggcagtggagaggtgggccagcaacagggtggcacgagaagaagagtactggcacggcggcggagtgagaagaggagcggcggtggcgcgtagggacgggggtcggggacgcccgcgagaagaggagcggcaacggcaaggtggcacggggccaaccctagctcccagaccgctgctcctactcgagtaggaaagaagaatggggaatttggatggattcaatctggggtattttggtcattaaacataggagagaagggacgaaacaatttttagttctcaaaaatggaagttaactcccaggccgctgctcctgctcgagtaggaaagaagaatgaggaattttgatggattcaatcgggggtattttggtcattaaacataggagagaagcgacgaaacaatttttagttctaaaaaatggaagttaatggcatttaaagccccacacttgagagcggcattctggtgaatcccaaatgcggagtggtattttagcgaatctccgtttcgatgatggtagaatggttattttctctcaacaaacacctcccttgtacgccatgagaatctcaaatcacgacataactctcagtgtgccccccaccgctggattgagatcctctgcagtcagcgttttagaaacattatgcaggctccaaagcaaagcaaaaaagctccaatccagaacctagttcactcaaacaaacaaacaagcaagcaagcaagcaagcaaacaaatgaggtaggagtagaacaagcacttcttcttcctcataggaaaagccctcaaatgtcataaatagtttgtttccgaggagcacggctaggaaatcactcttcccgaccatttccaagcacaatacagaccttgttctactcaaatcgaggtgtacatgtacaggtgcttaatgcatgacatcacgatccaaaaaaagatcacaggagatttcgaccaacggacgcgagccaacattaccatccacatattatcaccgagaaaagcccgaaccacacaaaagcgccttacgcgacgaatagcgaacggagaagaaagccccctcaaaatgaaaggaatttcatccccactcgaaacccaaaccaaaaccctaaatcccaagcatcccccatgaacgacgaatcgtggccacggccaagtcctcgcccaacaacgcaatgtaccacaatctccaaccccccaaaaagtccccccacccctcctccgccctgcagaaatggcgaagaaaagaaaaaaaaaccggaaccagcgcataataataacccgaccggggactccgccaccagagaagagagcgagaggggagggagggaaggggggggagccggagtccgcggcggcagccatggcgtggccgcggcgccgggggcagagcgcgtgagggggcagagaccgagaccgagaccgagagcgcatgcgtgcctgtcacgtgtgtgggtactcgctggtgggtggaatggaaaccgtggcgattcttgtagcagggggaatctccgtttcggagagcagggccaattgccacccgctacgctgacgtcgcgcgggtgcagggcccacctggaggtggccctccccctgctgcgctagggttgtaggggcgttggtgtgaatttccgggctaaggaaaggagagaaaaacggaatttgctgccatgacatgcctgctactccctccgtctcataatataagaattttggttgacacatcctaacactataaatctagatagggttccatccataatgtaacagattttggtgggatgtgaccttatattatgagacggagggagtagtaggtagctaggtggccgaggggatagcgccacatggtggggactgacaggtgggccgatgctgaccaggtgtacaacatcactcctagtaactccccatttcacaatgatggtgtggttgctagttaatggaggcactattggacagatgacttcttttaaagtatttttcagtgatgcgagcttcaacatgaccgtcctgagatatgcacagtataaagatttagttttttcagcgaggcaagcttaataattatgagggctagcaaatgatttctcttaattatggaaagaagatatatgagattttctttatgattgtatcctatcgtcaatttcatagaaaaataagtaaaagataaaagcctattgaaaattttcctttggttcaattgttggtattttttacgatcacagacaaaatccgcaagcgcacgggtataccgatgtagcacttcccctacggagtattccaagggtatcgaatataagggaacgtgtgtggtcagatcttcctccggttcatccaaggacaccaagcaaatgatatgccaggatagagaggatttactagtgagaaacagtgtctagggaaagcttaactttaatcctaatgctatacttcatgcactggcaacccactgttcccagatgtcgctctactacgtacccggacaggaaggacttaagtgatcttgagggctgtaaccacctctacacccacctcaaacgtactgtgggatatgcaacaattactggataacaattacctaaacaccacgtctaagcaattactatctactttagtgtttataactcaccaaagcaatcactatattttagttgattatagtgaacaataatcccgtatgctatttaggaactaaccaagagataattctcacaaaataaatctaaattactcaagaagaatattatattgaattcagagtaataaacagaataaaaggaataggagaagattaccgacaactccgaatttcttccgactccttctactctactctcttcctattctagtatataatatagtacaatagagcctcttataattcagctcaagcttggaagtgtgtgttaaagtgagtgagatgatgtccttatataggggtaggtatgatgatcgaaggggcaatgtccgaagtgccccgcaaccgccatcagggagtgatctgggacgtccatgccaaaacctgggatcaatggtgatcaccagggttcgtccgaacctgggctgggcccccctggcctggcctttggcctggctcctcctctgatcctcctttatccattcttaggtgttttgggctgattctctggtgtttctacgaagttcacaacccatccttgtatggatacatatttctcctcactttagtctagatttcctctcaacatcggagtttatcacctgcatacaaatatacaccaacactgtggaatatgtgagattaagcacctatcactatgttggatattttattatccgaactttatgcagatgttggcggtatagaatcggcatttaacagccgccaacaaaaccccccacacttagtcctttgctcgtccctgagtaaaggttagtgcataatgaatttcttcaagatatgaatcaagcatataaatcattcacaaccatacctgcacctgtgaactttatcagtggctatcttaccatcttaagtaattgacaaatggaatgatctcgattccaatccttcttgcttctccgtcaaactcatgggattttttttatgaattttcacaaaccagctcttttcctcatattgactttccctcttgtttctcacagatgtatattttctttttggattcttaccaaggaaaaatgtgccataattcatccctattctaaggctgatatgtggagcttggtagggataaatcggggcatacctgcatcatatatattgcaaagccaaaaatatggactcaagaagatcatcagtcatactcctagatcaagggtctttatttgtggatggaaaatgaaaaggtaaaatcttttgtggaatggtggaattaaaaaaaatgattctccccttttcctatacttcctctccatttggttctcttggcatgatcatggaaggggcatggctatattttctttccaacattgctcaatgttttgggagcaaacttttatttcctcccccccccttttttatagccatgcctttcctcccattttttttctttttgccaagaacttttccaggagaagaaagcatagtctaatataggagtttatttaaatggaattttttcggtggaaagccaacttccagtgtagaagcttagcttaattatatatatgtggaaaaagatggaaatggtaatgaccccttgatcatgagaatatgaaagatatctaacacgagtctcataaattcgacaaagctcaatataatgtcaagcagtcatatgcataacaaggttcatcaatgatatacttgcatatggccttggtaggtataagatgaagtcaattggaggattgagcttttaaaacaattttattttgaaaacaaattccaaagagtcataacaagagttgcaaggattcccttcatcttgaatcatctcacataaagcaattacttagatgcataaggttccctaaacatggatggttgttcacaagcacaagttcagctgagaataatgaatatacaagatcaatcacatgaagaatttcattagttggaaattttatctttcacttatgcttgaaccaattgttttctgaattttcagctctagtactataccgtggtagagatatacagatacaagacgtgctcacctgcttacctgtgaaaattgggagggattggggccagctttggttcggccgaacctgatgcccgatccctctgcaattttctacagagttcagtgccttccaggtgtttcagagattcaacaattttcagagcatatgcacgtcagaggctgggatatctcccccacacttattcaaaacctaaattttattaaacatgaaacaaaacaaactttggaaaacattggggttaacaccaatgagccacattatttatagcaagtgcttacatgattggaaaaataaaaccaagcacctactactattttattcatgggaaaggaagcatctaattagcataatacttattttcctttcccatttctacgaatgcacgcttgatcttagcgcacaaaccgcaactaagggtatcgaaattatttctaatttcagcaagctctacccctagctccgcgttgcgatccctaagctctatgttctccttgcggagtttcttcacttgcgcagcgagcttatggattgagggctctggcaacttcacctcatcttcttgatattggtcgggagcccttactattggagggggcgtcaaatgatgcttcaccttcataggtggagggctacgggattccgctgcccctccttctccgatgccgtcaacggccggagtaaacccttgccatacccaccgccgggagttcgcactccctggatgcggaatcgctcctccattggagtggatggagtagcggtgggtatgacatacttatggagcacctcatcccctgccttggtgaacagggtgcccacatagcgctcggcgggaggcggcacggccttcccgtcatcttggaaaaggcgtcgcgccttcaacaagccgagttctcccgttgtcggccgtcgcgcaggcgaatccccccgtatttttgtccttgtgacatggcgaggggagagggatcgcactgccgaacggggggccgaacggggccgagagggcctggttcggccgaaccagggagctcgccgtcgggctccagatttgcaggggagcccggcacagctgcgaggggttgagcccatacatcatttaccccctccatcgtgtattcttctaccggaatcaattgatttgtcggcgttggctctccggtgagattgtaagtggaattggaagaagagcgaatgaatgggatcagtgatttgcctgccattggtgaattggaggtgatggagcaagggaatcgggttgagatggagaggaggtttgcaaagtgggaaggaggaggaagaacaggtgctctggttggatgcgactgatccacctccgaaagcgcatcacaacagactatagacgagcgggggagattgctattcgaaaatggggccgaacgggcgccgccctggttcggccgaacgaaccctggtggatctggcaggcctccacttctcgtcctaggcccactaattcctaagctaagcgcagaaatgacaactatacagggttttaagcatgcactagatgagatcatcatggttcataatcgattaattcaataacatccacttcttcatctaaagtttcatttggttcaaggaaaatctttaagcgttgaccgtttaccttaaatatgttacctgagttgtcgcggagtgtgattgccccgtgcgaagaggtgtcgatgacgtcgaacggtccttcccatttactgcgcaatttttcgtggccaaaaagcttaaccctggagttgaacattagcactttgtctcctggcttgaatttcttgatttttatccttttgtcatgccagtgcttcatcctttctttgtatatcttcgcattgtgataagccttctctatccattcttcaagttcagcgattttcatttttctccattctcctgctccctcaaagtccatgttccagtttctgatggctcagtatagaatcgacatttaacagccaccaacatcaatctttactgcttgcaattaacaaacttctcctgtgtttttaaattctataggattgtaaaaacatgttacttctattcatgagtttttctattctatgtttcaaagggtgactgaagtgtaggtaaaacttcaaatctctacacgtgctttcaaaaattaattccgaatacgacgaggacaccgtcatgggtgtcgatgattactttttctccatatgtactatattaatggaaatattttgtatgtgtggagttgttaagatagagcaaagtgagttggccttaagatcaataaaaatagtcattattgccttactccattccaagaaattgaatgcaatagcccactaagagcatccctaggagatcctccatccggtcctccacccaaaatatggcatactggaggtgaaaatgggcttccaacagatacgacatctaacctgccaaatatgtcacaatgcgccaaagcgagcatattttagccaaatatagcgattctctctcctcacgccatatatgaacgcctgcatctggatcgagctcccgcccccatccggacatccatcacaacctcctctccgtcgtcgtcgtcgctgccatgccggccgcaagttgccaacgccgagccgtcgcaagccacaagccaccacttatgagtctgccagccgcctgcgcgctcgctgcctcagcatccgccatcgtcgcctgtgtggctccacgcccgtcggccaccgctgtcacttcctttctccgcggccaccaccttcacttatacgcccaccggccgcctacgttgcctgcccgcctgagcattcggcgctgtcacctgctcggctccacgcccgctagcctccgccgccgcttccacggcttcccgccgcactgccgccgcatgcgcacatccgctcctgccggtcgacgcctccggagtagtctggacaggatagaagagaggaaaaaaaaaagagtacagaacgatagagaaggatagagaaaaggagagaaaaagaggaatatgggttggaattgaacagaggaaagggcagagcattggtagaaaataaaattacccattaaaaaatatgcgttaaaatttactcattcgaaagattatcacggtaaataacaccattgaaatttagtcattcaaaatatagcccttaaaaatacaaatgtaaagttaattgaaagatattactaaaatataggagggtgcgatatggatgatctgttgaagtgggatggatataaaggaggaatcttttttggatgctcatccatatgggcataaggaggatgaaatttggatgtgctgctgggaatgctctaactagcatgctaccttgtcacctacttcctccatcccatattaagttcatttttagctccatctatttgtcccaaaataagttcattttaagagtaagagtttgtaaaagtagggaataaatgtattcggagtagataaagtgatgaatagttgcattggcatttgatggtattctagtcttttttgcttttgtattggtatgtgtgtgatggatgaaatttaaacttattttggaatggaggtagtattagcattagttttaccatgcaaccctccactagctagtataccacttgccaccattaagttcaccatgcaatacttaactagcttatagcatataagcccacgacgtttattttggtaattaatgacaaatgctaattatgaactaactattttatttgaatgagatattttgagttagtaccacataatgtgcatatgaaggacagctaccacgaattaaaattgatgatgcaaagcaatgagataaaggtgataaatctaaattttcttttttatcaatcaaggtattgagcagtcaaatttggtaggttttcttctagctttgacgtattatcaagagaggtggtaacctaggtgaagaaatgataaaaaatgctacattaggtcatatgtatgagggtgtttggtttgattcaaatctatttcattttgtgggaccgtagctagtttgaccgattgggacataccggtttcatcgcggcttgtgtgtcagtctgaccggaggctcttggtcagtatgatcaggctgagcttggtctgaccgggcacccatggagccggcagggatgccatggctcgacggtccagacaagccagagctgacaccgatctgaatgaggtagctcggtcgtactagagctgccagcggtctagccgtttgttaacactttggtaagcccgaagtcatcatcgacctagagttagtattggctttagagtccggaaattgggcaagggaaattaatcagtccccagtagtcagattcttagtggattcggttaaggacattaatcaattaaaggaagcttatctagaagacaaatttacctattccactatatatatttttggagctaacatggcaggttctcaatcaagttgccatggtgaaaatcatgacgaaccagatgcacctgccacatgggctgaggtgttgcaaatggggaataatattcttcaagtgatggaacggttgctgaatgcacgccttccggctgccagtggtggggtggttcagccaccgcttgttgatcccgaggatgagttgtggatgcacattcggttgatgatgatgccgatgacagactccatggtccgtccaatggtggaggtactagagcacgagaaggaggtgctcacgggcgaggatttggctcccgtgcgcactttggcggttgttttgagccccatgatcatcaccatgaggaggaatatggtgatatataatgatgattttttttcagagaacaatttgtagcggcggcatgttcatcctcgccgaggtgcggtccttggcaatggaggccaccatcgtggtcgccatgatcatgatgacctggataatgttgctcgggtaaagttgagtgttccaaagtttactggaaaggatgttctagatgcttatctttattgggaagaacagtgtgatcagatttttagagtgcataatctttcacatcagaggagagtaaaccttggttcagtggagttctttggttggaattagcatgttgttgtcaatatgaatgtcattttctctctctttcaacatcacattattgtacctgctctacgagccagaccctcgactcctcgtgagtgaggcactcgttggtggatcataggcggatgcaggggagggcgcacaatgttgcagagggcagccaaaatccttatgccacgtggaccaatccattgccggcaaaactactggcattaggccaaaagatcaggaccaaaatgccatctaaaagctcaggttgaggatacattagcctgattgattctctaggtttggtaatgagttggttgcaacatcacaaaatagaacaaattcaagctaagctgagttgtcgattcccatgacacatatcttgtatctgcattatatatagttatattagtatctctttttatgaaagaaaatgtaactaacatagactcaatcataatatttttgaaaaagtaaagtgaaaaattgcacttgaaagtgaaagtgaaagtggtttgcatgagcaatatgaattaactgtttatctatagatgttgttaataatggtcgatgtataggtaggtgaatatataataaaatggagttatgattgaacacactttgttctattttctatggaatcacattgatggagacgagctcggagccaccagatctttggccagcgagctcgttgtcgccagatctcacggtggcgtcttcctcctcgtcctctcctcttggtggtaagaagtggagaggcagcgatgatgaggagcccaattgtttgtgcggtcatctgacctcgtggttgccagatctagctccccagagctcaagaaggagggccgacagtggtaggcgaggaagctggcaccggcaatggcaaagagaggaggaagacaatgagcaccaaaccctagtttttttgttttagggggagaaatgaggaaagagcaaattgaccccatcgtggcattgctcgccccttgtatgcgcaggtgcgaaccttgcattatggatgcaggctgctgcatctagtgggctaaactgagttgtgaagctcgaatcgagtgtttacactcaactaggcaaccaaacaaccaaaaattgcatacacatatgcaagccaagctaaatgcaggcaaccaaacacacccattgtggatgtgccttgcatccgaaagctgaaccgtagcgcactgaattatggctgcactttcaaaaagagaggaaccactatatttgtgttgagaatgttgtcaaggtcacagtacgaaggaatctgggtgcctgaaagttaacgaatactagtagagatggtttattaaactttaaaatgttgattgcaaagagaggagtgacgtggtaatgaatttagatgttttaccttctgttcaaagggacaaacatcccaattatcttgtgttgtactcctttcgtcccaaaaaaaaaaacccaacctagtatgggatgggctttttttgggacggagggagtacttcatttgctggtactggttttggatcttcacgaatatttacctggacatgttttacttctggaaatcttccttgcaagctgcataagagttatggttatagtgtaattctttaaaatttagaaagtgtggtgtatattgtaagaaaaaaatagtagaagatatcttatatgtatccgctgaagtgttgaatctctgggacatttacccaaggtcaccatccatatgttggaggaacagagtacttgttttgctgctgtagtttgaagctgttgcctacttgttaagtgtattctgaattataatccaatggtgttgatttttgcaatattaaactattgtttgccaactgtcccttggttttgttgggatacgcataggctacgataacataaatcaaaattttctatcgcgtaaaccaggaaccatgcaagtattagatcatagatcgttaccactcgacgcgctgcgcagcggaagaagacgctgagaagtcgaaagaattctcgcgaagtagagcgcgtcgatgtagaggaagtagtcgatcgcaccggctcgaccttctcctcctcatgcgttctcctcgccgtactcccacgttgattagcaccgcaaaccagcggtgcctctaccggtatccacacgtacagggacggaacgccacgcgcagatgtgctagcatccgcgcgcggctagggttttgctcggggagggaagtgacggctagggtttctcacgtgatgcaatgcctccgccggtcacacccctcacgaatatataggatccatcacccgggccaccaaggcccgtagaactcctattcggatccctatccgaattaagctcatattgaatctccatccaatgcccttattccggcccattaagcgtgcgaccctgtaggttcatgtacactcagctgtaacccgaaaactccttttcggtccacgcgtcaacagcggcccctagcagaacgttttgacctaccgggcatacacaaagatcatatcggctgaacctctagtgtatacttatatgaacccctttgcctcacgatatcgattaagctcaaggctagatatgtgccatcctctaatagctcaatcattcactcgaacctgttgatagattatataacttgtgattgactactcaatcacctttggcatggccatgcacttccataatctacaacatcgaggggcccagagatatctctccataggaggggcaaatctcatcttgattattcatatcctactacatgtttcatagcatacccgaaaactacttttataactacccaattacggagtaacgtttagcagtccctaagtaagctactacacatgttgggaaccatgataatcttaggtctaaggattcaataccaacactaaatgagatcactgatgacacaacacatatggctcttgcagtgtctcatgttgggtctatccaacaacatgttcaccaacatgtgtccatattattaatttggtatctctataccatgattcatgagacatgatcatcaattaatacatgtgctgatcatctaaacatatttattctatatatgatatttgatcagggatcctttagaaatagcaacacacaacataaagagtctcatgaaagaatcacatattcattaaccaataatgagttatctatttcaagtaacaaagtcggataaatatgtaaacatagtatgtgtcacagcctgattttcgtttcaggatttataaataatttaataaattattaaaagaatttatattaaatgttcattaatttacaagtgaagttaaatgtgggaaataaaatttcctaaatataaagcatggttggatttaatttttattaaattctccatgattaattatactctctgaaattttctcggatttttcagagctcaattcctaattttaataatacaaagaatatttcagtaattatttaattaataaattaatcattaaatggtctggttttaatatttttaaatactttgagtgtccaagtatgttcaagatttttcttggaattatttgagcattgaaagtatttttaacaattgaaagatcatctcattggttaatttatttggaaaagtaataaaaattctcctcctcagcttgggccgaattcagcccattccctcctattccctcctctcctctcagccggcaaaaaagtctgatttacctccctggcgctacagtactccatcttcctcctccagacagagccgagccagccgtgctcgtgcacagtgccgccgcctcctcccaccaatccgacctccccgttgctcctctttccaaattagttgcgggaatgaaatcccctcaatcttctcttccttttccccaagaaatccccaaaattttctatggaaattctttccaatttcgcggatcaaatccttcctttttccggcgagaaccctagactttcccgagtttttcccgtcattgtgggcttgatcccgagctcccgtgcctatataaaggaccccctagtcgtcctctacctatcccctcaagtcccatcttccgccgtcgccggaatcgctctccccgcgctctccctctctctccacctccggccgccgctccagccgccattcgccgtcgccccggccgtttccggtcagcgccgccacctccctcggcttcgcagtgaagagctctaccccggccacctgttcttttgcgccgaaccccgccggaagtcgccgtcaccgtgaaggccgaaccgttgccatgttttgatctccggcgaagctttgccgtcgactccgtggtcgccagacctcgccgtagccactgtcggcatcgcagcagtgagaagaagcccggcagccatctccccgaagccgaaatccaccggagctccattgtcgccgtcaacccgaagctcgccgtcgcgttttgatctccggcgaagccctgctgctcctcccgtcatcgccaagcttcaccgctgcctccattggattcgcagctgcgaagtgaagcccggccacccctccattgtcgccgcatatcgccggaaagtcgtcgcctccgtggacagtacctcgccgcccttcgaagctcgtcgccggccatctttcgttgccgttcgtcgtcgcgtaagtggtggtaagggtcactttgatcccctctcgctcccggtgccctccgtttgcgttattgtgccgtggttcgctggcaatcgccgctcccatgccgttcacctgtgagtttttccctagggtcttaattcaatctaatccgttgtctatctagcgttgccgtggtctccatgtgttgccgccggttcaccgtcgtcatctatctctctccgaccgctttggtttggtgagtcttctatccgtgacccctcgggttaggtttcaatccctcggtcatgtcgccgctgctgttgctctaaccctagcgcagccgctgccgcgtcatttgccggctaccttgtgcaccgtcgctaccagttgtgccattgttgcttgtcgccaccgttgtgctagccgcctagccaaaccaagtcgccctagtgccgccgtgtcgcagctttgtgccgctttaacctagccgccgctttagccgttgctcagtagccaagttgtctagccgtaggtgcattcctaggttcctatcggcctatcgtttgccgtaccggggctttaccgtgaaccctgtctagcccaccggtttagtcgcagccgttgtggagtcgttcgctcgttcgttcgaacgaggtgtccccgtgtttcgttcattcatccgtgtggagtcgtcctttagtttagagcctttcagagccgccgattccattcgccggtttcggttgatcatttgggtgatcccgtgtcacgtagaattgactcgttgagtcgatatctcatgaggctcgcttgccagatcaatctaagccatccgatcttggtcaactctcggtcaagattaatcttagccgtccaaaattgatataaatccgttctctcttttcagtggcatattatttctttttaatatatgtcatctaccgaatataatctaatcttttccggaggttgttttaatcttttatctcagttataaatcatttgtaaattgtttaattaatttggaatagtctttcctttaataggtttaattggaatttaatcttgtaaaaatttgtaattaattcatatgaaatcggaatgaggtcgttcaagtctctaaattcatctaaaatcatgatctacatgtttgtttactttatatgtattgtttatttggtttttattagtctttttccttgttttgcgtgatagcttgtcgtttccgtcgttgcgaaggttcatgagtgcgtcggaagtgttcaagaagactaattgaagaccgattattgcaaggcaagtcacacagatcccaaacacaattcctttgagcatgttgatcctatattaaaattctctatttatttcaactgtgcatttattttggaatgtcaccgggtggtgtgaacctattcctttgttatgaccactttgcattccttactctattctttataccttgggtgataatttgactagttgagctttatatattggttcagctagatgttagacataattgcttagccatgcttagaaacattagcacactattgggataaataatgtttcactattacttaatgatggatatttaattgtagctcacgatggtcaatcgtgattgtgaattaattaatgtgccaactaaaacttgataatggtgggttgtgagcacatggttttgatggtcgtgctcataacaattaaggaccggttcacgagtttcggttgtgaaacattaaccgtgccaaccacaagccagcatgggcaacggctttactttttgtatagcatggttcattgcggagcacgagactgagaagtggcagagataagcccacgggggtcgctggggagtccatgccttgtttataagggggtgattatgatccaggaacggtgcgctgtggtggattgtgttgtgcgaggggtactgtcacagctcctttccgaggtaccgtggtggtattgaggcgcatggtgacatgttgtggggttgtgtcttgtgggtacagtggtacacctctagcagagtaaaactattcgaatagccgtgcccgcggttatgggcggatcgaacaatgtctttcgtgattagtcccacactactcattaataataatgtgataattgatggtaattaatttagctcctggtttggaatggtacattcctggtttggagatagatctgtgcagccgggtatggttgttcaggatggttgggcctgatcagcatggatgtgctgttcagtgttgattaatattgatgattaattactctactgttttgcaattcttaaatgtttgctaaatgctgctttcgcaaatgagccctatattatgtcatcctttggtatcctgtgcacttgcatatttgttgtgtggcttgctgagtatgtcatatgctcaccttgcaataatcaatcaaacctcagttgaagacaagttgcgaaggagaagacgtttggcttataccccagttgagctgcctgtgggagtggagccggagcttcgctagaccgtaattccgctgcagttttcttttcttttgtaagtatgtaacgttattatattgatgaatctgtatattaaattgtcagtttgtgtacctccgctgattcctgaatgaggatttaatgcacaaattagttcggaaattactagtgaatttccggacgtgacagtataagatacaatcatctctataattgcctataggacatatcactaacaggttttgtccaacactttcttagtcaactaatctcaagctggcagttttgccagctgcctattagaccatgtgtctcccctgatctcacaaataaaatccgaattatgtaagaacaaaaagatataaaaaatagcagtgtctcctggtagctgattggtcgagtggcagccaaatagtctagcgacacgtggaggaaaaagggaaaaatagcgaatggttgtgcttctcaatttttcatcacgcagtcacggtgcaatctagaagtcatgtgcgtgcatggagtctctgcctgggccaaagcctcaacaagaggagtccaactttggtccatgtgctgtgcgtgcatatgtactagcgcatacgagaaatttggcaattttcgtgctggttcatcttgcgtgctgccgtgcgatcatggaccgaggttgtaccgttgtataaaggagtggaaccactgtggcgacggtcttctccataatactaagatcaattcgtggcattctgttgtattttattgggatccttttcaatttagcttaatatccagggttattcttcataatgtcatctttattcatgtatctacattaaataatctacatcagcccacaaatataacaacgtatccatttacaagcctaaattttaaaaataattaaataacacacatgctataaaatggcacgcacgccaatcagcatgcctactttcagttatgaatatgatccgactttcggttagcttcggtttgttccacccttcagcgatttttgtctaaggtttcattgggcaccaaaaatgttcctttcaagatttatttaactatctttcaaggttcttagtttcataatcaccctattcaattgagaatgatttgactcaaacatttttgctctcatgtaacatgcgactgatagtaatttaatgtgaaaacaacaaaacaggttgtatgtgttatatcgggcatcggttcgtactcatgctggtttaagttgagcattgacaaaaaaaaaaagtattagatacgaaaatgagccatgtgccaatttggtccattgtggcctgttcgtttcctctgaaatttgaggataaacttttggatttaaatggcacgttttttaaactgctaaatagtatatttcgtgcgaaaactttttatatgaaagttgttctaaactatcatattaatccatttttcaagtttgtaataattaaaattcaattaatcacacgttattaccacctcgttttacgtgaaaaacttcatcttcatcttcaggagattcaaacaccacctatcttaccaaaattaggcagcaaagtatacattcctacctcccccacccacccccctccaaaaaaaaaaacactccgtgcacatactctctccgtctaataaaaggaagacaaaactagtacgaggtatggctcagcctagtgtagactatacatgtactccctccgtcccagaaaaacctaatcctgggtttaaatcatctagacacgattcaaacccaggattgggttgtttttgggacgaaaagagtagntcncatcctatactgatttattttttataagacggaaggaataagggtgtttttagttcacgccaaaattagaagtttgattgaaattggaacaatgtgacggaaaagttgaaagtttatgtgtgtagaaaagttttgatgttatggaaaagttggaaatttgaaaaaaaagttgggaactaaatcaggccaaacttagattgtcaaaattttggtagcaaaaccaacacattcataaagatccaaaatttgtcatactactacattatttatacttctgcatatagactataaatcagcactgtacaaatacaacccctgaattgtacaggtagtaaaaggtatggccatatgccacaatcaacttcagcgcctgttgaagacatctaacatgtaatattgctgacaggatctcaacacagtactcaaaacatgaaaactatttgctccatctttctttccccaaatcaaaacagcacgtcagtataatactagttgaacagaaactgcatgtgcacattagttgatttacaacctggctgccatgatgtcatcctttcccattttctgacagcttcttgcctaattgattttaggatcagctatgccatatcttaatcctgatccaaatagaaaaactccatcaaatgtcgatatataaccaatcattggtttcatactatcaatgtaaacctggatcaattaagctaaaaaacaaatcatactttacttactaaaatatccaacactcgaatcattgttttatatgttcaagttaacctttttattatgtgtgatgtaatagtgagcacaatttagtgattttaaggtgaccactttctgttaaaaggtacatgttcaatcatagtcaaagaagattagacaaactcagaagtcacaaggaggcaaggagcacagcagcagcaagttgtctacaataataataacatgtaacttaagtgatcatcaaaatattcataaaacttgccgcacttaaacaccccatgatttgcaatcagaagatgttagctcgaataatcagataaatgaaaagatcttgacaagattatcaagaacaatgggggagaacataaagagatcaaaaaagaatatagcatgagtttcacaggaagtctatcaagatcctgacaagattatgattcgaagagaacagtgat

SEQ ID NO: 69195 - DNA, 1296 bp, Oryza sativa
cacatttcgtgatagtcccttcgtgaagggatttgccaggtttctagctgtttggatataatccaacgttataactccggagtttctcaatttcctgacaaacttcaatcgtcttttcacatgtctagacgatttcatattatccttagaactattcattttgacaattatcgtttgattgtcacagttcataaggatagccggcaccggtttttcaacaataggcagatccattaatagatcacgcagccattctgcctcaacagtagcagtatccagtgccgtcagttctgcttccatgattgacctcatcaaaatagtctgtttgcaagacctccacgaaacagcaccaccacccagtgtgaagacatatccactagtggctttgatctcatccacatcagagatccagttagaaccactatattcctccagtaccgcaggatacccagaatagtgaagccccaattccatagtacctttcagatagcgcattactcgctcaagcgcacgccagtgatcatctcccggattagaggtaaaccggctcaacttgctcacaacaaaggagatatcaggcctagttgcactagccaggtacatcagtgagccaatgatttaggagtattccagttgattccttgcaattctcttgttcttgcgaagcaacaagctaggatcataaggtgttggagaatgcttactatcaatgtagtcaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcctaaatatcagtatgtcatcaacatacaagcacagaataactccctcacccccaccatggcgatagtacacatatttatctgcctcattgactgcaaagcctgcagatgtcaatgttttgtcaaatttctcatgccattgcttaggagcttgtttcagaccatacaaagacttcaacaatttacacactttgtcttcttgaccttcaactacaaacccatcaggttgatccatatagatctcctcatccagctcttcattaagaaaagttgtcttaacgtccatttgatgaatgagaagaccatgtgaggctgctagggaaagtagcacacgaattgtggtcaatctagcaacaggtgagtaagtgtcaaagaaatcttcgccttctttctgagtatagcccttagcaacaag

SEQ ID NO: 69196 - DNA, 2284 bp, Oryza sativa
aagttggataccactctggagttcttacaatggaaggcaaaaaatggtgttagtgacaaggcatttggcgatttattgtaactcgtcaagaacattcttccggagggaaacaaattgcccgagacaacgtacgaggctaagaagatagtctgccctctaggactggaagttcagaagattcacgcatgtccgaatgattgtatcctatatcgcggtgaggagtacgagaacctagaagcatgctctgtttgcaaagcactacgatacaagattagacgagatgatccaggagaagttgacgggcagctaacgaagaagagaattcctgctaaggtgatgtggtatttccctataatatcacggctaaggcgtttatttaggaacaaggtgaatgctagaatgatgcgatggcacgctgaagagcgtcaacaggacgggatgctgagacaccccgccgatggttcgcagtggcgaaacatcgacagaaaatttaaagactttggaaaggacgcacgaaacattcggtttggtttaagtacggatggcatgaatacttttggagagatgagcagtggccatagcacttggcccgttacgatgtgtatctacaacctcccccgtggctatgcatgaagaggaagtacataatgatgccgattataattcaaggccccaagcaacctggtaacgacatcgatgtgtacctaagaccactggtcgaagatcttaaactgttgtggaagaaggaaggtgtccccgtgtgggatgaggacaaacaggaggagtttaacctacgagcgctgctgttcgtaaccatcaacgattggcctgcacttagcaacctatccgggcagtccaacaaggggtacaacgcttgcactcactgtatggatgaatcagaaagtacgtatcttaagcactgtaggaaggttgtgtacatgggtcatcgtcgattccttgcagcaaaccacccggtacggaagaaaggcaagcactttgaacataaggcggaccaccgtacgaagcctaaacatcgcagcgggaaaacagtgtttgctatggttaaagatcttaaagtagtgtttggaaaggggcctggcagccagcctatagagagcgaagatggtcacgcggtgatgtggaaaaagaactctatattttgggagttaccctattgggaattcttggacgttcgccacgcaatcgacgtgatgcacctcactaagaatctttgcgtgaaccttcttggcttcctaggtgtatatggaaagttgaaagatacactggaagcacgtaatgatctgaagcatatggaacaacgcggtgaccttcacccggaaccaaaggagaaaggaagccattacttgagtccagccagctacactattagcaaggcagagaagtaaagtatgtttgaatgcttggagagcatcaaggtaccgtctggatactccacaaatataaagcaaataataagcacgaaggagaagaagttcacaaatctaaagtctcatgactgtcacgtgttgatgacacagctgctaccagttgtaataagggatatcctcccagacaatgtccgggcaacaataacaaagctacgtgctttcatgaacgcaatttcgcagaaggtcatcgatcctgatagattagaagccctgcagaatgatgtggtgcaatgtcttgtcagctttgagttgatatttccaccttcatttttcaatataatgacgcatctgctttgtcaccttgtcaaagagatcggtattctctgtcctatgtacctacacaacatgtttcctttcgagaggtacatgggcgttctgaagaagtatgtttgtaaccgtgctcgtccagaggcaagcatcgccaaggggtatggaaaagaggaggtcattgaattctgcgtagaatttagtcccggttgttgttacgaaccgggagtaaagatatttttactcccggttgttctcaccaaccgggactaaagatccgagggtatatatattcccggtgtgccctcgtcttctccaccaacacttagacgtttttcgatctcggcttctccttcgcctccaccgtgcctagggcaaccccacgccgacaccgccgtcgtctctcgccatcgcttggcggtcctcgccgcctccgccgcatacgccgccgccggatctcttgggtgagagccgccgctgcctctctctctcgatctcgatctcgatatctctctctctctccacggacgatgaccgacttcgacgcgggtgccgccgccgacgacatc

SEQ ID NO: 69197 - DNA, 10370 bp, Oryza sativa
gcgtttatactaatacattttattggtaatacatatatgattatatatgtaacttggcccgtttagagtaatacattttcctggtaatgttgcagagaagacgtcgtcgtcgtccctcaagccgaattggtagctagccatcgaagtaattcgcgcaggcaagtgatgtaaagaagtgattgttagatatttaatataagattgttagacttagcatatatgattattacaattttaatataagattgttatcgatttaatataagtttgttagacttagcatatatgattgttagcgatttaatataagattgttagacttagcatatatatatatatatatatatatatatgattattacaattttaatataagattagtagcgatttaatatgagattagtagagatttaatataagattagtagcgatttaatataagattgttatacttagcatacatatatgattattacaattttaatatgagattagtagcgatttaatataagattgttagacttagcatatatgattattacaattttaatataagattattagagatttaatataagattgttagacttagcatatatatatatatatatatatatatatatatatatatatatatatatatatatatatatatatgattattacaattttaatatgagattagtagccatttaatataagattattagagatttaatataagattagcagagttttaatattacggttagcaaatacatcctatatacctaacaaatattttttgtatgcacagatggctgattgcgatgaggaacagatactatacgatacaatcatagagggaagcagccagtactggaacgaagaagaggggaacgacgatctaaaccagtatttgaacgaggaggggaacgtagagagggatgcggaggggaacgaggaggggaacgatgaggaggaggctagtggaagtcatccctccgctggacagaagagggcacgcggacaacgaggtgccgcgaagaagatagagggtcggcacatcataactgaggtggacgaagacggccgacctagtgccccggcagaagcagccaagaattttgtacgccacaacggttgggttgtgagggacaacgtgcctgtcagcacggtgtactggcgcagaacatgggcacgcggggataatgatagctttgtcccagactcagagaaagagatgctgtggaccacaatgctcgagatgttcacgctacccgcgggtacggagaacatagtgaaacactggactctgaagaaaatggcagaacagttccagagcttcaagggagatctctacaagaaatacatcctgaagggactaacaccgaacttcgacgtattcccaaagctaagggatcattgggacgagttcgttgcttacaagacagggcaacaatggcaagcgatgatggctagaaacaaagacaatgccgccaagaagaagtaccatcaccacttggggtcaggcggatatagcgtcgcaatgccgaagtgggaggagatggaggcaagtttgattgagaggggtatcgaaccggccaccgctaaatggccggatcgatcgaagttttggtactatgctcacggtggaacgcttaacccagttgatggctcccttgtctttagcgatcagatacgcgaggctgccagtcgactaacggacgcagtggtagcctcttctcagggcacattccgacccgacagagagaaggatgagctgtcactcgccctacagactcccgagcatccaggacgaacacgagggaaaggcatgattccctggaagattggatttaaggaggacatccacacgtacaggagtcggatgaggagcaagagagataccgatgcgaagattgcagatcttgagtacagggtatcaagctacgagctcagcatgcaagaggaggtggcaaggaaggtggatgaacgtatggccgcacatcagtcccaggatccccatccgtacattcatcctgcaatggtcagcccatcaggcaatcatagcagctgcgcctcaacggggcaggtcggatcacagagcatggacgccatgcaaacccaggacgaaaccacctgccccgttgatgagatcacgcaacggacaccatgtgagctgcatattcccttcaagaacttatcaatcaaggtatactcgtagtttgatgatttttgacttgtacattccgcaagttgctgcttaggttgattattaatagataacctctcatcacgtgaaggtggcgtcgggaatggtcatcccaacagacccttccaggacttaccactgcaagccgattccagcaggatactcgagggtcgtagttgagttggtggaagccgcgtacgaggacctcgagttggactacccaggaggagacggtgagacgcatctacgagacacaagccacgccatcatactatggcgcaagcggtacatcatccttcctgggcgataagcggcgtctcgtgcaccatctcctccggctccgccatctcctcctgcaccatctcctccggttcctccgccacgtcctcctgcaccatctcctccggctcctccgccacctcctgctgcaccatctcctccggctcctccgcctccaccgtgtccgcctgcacctcccaagacaaggtctcgccaagctccaccgcctgcccgcacaagggcaacgaagatggcgaaagttgacgccaccaaaaacaaggagccaccgtacgattgcagtcaagaggagcttgatgcttatgtggcaggagaggtgaagaggcaactcaagccttggagtcctgaaaagaagatacctattaacccgagcgtgaagaacttcttcaagggaatgtccacaacaaacaaggaagcgttacagatatcggactatgatcgaacacttcagagagcctatcacaagaagtccaaaccagtccctcagcttggagaacaaccaaaccaagaggttgagccgttggtgaccagcgaagattttggcataacggaattcatttcagacaccggtctaactgtggatcagttggttggaggcgcaccaatcccgaaggcggaagtggcatacaagtttgaactcggtaaaccgcttatcaaacctgaacagctgcagtccctatcgacacagatgtacaaattccatgaacggtacatggaaatgagcgccaagggtagagagatgttcggagcgaggatcagaaaccccgacttcttgcaaggagaagatgttctctggatccatttcaaggatctcttcgatctgtaccagttggacaccctcgacgtctctcttctgagcgcatggattttgtgagtatctttgagttcgatttgtttcgttcaataattagctcctggcatatatataagcaataatactttcctttcatcgttgtagaatggagattcaatgggcccgacggcggagggtctacgatactgggttcatcgaccctcggaaaatcaacaccgaaatgatcgacaagtacgagaaagacacagaggacaatctcgtccatctcctaacgcagcagcatttcaagacgtacatactactgccgtacaacacagagtgagtttttattgtcgttcgaacaaattttattcccatacatatagcatgtacattttcgatcatatatatctcatctcacgcatatttcatattccactgggtcctgttattctttgacttggacgcatgcagagtcactgtatacgactcaatgaataaagaggagaagatttttgacaaggtcttcaaactgatagacaggtaatataatgccatctattccaaagtcgcggggaatctattgctattatgttgatctcaggtaataattaattaatcatagcttgcaactgcatatgtggggcttgggatcggttccgtcaattggtccgtgggacttggaaagaaaaacttggatggaggtttcattttccagtgagtacatgcatgatccaaaattatattgaattgaatctctaatttaatataaagagtatattaaatctctcatcgtttctcatgtagtgtgcaaagcaggaccagggaactaacttatgcggctactacgtatgcgagtatgcccactgcctatcaaaccaaatatgcacaacacgagtgctcgatgtacgtatacataaaccattcaaaatttcattgtgtattgatttgttaagttgtttattaatttcatatattgatacgtcattatttttcaaacgatagcgtattcacatgagggataatctcccacacaaggattttatcacggctgttcaagaacaactgatgggattcatcaacgaagaagtccttaatcccgacggtgaattctactacgacggatcgacaattcataacgtcggttcttcctcttctgacacaacgccggcgtcgaagtcgtagctatagctaccgaacaaatgaattgtactatatatgcatgtatatatatatatatttatatatgtacacatttacttctgtgttaatatatattttggtaacatatatatatgcacataaaatgttaagtgctttaaattgtacatatgtgtgtgtaatatatatatatatatatatatatatatatatatatatatatatatatatatatatatatatatatatatatatataaaatcaaccatgcagcaaacagggccatgcaaataaaaaaaatggtgcaccgatctttagtcctggttggtaacacaaaccgggactaaagatggtttggccgaccacgtggctgatcgatctttttagtcccggttggtaacacgaaccggaactaaagatcgatctttagtcccggttatttcacccgggactaaagatagctatctttagtcccggattcgtagtcccggttggacaaccgggactaaagggggttaccaaccgggactacaaacggtttctccaccagtgtatagattcttagaagctgtggactgtttggagtagcttctagcagaagtagctttttctaaaagctgcagctgggataagctccctcaaacagggccttctttaggtccgcttgtgtgagccaagtcggaggcaattttaaattttagaatcaacctagggatacatggatcgccgatcacatgatcatttggaacataaatttgaaaatatggatgaaccgcacgcataatcatttcatttagaacttgacaggcacgatcggtttattcagaaatgcaaatcgaaaactcagcatcgtttggcgtttgcactccaccatatggaggatggcattagtccagtgggtatgctttggctgtgtttcgttcaaactttcaactttttcgtcacatcaattatttggacatatgcatggagcactaaatatagacgaaaaaaaatcaattgtacagtttgcatgtaaattgcgagatgaattttttgagcctaattacgccatgattttacaatgtggtgctacagtaaacttttgctaatgacagattaattaggcttaatagattcgtctcacagtttacagacggaatctgtaatttgttttgttattagtctacgtttaatacttcaaatatgtgcccgtatacatcaaaaaatattttgccaaaacaactaaacacggcctttcttttctcaattttgaggagaggttgcatggaggaaataggtaagaagtatccacacggtactggtggtggtccgaaaccatgatatatacaatagagtatgactcgaatgttatgttgccttacacaaggcagggtgtagagccctaactgaataatacattgcataaattaggaaattaaagtcgtatcttaccttttcctccttataaccctgcccctcaatgcctctacctatataagatgcgcagggagtctccttagtggcactaaattcacgacaactatagtctagatcaacgtatcaatgacatctgtcagatacaatccaccaagatcaagataagagtagcgaattacctctcgttagagtttgaacctgcccgaggcttaatttgtttctttgagttcccaactcaatcccttcatttttcgcacacacactttttaaacttttaacggtgtattttttttaaaaaggtttctatacgaaatttgctttaaaaaaatcatattgatccatttaaaaaactaatacttaattaattatgcactaatggactgctttagattttccgtgcgaggaggtggagttcccaactacacctcccaaacacagcctaaacttttgtttctgtgcatccattcacttttaaattaatcttgtgcgtagctctcttttattattaccgatgtaaaattgttgtaacaattttccagtggacatcctttcggaaaaccaagctcaaagctttgcaatttttttttctcaaaatgttttaggtggatctgtggaggcataccattccggacatcaacaaaaaaagaaagtattcacgcatgtagttaaatacatatgtttcatttacttccacatcagcgttggttcttttggcggcacccctgatcttgggcattttccgctaaattgctgacttcttgattgattctttctcctttttatatcaaacatctgaatggggccacgatgctttctactctactactacatccgtccaaaaaaaccaacctcatattagcatgtgtcatattttagtgcgaggttggtttttttttaatggagggagtatgacttatgatacacttggtggataccatgtctcgagcatttctttctctctctctctttccaaagataaagtcttgagcatttcaatcattttatagttttgttagatactgactctgctgcaagtcctgaagtagcggcatttctgcacagaataagagaaggcattactttacttggctagccacattagagctgattagttattagattcaaaagtgcatcttttactatggctcctttttagtgttatgctttgtttgttatcattcttgtaacatataaatgccttgaactaattagtaagagataaacctacatttgagacgctgaatatagaactttacagcaactaacggttttatccagctatttctaaacaatatcttccaataaaggacaaacaaaagaaaccatagttacaaataccatcaatgtgatgctagctcgagtgatctaaatagatagatcttttcatatggatgtcacttttttttcctagtcttcactttggggcacctttgatctctcccgcatctcccgttgccgctttctcccgccgctctccctttctttctcccgtggaaggtggcggcggtgaccccagaggcggtagatccggcgccgccatggccgtatctagccccccggtggatggagtggcgccggccacgccacatcgaggacacggtgacgagtgccgcacgggtcgcggtggtcgaggcggctgacggtgagcgcgaggcggacgaggcggcggacggcgagcgccgcgcggacggacgaagcttcgttggtgagggcaacgaggagagccgcctactccgccgtcgccaccaccgcggatacgtcggccccgccgcttgccgctctctctctcttatgggtccgcctcggcgccgtcccggctgtgccgcgctctgggaggacgcggaggaagccatcccggtcccggtggtcgcaatgaagctcctctctccctcttcgtcgtcgtcggccggcggcgactctagctctgctaaggggtggaataggaatacgagctggggaaccgatgtctacaggagcccgtcgccccccaatgcgtccctcgactgcatcgctcagccgaaaagtggcgagagactcgtccctcagccgggggacgcgctccatcgtggggagccggcgcggatggaaaagcagacgtctgtcggcgagggaacaacccaaagacacgcattggtgatggccttatatggttgagaaaagagtcagggtgatccaagtgttacaatgtaagattatccgatccaaagtgaaagcatcggttaaagggcaatccaagtgaaaacattcataataaaagctaggtggcccaagtaaagtttactcttgtttttatctatttgcgctgcttcaaataaatagtgtttcaaattaatgttgttttatttgtctatttgcaaaagaacaatatgtttgatcaattccatgattactagtctgaataatttcgcgtacttttactgtaaaattttaccaaacgtataattatcttagcttgataagtgcatccaattatcagcctcttccggcatcactgggttagaaatagatataaacatccaagtagaagtacgtatctcggcatctctgctgccaggcgatcatgaataacaatcaaacagaaaattctcggtttaattaagatagctaactatgatatcctcttatagtgcaggataaaataagggtgacatgcatgagttgtcgaaggtagccttctaatgatattaattattcaatcatagaaggcgatcaattaaaatcaactgatgcacgttcttgcctggtacaggaattaaccaaatacaaaaacagtatatcaatacaataacagaactctacacacacactcagtatacaccacctagccatttttgcaagatatcaaaatcaaatccctagctagttggttcaaaggtaaaaaaaaaaaggttcaccaaaattgagaagtactagtctgttaaaaaaaatcaaaccctatgtccaaatttaaatctagggtttgattttttttttacggaggggagtatgtggtagtgactcgatctgaatgcatggttacgtacatcccttggtgtagactagaaatcagtcttcaatttttccttttttctttagaaaaaaaagaatccttttgtttccatctcgatatgacatgtgggactatcacatatacatatgtcaaaactatgtcatctaggagtactccacgaacctcagctaatactcatgttcaagctagtttaagcgttctggtaataaattaagcgacaaaatgtggctttcaatacactgttgtctgttcaccacgtgaagcaggagtagtagcactgtgggatcttcctatctcatccacttgcgagttgcgactgcgagtgtcagctcaagttggcctcaatagttgaaattcaaattagattattagggcatgtttagatggctccatagcattgccacccatccttgcaaacctagccaaatcgtcgatgagcattgacaactacgtggctaataatttggcggccacacatcacaaaggtttggaaaaaaaatagagaaaatctaagaaacgccattaacaagtgttctattccaaggaatatcatcgaaaattatgtgtttcatgaaataccatcgtacaagtgactttatcccaaaaatgtcattgctgttagggttccgttagccgtcttccgttaagtggtataggatgaacaatgtatttaagagaaatttaacattatgccactctataggggtggctttagcatgatgccacctcataagatgtccttataaaaatgccactccatagatgatacttcttaatgaaatgccactttggggtgattagcttttaatcacactttggaatgattagatgcttttaatcacacattaggagtttagggtgacttctctcggctgcgtgttcgtcgccgctgcttccccactcggccactgctttcattgcccttaggcgcgcctgcctgagtcgtcgcctgtccgtgcgcccgccggcgtcggctcccgtccacgtgcccgccggagtcatcgccgctgctcccccgctcggccatcgctttcgtcgcccttctacgcgcccgccggagttggctgccgtcgcccgtccgcgcttccgccggcgttggctcccaggcggagggacacggcggcgggccacatctcgcccgctggctccacacagcccggcgccgaggcgggtgcgggggtgttcggcgagcgcaacggcgacggtgaagaggggagggaggagtggtggggacggcgaagaggggagcgcgacgtggacgtcgctagtggcgagcacctcttggagcggctcgggaggtgggggatcagacacgagtagcaacgcgaacaggctctctctatgagaggtgagggaatcagctctgtggatgacgacgaggaggcgaagtggaggccggagatggcggaggcggtgaccgttgctgtggcagcggggggaggcggcggcgccggcaccggcggtgaggaagaaggggaaaagagggaggggagggg

SEQ ID NO: 69198 - DNA, 5838 bp, Oryza sativa
gggggggagaggacgcgggcgagtagacgtggatattttttgcgggcagcacatgtcacacagattctctaatcaccccaaagtggaatttcattaagaagcatcctctatggactggtatttttataaggacattccatggggtggcatcctgttaaagccaattctatggagtggcatattgttaaatttctcatgtatttaatggtgtcggatgaatggaaccctaacgacaatggtatttctttgataaaaatcacttgtatgatggtagttacgatactcacactcatcgatggtatttcttgaatttgggtatttgtcaatgatatgtatttcttcgattgtttcaaaaaaattatgtacatggcatgtggacccagagctagaaaaactatgatatgacataagcgtggcatgatttgggcccggtttagatctcactctaaaatttttcatcctgtcacatcgaacgtttgaacatctacatgaagtattaaatataggctaaaaaaataactaattgcacagattgccactactttacgagatgaatcttttaatcctaattgctccatgatttgataatgtggtgctacagtaaacatatgctaaagacggattaattaagcttaataaattcgtcttgcagtttagtgacggattctataattagtttttttattagtgcccgaaaaccccatgcgacactctatataatacccgtgcgaaacgtatgatagtaaaccaagcaccccttcattcttttgatgttgtcacatcaatatcttaaatcattaataaattaaaacatcacaatttaatatgtgataacgatattaatagatttgcatgaaaaaagttttatttttaatgttttataaacatataattaatcaggaggcatgtatgttagagatcgtgttgacgttgaaaacaataattaaaagaaacacaggtacttcctccatttcacaatgtaagactttcaagcattgtctatattcatatagattttaataaatctagacacatatatatctattcattaacatctatatgaatatggcaatcctagaaagtcttacaatatgaaacggagggagtagtactttattttataggagtcttgattaagagtattaatttgagaaaattgtggtggcggaacataaatttacaatgtgggtacaaaatatagtacagaactttataaaatggtgcaccgttctgatcttattccctatgtaccacataaatttatatattagaatagtcgttttacatattcgtgcactaaaatacattggaattttcaccttttaattcttttgaaaaacttattttacaaatagacctaaaaagaatcattccaaaaatagatccttttcgcagcgtcacattattagcgttgtggtccaacatgacggccgccatccccttacccctcggtggaagctaagtcattgatgctgctcaagacctatttgtaatagaaaatgacctattttgaataaaatatatctacaaatagttcttgacagcaatagcactagcgtcaaagatatatttgtaattttttttacaaatatatttggatcacggtaccaatggcgtttagcgcccatgaaaaggatcatttctgtaatacctttttaggggcctatttataaaataggttttctaaaaggatcaaaaggtaaaaaattccagctaaaatacacctatctcttaagttcaactacctcaaacataatttactccttttgaaacagactccttttgaaacagactatgttccacttttgagtgtggtgatcaagagtaccattggggaataagttcatttgaggtcccttaatttggcaccaaatccaattttcatcctttaacccaaaaaccagatataaaggatccccaactttcaaaacgagtgcaaataaggtcattcggtagtattgtttcttgttttggctgacatggcacctacatggctaatttgacaagatcttcgtctcacgtgacattgacgtgacgcttacgtggcaatttgatttggaaaataataaaaatcgcgggtccacatatcagttacaccaaaaataataattaaaaacggtgggttccacgtgggccccacatgtcattctcactcccctcctatctccccatctcccctctcttcatctctctccgctctcctctctcctgattggacggtcaatggacagcggggagagggcgggggccggcggggagaaagggaaacgcacggcgggccgtcgggagaggagctacgaggagaagggaaccatcccggcggcgacggggccaccgcgaccttggccgtggacgacgtcgacatcgacctcggcatctcggcggtgggatgaatgtgtctcgccaacacacgcgcgcatcctcggagggggtcagccgtgccggcgggagagggaggagacggtcgatctcgccggcgggagaggggaaagagggcgccgccttgccggcgagagagggggagagatagccacgaggaggctagatgggggcagggtggtgagctgagcggtggtggtggccgcccctgttgccatggcggagtggaggcgggatgggacgggagcaacttggcgaggtgaacggtggtggtggccgccgtcgctaccatggcagcgaggaggcaagatgggggcaagggcggctcgcccacctccatttctactcttacgagacagagcagagcacaaacccaatcccatccaacctaccacctcgccgccgtcgccgcgacagccatgggtgtccccgcgctgctgctactcccctccctcctcctcgccgcggccgccacagctacgctgcaggaccagcccgcattgctcctctcccgtcggccgccgcgcgccgtcccttctccccgccggccaacgccctctcctcgccacccgtcggccatcccatcccggttaaaccacgcttgcacaccgagtgggttggaaggatcgggagaggaagagataaacacaatggctttgccacatttagatgtggcaattaactttttgccattggatccacatgtcatagacacatgtggacccacatgtcattgagataggggtggcaaatagttatttgccaaatctaaaagtggcaaatagttaaaaccccctgcctctgcggcaaggtacccgaggacggcagcgaggtagacgggggtgccagtgccgacgcgttgcgcgtgccggccgttctcgaggtagcggcttacgaggaactggagcccggccttgacggagcgtggcaccggcttcttcggcccacccagcttccgccccactaccttcttcgctgccaacgccaacgtccatctctgggaaacgcgaaggtgaaatcggggggattttgagcgatttctgaccccgtctcccactgcctccatcctcgccgcgtggaggaaatgcggcggcgccactaccctagccagtggtcacccgcttcgacgccgccgctgccgccgacaggcccttgccaaccctgtcgtcccccgctcccgcccggttcctcggagaaaatgagaggattggaagagaggagaagagggtgagatggaggaagtgggacccactaacatgtgagtccccctttttttaactgacatatgggtcctgcatattttgctttattttttagtttctaatttttgttcttttttttatcaaactaccacgtaagcaccacgtcaatgccacgtgagacgaagacctagtcaaaggtgccacgtgtgtgctacgtcagccaaaatcagagaatactaccgagggaccttgtttgcatggttttgtaagttgggggatgagttatatctagtttttcgaatcaaggatgaatatcggactgggtgacaaatcgagggatctgaagtgaacttattcctaccagtgggcatatgtcaacgtcaaccccacagcggcccaattcctttcccgcaagcactccagcagcccgctcttcctactcgctctaggctagtgtttgttttattgcagataaattaataatatgaatacattaaatattgcatattatctaaacataataaatagttgtagtttaaaacaagtggtctgggcaataaagtaaaagaaagtttcatgagaaattattattcttaaacatgaagcaaataattcgtaacaatcaggtgatattatgcttctaagctgaaaaaaagcgggccctgcaaaagtacaaacagctcctcttcccctgtccttgtcgtcaccctcggatgcaccagcaccaggtgaacacaaccgccaggcctttgagagattagttgccgctggcaactgatctggagtcgatgagtgcaacgagccaacgatcgagtatgcataaaaaaaaagtatgcatcctggcattgcgagtcttaaagcatctttcatgggagccagaattgaaactagaatggtcgacacaaaaaccaggtactgcaacaaaggagataaaagagatgcacaaatgcacgacggataacctacattccgttacgcgcagaaagaaactatctttaccctatcaaaaagggcaaatttgaagaccaattgaagtgcacaaaagacaggtaaggaaacagtggcattatttaagttgttagcaggaacggcagaaaccatagttattagtcctggagatcttcagaaggaaataagactaggatcagctcgcgaaccgctgcgccaagctggcacatgttaacaaagcggacagtggttcaaataggtagggaaacgaccgaggttaacgataaatcctagcatgaacggaactccggcattagaaggggctactgtaacatcctgaaggaagaaaaatgatgaaggttaacgaaaaagctgatggtcatacaatcagaacagaataaggggcaaagattttgtaacgtgaagaatgattcacgagaaatccccttacttcacagcgatgatcacccagaaagatcagcattgcattatgtacatggtgtacagcagccacatataacttgttacctacaagacaattttggataagacagagagagcatctccagggtttaacttgcacatgcgcacggggagaaagagatagctgaccttctatacaaagccttgatatcctggcgaatagcattagcctccaatagttcatcttcagagtcatcaatatcaacttgattcagtttgaagtcttcagtagtgcagagctcactccattcaaaccatagctttgggataacttctttcttgaatgcagtttcatggaacttcacctctggagaatcagcagcaacaagcctgtacacaaacactttcttctgctgtccgggcctgaatgcacgtccgattgcttgacgggtgacagatgggttcaaatgaacatctagaatgatgactcgagatgcaccaacaagggagattccctctccacaggccttgatggaaccaaacaaaacttttgcatcggcagagttgttaaactgatccatcgccacttctctgtcgtctgcactagtatcaccagatatcatgaaaatctccttccctacatgccagcccagcctcttaaccaacaacctttccaaaaatttcatgggaagtatatattgactgaaggcaagcaacttctctcctgcagagttagcaagagacataatgttaaagaaaaacttggctttcaccccatctttaatgatgatagactcaatcaagctgtcaacagtggcatctgtcaagttgctcgccctatctgcagcatcaccctctgaaatttctgacaggcagggatgaatgt

SEQ ID NO: 69199 - DNA, 1561 bp, Oryza sativa
aatgttgagaatataggcatataatgatttaatatattccataaataaatcatgacattacagatatataatagcattaacgtatcattagatctacacatgtaaactaagcagtaaaacatgaacagatcaaatatgcgcaacatgtcgaacacgtaccgaggtggcggaaagaccggttgctcggcaagaactacttgcggttgtgagcgtcgatgaaggcgcgcagcacgcgagtggagaggaaggtgaaccgtcgcggttgaacagggaacagtcgcacgaagcgcttcccaaaaaccttattgccgctttctcccagtgcaggacgtcgaaggcagagattccagagacctgctctcccgatcgccggtgcacgctggcgagcgggatggagtagtccacgagcgacgacgcaacacagaggaggaggcaaaccctagattgatttcgcgtgtgttgcgtgaaggcggtggcacggtttatatagagataggtcgcttgatcagggcgcccgcacgatctccactctgcgtaaccgagccggataagtcgcgcgtaacttatccggactccacgccgttttcacgcaccggatttttcggaatgttttcaacaacaaaacaaatccgaatttttctgcaaccaaacaaaactgcaaaaggaggctacttctgcgcaagggtgaggagccaatttttcggaccattcgacgcatacgtcgtgcacgcgcgccgcctgccctgccctgccaggccaggcaagcgcgcgtgtgtgttccccctcttttctccaccacacatgcttgaagtggctaggagggcatcctcccttttaagaaggtccccctctcctagaataagtaaggtggtactaaactccacatgcatgccatcccatgagatgggcttttgtgatttttcaaagaattaatcttcgaatgggccttagcccatctattaattccaacaatcccccaccaaatctcaaaatcccattgagattttccttttccaatgtactgtttatataccagcggttcgatggagaccgattaaggttgaacatccacctagaactccaagctacacttactcacaacttgaacaatggactacgccttgaattgcaagtcttgtgcaagcaagtttcactcagagtcttatctggtactagactgtttgtagactactcctcgggtggagcgtataagtcatactcctaggtctttcgtaagcttcctagaagattcacccaaaatcttcatagactgcgaccaacagtcaagcttacaaaggtaagttctttcaagaatgctctgtaggacatcatcttcgctaattaaagccaacagaactcattaaggcatagccaacctgccttgcagctcacgagagtacatacatcttcacttagaaagggtatagattggtactctcctctagtttactaatggtttgttcttcccaggttctaattcacgggatctccgatcacatagataagtttaccaccatagtataactcacatgggtctcaaacccatctccttcgatgcatt

SEQ ID NO: 69200 - DNA, 5025 bp, Oryza sativa
  unsure (1)..(5025): unsure at all n locations
ttgtcaaatttctcatgccattgcttaggagcttgtttcagaccatacaaagacttcaacaatttacacactttgtcttcttgaccttcaactacaaacccatcaggttgatccatatagatctcctcatccagctcttcattaagaaaagttgtcttaacgtccatttgatgaatgagaagaccatgtgaggctgctagggaaagtagcacacgaattgtggtcaatctagcaacaggtgagtaagtgtcaaagaaatcttcgccttcgttggttttcttgagnaaggtataagaccccttagcaacaagccgagccttgtacttttcaatagtaccgtcaggcctgagcttcttcttgaacacccacttgcaccccacaggtttacacccatagggtcgctctgtcacctcccaagtcccgttagcgataatggaatccatttcactacggacatcctccttccagtagtctgcatcaggagatgcgtatgcttatgaaattgactaaggagtgtcatccacgaggtacacagtgaaatcatcaccaaaagacttagccgtcatttgtcttttgctcctttgaggaggttcactgtcatcctcctcagtaacatgttcatgtgtatgttcagtttgttctggtggtgtgattgaactgggaattatttcagagggttggctagaactactatgtgtatccttcattgggaaaaagctctcaaagaaggtagcatcacgagactccataattgtaccaacatgcatgtcaggtacctcagatttgactattaaaaatctataggcaatgctgtggtgagcatatctcagaaagacacagtccatagtcttaggtccaagtttgcgcttcttcgttattggtacattgactttcgccaagcacccccatgtgcgcaagtaagaaagtgatggttttctcccaaatccatatctcatatggtgttttgtcctcatttctattaggaactctgtttaacacatgattcaaggtcaacaatgcctccccccaccatgccttaggtaatcccgcggtgtccaacatggcattcaccaagtcggtcagtgtgcggttcttcctttcagcaatcccattagactcgggagaataggggggcgtcctctcatgtataatgccatgttcctcacagaataagtcaaactcgtttgaaaaaaactctctaccacgatcagacctaagtctttttatctttctgtcaagttgattttcaacttctgccttataaattttaaaatagtctagagcctcgtctttcgttttcaacaagtacacatagcaaaatctagtagcatcatcaatcaacgtcataaaatatcgttttccacccttcgtcaacaccccattcatttcacagagatctgagtgtaggagttctagaggtgccaagtttctctcctcagcagccttgtgaggcttgcgaggttgctttgattgcacacaactatggaacttagaacctttgacaatggaaaacttagaaattaaacacatgctggaaagccgagacatcaagccaaaattaatatgacataaacgtgagtgccatacattagccttatcatccacactgccacaaatatggttcacagacttattgcaaaaatcagaaagggaaaagcggaataggcctccgcactcataacctttaccaataaaatatccatgtttagacacgactactttattagactaaaaaaccaacttaaatccgtctctagtcagacgggagccactaacaagattcctgtcgatagaaggtacatgctacacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcaacacaaacatgtacattggcccctgtatcaacccaccaattagtagactgattaactgaaaaaatagtaggtaaattaccatacccgcttccatctccagtgttgccaatggtcacattagcagacttagaggtctgtcctgcaggtgccttcatccccttgcgttgtggacacttcctggccagatggccaggttgaccacacacaaagcaagtcctctcatcctgattaggattgttgtttttcttcttcttattgaagttggtggtctgctgagctttgtatttccccttgctcttgttttgggccttgtgcacaacattggtactggactgcccaccatcgcccttagacgcgacatctttttcccgagctttgtcctcaacatcaagagacgctatcaacccctcaacgaagtattcctgtctcttgtgtttgagtgcagtaccgaaacctctccaagatggagatagtttcgcaataatgcacccggccacaaatttgtcaggtaagacacacttaaggagtttgagttccttagccatggtttgtatcttatgagcctgttcgactacagaacggttgtcagccatcttgtagacatgaaactgctccatgatatacagatcattactagcatcagtagcaccaaatttagtattcagtgcatcccacaactccgtagcgtcggtcatatgcatatacacctcgaccagacgatcgccaagcacgctaagaatgcatcccacaaaaagagtagtggcctcatcgaattctttctgctgatcagcattaagaacgcccataggcttgccagtacttacccagaagcatttcatagctgtcagccacagattgaccctgatctgccatctcttaaagtgcacactggtaaatttatccggcctcagtgcatcggcaaaaccagccatagtaaaatcacagcgtctataataaggtttttggaatgttgcgaatataggcatataatgatttaatatattccataaataaatcatgacattacagatgtatactagcattaacgcatcattagatctacacatgtaaactaagtagtaaaatatgaacagatcaaatatgcgcaacatgtcgaacacgtaccgaggtggcggaaagaccggttgctcggcatgaactacttgcggttgcgagcgtcgacgaaggcgtgcagcacgcgagcggagaggaaggcgaaccgtcgcggttgaacagggagcagtcgcacgaagcgcttcccaaaaaccttattgccgccttctcccggtgcaggacgtcgaaggcagaggttccggagacctgctctcccgatcgccggtgcacgctggcgagcgggatggagtagtccacgagcgacggcgcaacacagaggaggaggcaaaccctagattgatttcgcgtgtgttgcgtgaaggcggtggcacggtttatatagagataggtcacttgatcagggcgcccgcacgatctccactctgcataaccgagccggataagtcgcgcgtaacttatccggactccacgccgttttcacacaccggattttttggaatgttttcaacaacaaaacaaatccgaattttcttgccagcaaaacaaaactgtaaaaggaggctacatctgcgcaagggtgaggagccaatttttcggaccattcgacacgtacatcatgcacacgcgccgcctgccaagcgaggcaatcgagcgcgcgcgtgttgcccctcttctctccaccacacatgcttcaagtggctaggagggcatcctctcttttaaggaggtccccctctcctagaataagcaaggtggtactaaactccacatacatgccatcccatgaggttggcttttgtgattttccaaagaattaattttcgaatgggccttagcccatctattaattccaacagtgaacaatttctttcagcttgttactgagtttcaagaacacactaaaatccactaggccagatagttcatctaagatatcgcccttgtaatagtgaagcacatcttttgttaattctctaagacttctaataacatgggcttttctagtgaagttgtcatcattcagcagggtgtcttccactgactcagtgaatgcactgtcatgaaccccttttaaactctgatacctgatattgctacctgactcattatacgtctagcaataggacgggacgattccatcttgagaaacttagggtgcacaaggtccaagatgttaaacacttccgaaacgtggttctggaaaagtgtaccagacaggaccactttgcgtggtgtctttttagtgatgccagtacatctgtctcccgatttcttggtgtatgaccctcgtctagtataagtaggttgggtaccataagcagcctgtcccagcacgcagctgcaatgtttccatctccatcaccacagatgattcgtgagaactgcttgtatccaagaaatagtatgctcatctgggcttcccaatatttgaggacttccagttgctctactcttttgtcagccttaacagaatagaaatcatatagtggtatgtcctccacttgccaccactgaaactccctcttccaagtacctaatttacaccctacttacacaccacttacaaatgtaaattagtatgtaattttgggacttacatatgtaattttttctgacatcaccctgctcgccaacatagatccagcccttcctattgagaactctaccttgtatcaccggttcgctgtagagtgcctagttgattttttccaaaacctgttttcaagctcttcaatttaaagaaggtaagcaatttctgcaacgtgttcttctcgtagcatatgtaattttaggacttacatatgtaagtttgggacttacattgaaaacactaaaaatacatatgtaatttagggacttacaatgtaaatacatgccgactaatttttgttaaaaaatatggcgccataatatagctactcccaatccctttcggaagcactacaaggggccttgcagaaggatactttgctaagaagctttgaatgaaacttatgagcata

SEQ ID NO: 69201 - DNA, 14750 bp, Oryza sativa
  unsure (1)..(14750): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaatcctacccgagtacactttctttggtatgctaaatctttttttctttgaaaaagtaaattgtattcacggtacaagaatttatcgggtgggtgcgcttcagtataaacacttgaaatttgagtagtgaatcaacttactagatggtgcattttcagtcaaagtgcaagtctcgttggatttttttgccacatcagcggcacattggcactgattaaacaccaccaatctctaaatttcagccaaataccaaccattcaccatctcaccagcatccactatccacatatcgtgagagccatctcccccttccttaaactgatcagcaacaaatccaccggtgtgtctccattgattaacatagtaaattatcggtgcatacttgctaaactaacaaataaacgcttaaaaaacaatgcaaacatgtccaccttcatcatggcctcggttcatgtgatgatccctatgcagttagtaacatgtagacatcaaagccacaaagcatatagggattaaaacctgaccgaaaatgtcgtgtggcttccacttgcccgctggggcaaagaaaatcccacagggctttcactacaattgaaaatgcaccgcctagttaagttggtgtactttaacgcttaaattttaagttcttgcactaaactgcacacacctaacaatttgttgtaccgtgaatgtaatttactctttttcaaacatttaatttggatgagagcgcgaacctgtaactgctctaaactacaagtctgaactcatgcaaagagaaagtgagataacatgagagttgtggcgccacaaatatagcaacgccgtttaataaaataaaattgttgttgtttgtgtatttgaggtaattaccaagtagatgacatggttaaaataagttgtagtagcctccagaacttgctcttaataatcattgttccctagctgtagggtatgtagggcatataaaaccacaattaatattgagctcttagagttgttaacaaaatactccccctatcggagtaagttgatcgagatggaagagagatgggaaatgaaacaaaaggatcgttgttaagcttagcaatagctcaatatcgactcttagcgcttataaaatagagatggaaaaatggaaagaaattaatacgtagaaaattattttggtacactaattacagcttttgtcttcttaaccattataaaaagataatttctaaataaactaagagcctacataccgagctatatctttaaatatgcccttagagcatctccaacagcctctctattttactctccaagctaaattttagctattccagcttaaaaaagtcatccaacagcctctccaaccggatggccaagccccatccggctggccaaaaccctccctccactagccaaatttggctagccaaaagtcgctagccaactatgggccccacacacattcctccttccatctcctcttcggctccttgcatcggcttgcttgctatgtcctggtgtcgacgacggcacaaaggaagaggcgtcgaagcagcgactgccgccgtctccgcgccgttgcccgccgtgaccacgccgttgctcgcgctgtcctccgcgaccgccgccaccaacgagaagcagaaaaaaagcaacataagggaggggagcgtggagcggacgaggccaacgaggagtgaatccggcgtcgccattgcctaagcaggagcccgttgtgcgtcgctgtcatccccgcgtcgccgttgcagcaccaatcccgcacccacacagaggagcgccatcaccactgtcgtcgtcaaggtcgccatcgccatccaccactgctgctgaggtctccgtcgccagccgtcgctgtcgtcgtctgctacgtcgccattcgctgccatcgtcactgaggtcgccaagtctagaggcctctagccaagcacggcgtccgcccccgccagattcgctcggctctgcccccactggattcggggtgggggcacgacctctgccgcctccatgcggcctccggccccgcacggcctccggccccgcacggcctccgcctccgttccatgggtcatcgtcgaggccgtcattgccaaggtcgccgttgcgagccgccgccgtcagcctctgcatgatcgtcgtcgcgcacttgcacgggaagagggccgtgagaagaggaagagggagaaaaagaggaggaagaaggggtagtagaagctgacgtgtgggtcccagtgtcataggctcgtaatggagagtattgatggagagcctattggagtgaggaatgagtttgggttaccaaatcaattggaaagctgactatataagtgtttggagagtccgatttggagaggctattggagatgctgttacatggagcaaatcttgctaatcaaacaaatccaatatatccatggttgcatctttggcgaccacaaggcctgctagtttcttcttgtgctggaatcttgatctatgttcaaaaaggttttcttgctagtgaggctagctagctttgcttagtcaaaatgtacgacaagcatgcaatcatcaatttctaacgctggtcttatgtgctaattaactttgctcgtttgctactctacttcgattctacttaagttgtagctaggcagaaggactttggtccatattttctcttttttttgtagagtttgaatatttttgtatttagttgtaaatgtttatcttatatattttttagtatatgttagaacaatttattagttgaccctttttatctaaaatatagaagtgagtgtgtttaaatagagaagagtataaatttcacaaaaatacatatactttgatgaaactatcacaaaactacatattttaaaaaggtgtatcacaaaactgtagatttaggatgaaagatcactgactatacatttaataatacaattatcacaaaactacaaatttagcttcatgtttagtactaaactacaacatttgtaaccgtaacatagcagtagtggtaaggattattaaactatagaatctgtagttttatttttatgataactctggtattaaatctaatattcgattttaaatatgcagttttgtgatagattttatattaaatatatagttttgttttgtaacactttcaatatgtagttttgtgataatttagttaaactacccgtagttttgtgaaatttactcaatagagaataaggggaatgataataagaatggttagattttcacttaatgttgagaaaaactgaccaaaattcatctaaaaattggacaatcccattaagtaaacctattcgatttttcacacccagttcatgctctcaaaaactcccatttcatgggtgataactgataagtaaagtacctttttttttcttttcttctttgataatcaagcaggtgtactcaataagaacaggttttgcacgacacacattgatcagctcacctcttcatcctcctgcacgcgagaatggccatggcgacgccaatggctccccgctccacgttcgccatcttcctcatcctcctgctccgttccggccactctccggcggccgcgttctatctcccgggcagctacccgcaccgctaccgccccggcgaggcgctggccgcgaaggtgaactccctcacctcgccgtcgtccaagctccccttcccctactactccctcccgttctgcgcgccgcagggcggcgtcaaccgcgccgccgagagcctcggcgagctcctcctcggcgaccgcatcgagacctcgccgtaccgcttctccatgctcaagaatgccaccgccttcctctgccgcaccgacccgcttccccccgccaccgccgacctcctcatgttccgcatcgacgacgcctaccacgtcaacctcctcctcgacacgctccccgtcgtccggtatgtcaagaacctggccgcgccaggggtgttcgtccggtctaccggcttccccgtcggcgtgcgcgccgacgacggcgagtactacgtgtacaaccacctcaagctcaccgtgctggtcaacaagccgcggaacggcaccaccagggcggaggccctgatggcgaccgccgacgccgtcgagctcatcagcttcgccggcgggagcaaggacggcggcgggtacaccgtcgtcgggttcgaggtcgttccgtgcagcgtggagcacgatgcggcggcgatcaagggcaagaagatgtacgacgagctgccggcgagggcggccgccgggtgcgacccttcggtggtcggcatgcgcgtgcgggccaaccggccgctcgtcttctcctacgaggtggcgttcgtggagagcggcgtcgagtggccgtcgcggtgggacgcgtacctggagatgggcggcgccaaggtgcactggttctccatcctcaactccatcgtggtggtggcgttcctcgccgccatcctgctcgtcatcctgctgcgcaccgtgcggcgcgacctcgcgcagtacgacgagcacggcggcgaggcggggttggcgccgcaggcggacgagctcgccgggtggaagctcgtcgccggggacgtgttccgggagcccgcccacccggtgctcctctgcgtgatggtcggcgacggggtgcgcatcctggccatggccgtcgccaccatcctcttcgcggcgctcgggttcatgtcgccggcgtcgcgcggcgcgctcgtgacgggcatgctcggcatctacctcctcctcggcttcgcggcggggtacgccgccgtgcggctctggaagacggtgcggcacggggacagcgccgggtggaagcgcgtggcgtggcgcgcctcctgcgccttccccggcgcgggcttcgccgtcttcaccgcgctcaactgcgtgctctggtacaacggcagcacgggcgccgtgccgttcctgctcttcgccgtgatcctcctcctctgggcgttcgtctccgtgccgctcaccctcgccggcgggctggtggcatcccgcgtcgggcacctcgagtacccggtgaagacgaacaagatcgcgaggcaggtgccggcggcgcagtgctcgccgtgggtgttcgtggcggtggcggggacgctgccgttcgggacgctgttcatcgagctgctgttcatcatgtcgagcctgtggctggggagggtgtactacgtgttcgggttcctgctggtggtgatggcgctgctggtggccgtgtgcggcgaggtgtcggtggtgctcacctacatggggctctgcgtggaggactggaggtggtggtggcgcgccttcttcgcctcgggctccgtcgcggcctacaccctcggctacgccgtctactacctcgtcttcgacctgcacagcctcagcggcccggtctccgccgcgctctacgtcggctactcgctgctcatggcgctcgccgtcatgctcgccaccggcgccgtcgggctcgccgcctccttcgccttcgtctactacctcttctccgccgtcaagctcgactgatccatggcgtcatcgtccgcactgtccacgtcatttcattatgtaggtgatctatgcgttttattactacatgataataagattattattttttgttcctcgttttggtgttttccattttgtacttcatgagtatacaccgtagtagtactagatagaaacgagtttgagtttggtttaaaggagcactattacaagatttcactttgtatttatatctgcacgtgtcagctgtttgacttccactgcctttgcttaagatctatccatgtgtcaagtgtgactacacatagctttgcttaagctttattcaacctgtcaactttactaggtctacgggaaccttttcgtgagacgagagataggcaaacaatttgctaggtcttctcatcgttcagagaacttctgtttaaacttactggttagaaaccagatccagccattctgtgtatgaagagactcactagtttggatttggcttataagccaaatgcagttttcaattttagaactagtttagggtttagtgttacaaccgctaagtataaaagcttaatcctagaattatttcaagttcaaacaagcagagggattcgagacgcaagacgaatgcaacctgctgatgcaaagatcacagggagatcacagggcatccatcgcagcttcacattacttcagaaagacaagttgacacaaaaacactagatgagacgtaccatggaaataaataactttcctccagagaattgaacaaaacaacagggaatgaaaaatgtgaaatgccgcaatgtaaacaagatagaacctactgcctacagccaggggcatcggaacccacgatttcgcgtgctgtttgccgcggccaacggggttatgctctcctagcatatatacaactaggttatcaaactcaagcggctgtaaaaggtacataacatagataacatagatagatagaaggcacatatggtattaatacttattcttagctcccagccccattgacttgggtcgcctcaccgcagtcaaggggttgacgatgccctggccatccttccccaggccagagccctcaacgaaccccatcctcgccatcatcttggatccaaagccctttgtatgcctctcaaaggaaccaacgccaccaatctccactttcctcaaattccgccatggttctgaccttgctttggttggtggttctgaccttgccttgattgcctcagcctcgctgtcaaattctactcccagtccaagagatttgggacgttgaattggctggatgggctgcatcatgccttggccatctttgcccaggccagttccctcaatgaatcccatcttagccatcatcttagaaccaaagcccttggtgtgcatctcaaaggttcccagcttgacagagtcgctttcaacaattttctcacatgagacttcaccactggttgtggcaactgcaattgtctcagtaacagattccgccatagtgccacaggagacaaaagatacaggacgttcagcaaatgatacttgtttcttggaagatttctttccactggaagtctgattccttgccaactttcctggagctgagaggcccttcacttgggctggacgtttagagttctcccaattgacagtaaagtcctcaggctcagttcccaagagctgaaatatagaagaaaagcaatttagacagaagattggaacaattaacactggcaaggagataacatgattgcaataaaacaaaatatcaagaccaattatgccaaataaaatgttttttggtgaatatcaagacaaaaaaatgatgtacaatgttttatgttatatgtagaaatactacagtactgagattcgacatagtttattactccctctgtttcatattataagtcactttagatttgtcctaagtcaaaccttttaaagtttaaccaagtttgtagaaaaacataccaacatttacgacatcaaattagtttcattaaatccatcattggatatatttttatagtatatttattttgtgttgaaaatactgctatatttgtctaacttggtcaaacttgacgatatttggcttaggacaaacccaaagtgactataatattaaaccgaggggcataaaaaaaggaaaaatgtgatgtgaattcatgaagggctgaacgaatcaaagcacttcaaaattgaacagagtggcgactaacaatatgagcagtgtatacacaccttttcaagtcggatttggccctcagaagatggtaaagaagaatccgcggttaatgtcacagtgacaaatctgcaagacagaattattgactttacggcaagaatgttgtattagcatttgactcaacgcagctgcattcagcagatcaaagaatttccatatgatttttttttacttacacaaaataattagaatgcaagttaattgaaatttggggtatccatttaatttgcaacctcaccaactaaatttttaatatagtgcaaaaccacatatgatgtcaattttctcatatggacatgggcttgactagccaacataaactgattttaaacaagaaaaagattgcaactaccattatctccattacatgtcataattgatataaaataggtaaacagcaggtaagtatagaaagcataaaaatgcaatgctacaagatggttgggaggtgcaatgtcctgcatacaactaacacataaccatcttggtatagataaccaggttatggcagttgctatatgcgcagacacatcgcttacgcgatgaacacgacaaggaaacacgtcattgtcttacgtctctcgtatcagtgcccatgcataacaggggagtggttaataagccactgcaccctttaccactgtccataaaggacagatggtttgttgcaggaggtcatgcaccttcctaccttaaagagtaaaataaaatagcgaatataaaacaagagcaatttgagtgggtaagtcggttaggaactaaggatggatctgtaacagtcagagcagtcggggtatagggaaagaacaagatcctacaccagtaaggcattacttaatacaacgacaattatgtaaagattttagtttgagccctagcaatgcaaaaattccaggcacattgaaatgacatgaactcgcatgcataatgatgatgtttggtatcactcaccgcgctgcaacataagcatacctcaaggagttaaggaaactaactaacatgcctatcatcatcgaagagatgggaaaaatgactcatcattatgacatgttgtatcaaaccaatgtgtccgtggcaagattcaacatgacatgggagtgctactaggatcggtaaatttactcatatggcacttaccttttctttcctgaaccttgacacccactcttcaagtgataaatagatgcaaggcgttgaacctacaaatttaacaacaataatggcacaattagcatgcgcttgaatacaaatgctttaacaagcaatacaaacaatcaatgatagacagacatgcatctaatacctgcgaacagtctcgagtgtgcattggttggaagcataccatatcaacctgatctacgaccatcttcctcaatttctgcacataagaaacagaaccaggccacacatcattttatactaacaaggaatggggaagggaaaataaccaagtaccatccaacaacagaaagcataagaaatcctatgcgagtatgaaagctcaaagtttacccataaccagcttgattaagaaaaccaacataaaggaaaacagacagcataagaagagctacagtggatatgaaactctctctagggatgtgcatttctccatattgtgcacatcttatcttgtacctccactttaacaaacagagtacaaaactgaatccagatagcaccacactaacatcctccggtttaaaactcaatggacagaatcacattgcatagaccctgagtttcaaaatgtaaaaggtctcttcacataatgttgtattactactattttcttgcatttatcactgaactttgtacaatccctaatatctttataccatatcatagacattaatgactgtgtgcttgccttttttttcaggggattgagctggagaattagaaaataactagactcctgctatgatgatttagaatcatacgggcataactttcagaataaggtcacttcatgtgaaagcaactataagactcacagtattaatttgatctaaatcaactcctctgcctagcattcgttggcggcgcttctttgcaatgagttccttccgatgcttctttttctcacctgaatcacatacaaaaaattttacaaacccatcgcaatataggttaaatataatgagaacatgaacatttgagcaggcacacaaacataatataattgtaacatacgtgaacaaagaagagcattaatgtaaacagtggccgagcaactttttaagaagctgaactttccaaggataatcatattccctgcagacttttcaatttgaaaggtctacattgagttacttctccatatggagacggacaatcataatgtaacacaacaagctagttgcgccaatgtattaaaaaggtacacaatagataatcactgatcaacctagtgctatttttctaaaatcaatacacaccatctgccatgagcccatgacttctattaaaaagagagtggaaattgggcaatacttatcagctattatctcaaattctctgtaaagtggaaacaatagcatacaaccagacttactttatgccatctttatgaaacaaaaaatttaaaagctttaaaacaaatcaaacctaaatgttattaacatacacaaacaactagtaagaacattccatgattaatggaagcttggcagtcttagcactacgacttttcaattcaagatacatagtgagatgtgcttgcccgctgattgttctaattttcccatatttgacaatggataacataaaagaaaaaacaacagaaaacagtgaaggcattttacctggtacactctgatacttcttgctcttcctaccctcattaggccaggacctggagaggtgagaagatgatgaagccacctttgctccctttcttaatctgtttgccatgcgtacatcctttaccatcatcacagcatccagacccatcactcgcatacttgccaggtcccggtcacaagccctgacagcagtgccctttcccttcaaccgatctgctgagctcggcctcttcatcccatactgctcggatgcattcatcaaggcataaccctcaagctgtcccttcaccttcttcaagaacccatcctcatcctcatctgtatccatctcatcgtcatcatctgaatcgaccaaattcattccagccacccacttgctgcttaacagctcctcactcccgccgatcccctccatgtaatcggcaacaacctcatcatcaactgatgaatcaccaatgctcaagtcttcctctgaatctgatccagacaactcttcatcagactccgaaccaccttcgttgacatcactgccttcctcgtcactatcaccatcatcattgccatctctcccctcataatctgattccgattcctcatcagagtcacccacccccgactctggcgatgagatgtcctccgtgtagatccgaattcccccaatggacaaaaatccctcgttgcgcttgcccttaggcttctccttcggcttcctcggcgtcactaaggtggcctcctccaactccacctcttcgttgctgcaaccccggaatcccaatccgagatgcagcccagcctcaccagcctcctcctcctcatcctcctcctcgccgtgaaaccccagcccgatcccgccaaccgggccgtacgagtacaccgggacggaggcggaggccgggtcggcgcagggggcggtgtcgatggtgacatccagcacctgagtcgccccctcgaaggaggcggaggggcggagcgcggcgtagctgaaggggacggcgtgggaggacgagtcggacgcggagttcgacgacccgcctccgccgccgccgcggcgcccgcccctccccccgcggccgcggccgcccgaggaggacgaggagaacgcggcggcgacggaggccggggagacgaaggaggggagctcggggacggggcggcggcgcccggccccggcgccgtgccgcggcccgccggcggtcgggttgctgcgcgcgtggcggcgcttgccgccggccatgctagggttccggcctgcctcgagattcgtgcggcggcgagcggagggagggagggggggacccaccttccgttcctgcgtgcgggggtggggtgcggtgcggtgcgcggggcgacgcgtgcaagagggcaaatcgcgtatttgtagctggccgcgtgcgggatcgggagacgagaggcggagggggccgtgccgccggggtgtgtttctctgggtttcgtagcggccaagtcgatttctatgacttccccgccgggggggacgcggatatgccgttttccgagatgcgatgcgatgcgatacggtgtggccggagggaattgggtgtggagcgatggacggtgcagatcaccgatcgatcgggtttcgtgagcacgaggcggtgcaggtggtgcactggtgcccccagtcccaatacaaccacaccggtcggccatcccattaattgttgattgcagggaaaggaataagtccattttagatctcttaacttgaaagtgagtttgattttcgtcattgaaccgaaataactatataataggtccattaaccgttaaaacaaacacaatataggtcccgaattttttatttataataaataattacccttaaattaaacaattagtaaatcgttggggggatttataggagtaggatggacgctaatatagaaagcgtccataattggacgccgttgtaaacaacgtccatacttggacgctgttggaaccagcgtccacctccctggtgcagccaagccacgaatagagtgagaacaatcaaaagaaaaccctgacaatcaaaagaaaaccctaactctagcgatgagcgctcgatcgcgcatgccggcaaccggccacgcatcgtcgtaactcatatacgagttcaccctctctacgactttgatccatccgcttcgtcgtccaagccactctcgtcgtcgacgccggggccttcgatttgtccgtgttttacggcgccaccaatcctgcaatccagccacggcgccgtgtgcattggcagctctctcgtcgtgagcaataggtttgccctgcaatttatatcatgcatgcatgtcttttcacttatagcatgtctctgctcaccctcatctaattagcattaattgatatgtactacattgttcatacctatacttgatatatgacattagtgttttattgaatatatgtatagattattatccaactagtagacatataccatgcctttgttaattgttgagttcgtttggaagacacaaccaggaaataaaatgactattgttcattgacatttttaataagcaaaacaacattttttaaaacttgaaaggatatatcagcagattattatctaacttaaagttaattatataacttgttttgctaacttgtttagtttgttttgcagagttgactgagaaaaaatgattattgttctagtatatgttgatgggagaatacaatatggagctaagggtgcagaatataatattcctccaaaaataacttttccggcagtggaggctacgacctttgaggaagtcaaaaaagaaatttttcaggcccttggatacattgaggatcattgtgcaatgaatatccaagctcggtttgatatcggaaatcctgggccacaatattttcaattgattcctatttatgaagacaggggatggaggatgatatttgagaagacatgtgggcaggttgttgagctttatgttgaatgcgcctatacggaagcaagattaagtcaggttaatagtacaaccttggttgcatcaactaggcattcggaaaggaatggctcaggtgtttctttggagccaggtacagttcattcacaagcaaaggttgtacccactttagcagatggtatgcattcaacagttcagttgtcttcacctatcaaccaggataatgtggtttccgaaacacaaccaactatagatgatgacaatactgcagaagacacatatgttggtgaggagacatatgttggtgaggatagatttggactagacgatgacaacaagcaggattgtgatggtgcccttaataatagttcagatgatgagcccccataaccacgagttgttcattctgtcaatgcatttccttttatgcgtgcatctggacaaaatcctataaaagcatttaatgatatatctgtgttgaaggagacaacagcatacgagagtttctttggacgtaagaatcaattttctaacccactaacagaaggaaagtcttttgattcaaaagagcacctacaaattgctataggtgagtttcatatatgtaaaaattcagaaatcaagtatagcacaagtagtcagtctaaacttgtagctgaatgcacgaataatagctgcatgtggaggctctatgcaactcccacaaagataggttcaggttggatgataaggaaatgtccctatgctcacacctgtcgagcaccggctgatagatttgatcatgctcagttatcatcttctatgattgctaatgtgatacgtgatgcattaagggatgatctggaattgagtataaaaaatgtgaggtcactagtccaacagagatatagaaatgtgaagccatcttatagtaaattatggcgaggcagagataaggcaatagcacaactttttggtagttgggaaggttcatatggcctcctcatccctttcttacaagctataaaagctaaaaacccaggtacaaagtatgtccttttgtcaaagccaacgactcaggaaggacggcgagcat

SEQ ID NO: 69202 - DNA, 17762 bp, Oryza sativa
aagataaagatgagcaagaaaagcccgagaaggtatttcaatgcaaggatggaggatattgttggggaatgatgacaagcaatggatctgagtcattgaacaatgtgtttaagttttctcggaggttaccggtggcagccattgtggaggaaacattttcaaagtgcttagaatggtttgttgagagaaggcgaaatgttgttaatttacttaacaatggcaagcaatggtctcaaagggttgataagctattagtgaagcgaggaaataaggctggacatatgaatgtaatctcgtatggagatgaagttggaatatatgaggtaaaggtcgacaagagttagtcccaatgcaacaaggaaaccatgaggtttacacactgagggacttcaagtataagatagttttgcaacccaacaacacaccatcttgtgattgtcaaaagccaaatttgacaggtgttccatgtgctcatgtcttggcagtttgcaaacatagaaatcttaatgaaaatcagttgatcaatccattctactcttctcaagcacttgctattacctgggctggacaatttcttccttatggaaatcaaattgaatggccaccatttactggtccaataattgttcctgatcctagacagataaatctaggccgtcgtcagcataacaggataccaatgtacatggatgaaatgtaaggaagacgacttggacaccaggcacacccgttccacaagagatagcgacaatttaggtagcaaacaatgggaattatatgcattataattgttagttaacttttacttgatatatgactctctttgattgttttgtaggtgcaacgtcgagcagaacacatgttgatggaccctctggcaccatatagttttacgcatcgtgtagtctatctataaattacagtgtcaatttagcttatagttgtccaggaataggacattcttctggttggctttgaacatgaatggagctcaacgaacattgtttttgaagtatttatttgagagtacagacagttcaatttgaattaccttatcaatttttcgtatgatttgatttacacaatagaattgctgctgtactgctatttgtaggatgtatctgagcacatgtttaaacaaggatttgttccctacagcacacacatatcgtggcaataaactgaagtaaatagcatgcgctcattcaaatgggatgtaagttggcaacataaaaatccattaatatagtaagtcagtacaaagtaaagtaacacgccattcaaccactgacagcgtgaccatattttacatagtatagcacccatataagacagtggtcgaaaagaacatatatgtcaacaggaatatatggtcttcctaacttggagtggctgatttccagttaacatatatgtagaacatatagctccaaaagttctacaaaattatatccaacagaatatatggtcttcctaacttggagtgttctttttgaacataggagtcctctcagtactagtccaatcaaccacttggatagaactttttgaatgacttgacgttctttcaccaggatgcagtggagctgatgcttctcttgaagccacctgtcatgtcacccaatagtatatcatatattaaatacattacaaagttaatttgcatacacacaagtgttagaattttaccagatcttcattttccaaacattgagtcacttggcttgcatcttgtgttgtgggaactctattagtagtttccacacctagatcaatatatctactaaaacattttcctgagatcatccactcatcaaatacatcaacggaactttcatttggaggacttggcgtgcaagcagtagtgccatcgtcatcagatggaatttcttcaaccttaattggtagttcagcctcagacaacatgttttgcaatttgtattccaagttaagatccctaatattcccctgacatgtgatcaatatagatttacctatcttcttgcatccattagtaatacaacatttgattccccatgctgcatttttaatctcacgcaatccctgcaattatgagttaaaatcagatctaggttgtcactgcaatataaagagtaattggaagaaatctataacttacaatgcgagctaggggtggaccactaggcatgtacccagtccactccatgttatctcgagggtatgggatagagttttcaagtcctcccaagcattgagaatcaaaaaacacagtgaacataccatttgcttggaaccaacatctatactccttcaagctagctgcgtcgaaaggacaatcctcttgaacgattgttgcttcaatcccatcatattgttgcacatatttggcatggaatttattccaatcgcacccttttcctcctacatgcttcactttgcgtagcttccgaagctcaacctcaccatgtggaggcggtggtgtaattaattgttttcttccaaactgtctcattaccctttctggataatggaactctacaacccaaaaatggatgagaggtagtctagcaaaccaccaagtacggtcattctgaatttggataggcatatgctctatgagaccttcatatggttgtcattgtacagtaccttctcgaatcaagtcaatttggtttcggtactattgagtgcctgtataatattagtataaaaagataagcatgttgacatatatgttgtttgttataagaatctacaatgagacataattcaaaagatatgtaaaacattaccacaattatgtggggtggggaattcatgataactacaccatttggccccaaatataggatagccatctgattcttttttttcttgctcctccacttcatccgtcttttgaattatattttttggacgacctaatggcaaccgtgaccatgaccacaattgtaacaatactagagggccaaaaatttctgatcttgccttctcagcaccattattcaactgcctgtataacatagcaagtacagctcctccccaattgtattcagtgcgggtcgctaaattatccataaattggaggtacattgcaggcacactatctccagatgaatcagtaaaaataatggagccaagaatttctaagacaagtgctcgactatgccaatcgatctcccgttgtgttgggttactgggcatggcacgaaagcgatcacgcaatttgctcagagttatggagtatcatgagtaactcagtgcaaatgtatcatcttcctttttcctctttttcttcttcatttcttgatcttctggtggaatcccaagatacctctcaatcatatcactccaatttccatcagattggcccacaattagttttccactgattggcaaaccccaaaggcaactgatatcttgcaaagtaattgtcatctcccctatcagtagatgaaagctatttgtctcaggccgctaacattctaccaaagcagatatcaaatatttgtcaattttgatactcctcatctttgcaatttgatagaaaccaatattttgtagagccgatcggcacaatgggtggtaagggattccaacgcgatggtgccgtatattcattgaactactaggctacatcaaagataaaaacaattactcatgggaacctagatgaatatatttacaaatcgacaagaaaccaaactaagtagacaactcacattttctgaaattttagatactttgttctgcccatgaggcatccatagtaaatcactgaaccgatcactatcagccattttttagctgcacaaaatgttaacaaccaataagctaaatcagtatttcaattctactgtgtgaataaatgtaatttcagttccgaagttggaactccaatgacaactctgatgtagtagacatatattttataaagatctctattatacattagacttattaggatgaacctatgttatatttttgaagccggttctttttttttagaagttgtgaagccggttcttgattcttcatctcctgtaattaccatccataaattgtgttccaaaatgtttattaaataggctacaacaaaataagttagttgaatcaccttgactgtaggagttctgggcttggacgtcaatggtggctgcaagcttccaagatgagaacagatgacagcacttggcaggagtcgaggcagacaacagctgcagcctccagggaagacagcaagctacggatggaagcggccgacggcagccacctctcagaacttcaaaagtcgattcaggcggtggcgtggtcttcctgaggtggtggacggcgacggcggactcccggcgtcgaggtggacgacggcggcggcggtggcggcggccctctgccttagcgctgccgcgccatttgcctcgtgggtagtccctacgctcagtcggaaggaggaacagactccagaggttgaggcggacggcggcggcggcagactcccggcgtcaatttggacggcggcagaggcaccctgccctagcgttgggggatttttcttttttcttttttcctaatcgcgatgattagcgccaggttatgaccgcaccaacctggacgtcgatccaattggcgtccacatctgtacgttaatggtaatagcgtccacatctggacgctgtttctagtagcggccatcttattttggtaaatgttatcctctaattactaataatttaatttaaataatattatttattattaataaaaaaattggatataggtcccatggtaatatagctgatgattctgttcgatgtggcaatttgatccaagtcaacagcgttgagtcagcgtgagccccacatgtcaaggcctcttcacttctctctcttcctcctcttgttcccatctcaccggggcaagcaggtgtgaggagaaggttgatggcaggtggtgaggaggatagtggtatgaaggggagagggatgtggtggagtcgaacgccatggaacgccggagtaggtggacagcagtcgacacgcagggttgattcctcgtggtacaactgtagtcaaggcagtgggcaaggaggtccgacaccttgggctttgtcgtcagccatcggtgctgtgaccacatattctcgagctccagcattgatgacacgctctttcatcgctccagcatgggcccacgcctcccggctgggacaccgacaacgcggcctggggagcatgcgacgtctggtagaaggactccccttggaacaacaccaagaggatgtgcatcgtggccaccgtcacgccccaaaagccacagtcaccgccacgccctgggtgggcgacgtcgagtgctatggcaggagagtggatgaccagacacattgcgtagagagggagcagtagttcaatgacgtgaacgaagatgatgacgtcgaggatgaggtggaggaggtcggcgacgcggcagccaccgccaacaggtagcgtgacgagatcggctttggcggagcgcgtggggcggcacgcagtggggtagagttgggcttgttgagggttggcatgagcagtgggcatgcggggtgggctagacctggtgtggtagccgtagtaatgcaagcccatcgatagggcagggaagaggaaggggaagggaccactagtggcgagggaagaggaaggggaccgccgagagtctctcccgctagctgacacccttctccctgctggtcgtcgtctgtcactgtcgagcttctacccgccacgcgcctctcccgccgaccgccgcaagcctgtccaattgttgttcgctcgctgcgccagcactacctactttgttcctcctttgcacgcgcggatgcagcgcccccagtgttgcatgcttgctttgtcacgccaccgttcgccggaacgcgccgctcatcactagctcctagccctggagccgttgagcgtggagtcctaaagagatgggaagagaggtgaggtagtggaaaaaatttaggccgctgataatggggtctatgttgacttagccatcacgtcagtaaaaaagggagactatactgctctagaacgtaaagtatgccggtattttaaattgagtgacgtgttatatgtattgttgtttagggacggaatttgaattggacgtcacgttaagggacctagaatgaacttattccgttgggaaagcccaccgtcctgtgtgtgggccatccctcccggcctttgttgcatctgaggctctgagcgtactactgtacagcccagcaacaggttagccccagactccaaagtccaaaccacttggcttgcagtcttgcagtactagtacgagacggtggcctggtggtgtggacctaccggctaccgcacctccaaggtcaacacgggcaggcagggtccccatgcccatgcccacatgacgatgggggtgtgggggtttacgcctcgcgcgcccatgcgctgcagcgccgctgcctctggcccttgagtccgcacgttagtaatgcgtgctgcagaggcgtgcacggtgcaccgcgcgcgcggagcagagcagcggaggggaagggaaaggcgacgcggacgagctcgatcacgagcgtctcgaggtctcgcgttgcttgccaatcaaaacgcaagcgccggctcggtgaaaaagatctgggcgcgatcaggcgagatggcgtgagggccttccgttggctgagtgccaaaaggtccggaagacgaaataagggcatctttagttaccaaacaaatttttcacgctgtcgcatcaaatgtttagacacatgtatataatattaaatatagacaaaaaaaagaaccaattacaaaattcgttagaaaattgcgaaacgaatcttttaagcctaactgcgctataatttgataatatagtgctacaataaacattcgctaatgacggattaattagacttaataaattcatctggtggttttctagcggaatctgtaatttattttgttattagaccaaattatcactaacctcaaactttgaccaaattatcactaaccattacaataaatcttgtgttaaatctatgtacatttttatagtttggtcaatatatccatagcttcgtgaaatttactcaaaaaaataatatatgttatgagactattgttatgcgatccgagatggctcatttgtaatcgaatttagaaacatatgttaatatgtcttaactcacacatatccaatatatttgttgacacaaatactccctccttcctaaatgttcgacgcagttgacttttttaaatatgcttgaccgttcatcttattcaaatttttttatgaaatatgtaaaactatatatatacataaaagtatatttaacaatgaatcaaatggtaggaaaagaaataataattacttaaatgttttaaataagacgaacggtcaaacatgtttaaaaaagttaacggcgtcaaacatttattaatggagggagtatatatttttatatgttacacactacccctagttatcgtactatactacataataatgccactcaaaaactgaaaaattttaatttgagatatattttcaaattttaatttgaaataggcaagaaatctttatcttagccaccttctgtccaggtgagctgtttaactcagtggcctgcgaaaatatatgtagtatcacaatcggctgagttaagagatccgtttagaataattattttttttctcacgcggttggatggtccacctgtgagaatctccaattggggggagatggggcgtctaaccgatttcggaaacgccttttcgctgtttgtgtagtagtactgtttagggttatcaactagccgagctcgagcgagcttgtctgcccaagctcgagctcgacacaagctcgagccgagcctgttgcaccttcgagcttttaggcaagctcggttcgagctcgagctctaccgagctcggccagccgagctcggccataagtagtataatatatattttaatgataatctcttgataagtttaatattttctagttaatcacactaataaaaagtagaaaaatgattcaaataaatatattgtgttaacacgtgctaatttattgtgtaaataaatattaatatatatatatatatttatctattagtttattatattaataaggtgaacatacaatataatctatatacaaacaagctcagtagaagctcgagctcggtttggtaaagctcgcgagtttttctcaggctcgggctcggctcgtttggagctcgagccgagctcgaatcgagcctagtatgagccaagctcaagctgctcgcgagcctcgagctttttttttttttttactgtgctagtactgtacatccctctcgcaaggcaacaaaaatcgattcatgaactaatgaattgcactcttgagaagataattctcactggaaaagaaggatatgctctacctatataaaaaaaaaactatgcagaggaggatgagtggatgacgatgatgcacggcatcattgagaagcgtgatattcattatgtggcataaggatttgggcggattgttggatatacacggatcaaccacgtacatatcctacttggcaacataataaaatgagagcgggagttgccaatgtcaccttctctgctggaaagtgtataggtcatgtcgcatgtgtaacttgtgatccggtggttgcagtttgcagtggaacagggctcgtgcctcaatttcttttctcgagggtaaattcacttgatcacggacaacagactttacactatctgtacatagtgatagtgtactgttacacgcacagaatatcccaagagatcgtattaattaagttattaacaataaatcaagattgctcgtcttgatcatctgatcaaatggaaagcttggacagaataatacacaaatatttgtcaaatcaactggatccctggtgcatcttaccaccctagtaagttgccttttatagttctgtcacaaaaaatatgttgtatatatattggcatcgatataatcttaaaaaacataattttgaccgctagttttgtattagtacacaatatttaatggctggcaaagttgtaatactacgagatgtacttatacagatggtcttcatgcgtccaatctacatattttaaaagagattagtgttcaaaagtttttaaaatttcatttcaaatatgttgagcacaacaagtttccacgaccgtgtgtacattacaaagtgctgagtaaataaataaatttgaaaaacaaaaggcacccatcatcccattcacccacctattgaggagaaaacaggacggcctgagaattccacttagctccagtgtatgttcaaatcttgctttttgggttcaggacgtgtcagttggtttgatcctgtaaccaacaagactaaacagtaaaatcaagttagaacaccatagccaatcggccgatgagccgatgacatatcgtatagccgatgttctctgatcgaatcggttgtaaggtataggatatataaaaataaacaagcctaaaatatgttccatcagctttagatgcaatcaaacatgtaatcactaattcaatctttctctgaagtgcaagcaaacggcatagattgaacctaatcgagatagtatggatcagatcagataaactaaagattacacgtttttatattatagccgatgatccaatacttaggttaagaaaggatattgtatcggctaatactacgatacagatataagaatatcaatctaggtaatactacgatatagctttacacaagaatatcaatctaggtaaatatatcgagaagaagatcgatatatttaaatagagtgatatacctatacaaggggtaggtatagcatgaaaaacatgattaaaagaaattaaatatagcaaaatagttacatcaaggaagatcggctgaaaccccaattctacccctattggtaatcaagaagcatgctagtttttatgattctaagtacgatttagtagatcaaacttaactgatgcaatactaagtatgaaaagaagcataaagtctaaacaattaagtttgtgactgatttttagtgtggcaaataccttagctaatctaaagtgacaaaacgatttagtcgataccaacaaaaccctagaaaaaggcctggttgatacaagtaaatagaatcatcaatttagattaactaggatatatgataaccagtagctgcaaaagatagattagaacatctaaaacgacatcctaatccgccaatgcaaaccactgtgacatgccatacctcttgccggaaaatcgaagccgatgccccaacttgaagcaagaactcgtcgagaaagtcgaaaagtaaaaagggggtgatgtgccaagagtttattgaactgttattttttttacaaggtcctgggcatgtatttataactgtagtacaaaacttgtccatatcggatacaattcaaactttacaaaaataaacacactagctcattgtgaactctaacataaatttctaaaatacataaaggaaaacggattgttttcaattgtcttcttcggactccgtccttattttgcaatatctttgaaaccttaatcttgagtttgatatgaactcaaattgcctatatcggctaaccgaatccgactctatatcggccaatacagttttctgctgatgcgccgttctgttttggaaaccacgttaattccttcaaatccgcttcggatctatccttatcttcacgtatcttactaaattttgccatcaacaccaccacgtaaaaagattacctttttattattatgtaatggatattacgtactccctccgtctaattttaagcgcagttgtgggtttcggtgtccaacgtttgactgtccgttttatttaaattgtttttatgattagtatttttattgttattagataataaaacatgaacaatattttatgtgtgatttttttaaattttttaataaatttttcaaataatacaaatggtcaaatgttggcacggagtacgtaactaaagttgacattttcttattactaattaatcatcaatctatatctaagaccaccagtttgaagaaacttcctgcccattaccaatatacgtgtgttttttattagtatcatattgggtccaaattgctggtcggtgaacacaaacatatgctccggacgtttaagagaaagcattatcgatatgtaatttcaaatactccctccgttctaaaatatacgaattagtaatttttgtttggatgggatgtgtcatagtcctacaaatctggacaggaggcttatccagatttatagtactagaatacgtcccatccaactaaaaaatactaaaattatattttaggacggatggagtatatattaattatgtataaatgttagttgtatgaactccataaatgtgatctgcttgtgctgataaaaaggtctgctcgtggggtcacatatgaatcgacaattctgttacaaattaatttaactataagtaacgttgcaaataaaagagcaccatgccggcttttatacaagtagaaacgtatggctagctgataaatgtcccatgttgaggtaattagcgaatataaccttacttccttttagggaaaggttggcgtaaatcaggcaaaaaccacagaagtgtgatggttctactgattggcactgccgtgccgtgtcggctcgtctggcatgtcaatggtgccacgttggatccacgtggcaattgaagtcacggcctggtcgctctaggacatgaagacaatgtgaacctgccacattgtatttgcataatgtacatatattgtaaatgattgatatttttgtaagataataaaaatggtttacatgtttgacctctgcctacaagcagacatgcatccattgtattttataattgaaaatgagagaaaaatatagtgatgggacaatttccctcttctctgagaagatgatcaccagaattaaaagctaatataaatcccgtaaattatagcgattaattcgataggtgctactccatccaaaattgtataaaatacccttggctaccaattttaaaagtgtagcatcaccacgcatagtatctcgtttctcccatgatagcatcaaatacaagtatagcgttgattggtagacatgaagataacatgcatatgattagctattttcttattatgaaaaatatcatttcggcaccaaattggccaacatatgttattgatttgatcatagatggtagtacatatatctagtacaaaccatttggtaatcatttaatcaacaaacaaagaaacaatattcttggacctttaccctgtttcctttaacgccatagcaaatctagctttgtttggaggatatcgagatttgaaaaacagatcgtgagtagccagtcaatgaggatttgtaaaaattggattttataacttataattttctatttttggaattgcaattcatcatggtggtcttagattgtgttcttttagaatggatgggacttgagaactttttccttccgcacgcaaaatgaagcggtatattaacacataattagttaagtattagttaaaaaaataaaattattaatatggtttttaaagcaacgttcatatagatttttttttaaaaaacacaccgtttaacatatcatgaaatgtgtgcacgaaaaatgagggagtgaaaaatagaaaattggagaaaaaaacataaccttaataggtggcaccaatcacaatacaaaaacacatggcattagtggtgaaaatggaacggaaatttttgagatttccagctgtcgttttcagtttgcaccgaccatttcaattggtatcgataactgatgatggtggaaatggaaacggtaatatcttctggaaatggtagtggaaatgtgatggagttttttccgaccattttgtcggtaaccgtatttgtacagtaattactatcaaaattctgaaagttcctcaatggctcagccagcccaactcatcggaagctcatgaataaaggaagcctggtaaacttgcagcccataaaaaaggcaagtggccagggaaaatgttgttaaccctacgatggcatggtaggatttattcgtcgtgccttgttcttttctgattaagattcagattttatctcgattttcgttagcacgctttttaagctactaaacagtgcgttttcgtgcgaaaactttctatatataagttgctttaaaagatcaaatatatcaatttattaagtttataataattaaacttaattaattatgtgttaatagttttctcgttttacgtgcgccaatttggaccttcttaataattctttcaattaaagtcttaataaaaataaaaatgctacgttactatatgaactcttcctggtatgacaaaattatgccataaggtcccatcaaatactcatgtatactacggctgtgttctcctcctcccggcacgcaaaacgaaactcgtattattgcatgattaattatgtcagggttacagataaggcataccctctatcccacgacttatggaatataccgataaggtatacctttatgtatatggttagtttccatatacgccgttaggaattcgcctcaaattatggaaaatatctccacgaagttaaggaattgcaaaagtcatactcggaaaagataaaatctctagtatatcgtgtcggtttacatatctccaagtcttacttgagggtcaaggtatcccacgatataaaagggacccctagggagaggcaaagggtatcgcatctcattgccaacacacctaccaaagtttacgaagccggagtccacgaagccaactcgccgggagatctcgtcgagtccctcgactacgatctcatcagcatcgtctattcggttactctctttgtaatctgttctcatcatcatcaatcccatgtaaattggactagggctattacctgataaggggcctgaaccagtataatccttgtcttttgtctgttttgatgtcgtactacgtagatccctgttccaacgtaccccaataccctattcttccggtccgcgagtatcactcatcgacaaattaagtattaactatttttaaaaaatggattaatatgatttttaaaacaactttcatatagaaagttttttcataaatcaactgtttagcagtttaaaaaatatgcgtgcggaaaacgagagagacgggttaggaaaatgggggaagaacacacacacagcctaaacggtgcattcgcccctgggtgattggagagtatgcacatcgtattccacgcgcacgcttcccaaactaccgtttacggtgtatttttttgcaaaaattttctataggaaagttgctttaaaaaatcatattaatccattttaaaatttaaaatagttaatatttaattaatcatgtgctaatggctcacctcgttttgcgtatcttcccaatccccttctcctcaaactgtgaatatgccacctacgagctatattgtattttctctctaaaatttaggtttatcatgcaaagagatctacagcgaatcaagaatgaaattgtcccaaaactttacaactaacttattccaaatattattagcccaagtataattcatttttaaaacataggtctttaccttgtatctagaaacaaacaactcattcagaaataggttgggtttgttgaaaacctttgtttttacctcaccaaagccaactgataaaaaaatcatttacaataaatagctaatcttcgtagttgatgtttcggttgcgacaaatccataattttcactttcttaccggagattgatccataagccgcactcccacttccttcctccctctctctccaaaaaaaaaaaaagaaaagcatcacgtaccgggcctacctgccattgaatgagtaggcgcaggagcagtacaaactcaaaagcgagaattcctcgcaatccacagacgaagacgagacgagacgtacccgcatcagactccaacagggcgagagacccgggcccacctggaagtgatgcgggtctaccaacccgagtgcgaagtggatccccgatgcctttacaccgagccggactgtgagagacggtgggtggggcccacatgtcagcgtgcgaggtctaccaacacccggtctacgcggcggccgagaagcgcccgtccctttcaggtttttttttcctcctcctcctcctccctataaatgcttctctcgcctctctcgcctctccctttccaagaaaccaccaatctctctctctctctctctttctctctcgctcgcggcggagaggaggagcagtctcccatctgcggcggccggcggcgtgcgtgcgtgcgggtggctggtgttgtggattccgtttccgatggacgacgcggtggagacggccgccgagattctggtcagcttccagaacaggaggctggtgcggtggccggagtgggttccgcggccggatgagaagggcgccgccgctgaggagaagaagttgccgggatggaaggaccggcggaagcggacttccaagtccaaaccgccgccggccattttggtgtgtggcctggagctgagggattccggcggggagaaggcggcgtcgattccggccccgctcccgccccccgcgaggaagaagatgttgttcaagatgaaggtcaaggacgagccgacggcggcgcgggggccggagacgccgccggagtacggggccggcgcgggatccggcgcgaatttcagccgggatggcgtggcgaggcctctgccgccacgcgcggtggtgaaggccgagccgacgccggcggcgcggatgcccgagtcgccgccgtactacgtcgcggcggccggatccgccccttccacggccggcggcgaccggcgtccgcgtcctcgccccgtcgagagggcgcacgtcaagacggtcctcgcggcggcgaaggaggccatggaggcgtctagcccagagacccctctggactacgccgccaccaccggatccggcgcgtcctccagcggcgacgagtcgtcgcggaagcggaaggcggcgccgggggcgggcggatccggcggcgcctcgtcgagcggcgacgaggggtgcagctcaccggagaagcggccgtgcctggtcgccggcggcggcgctcagaccgccgcagcggctaaagcagaggtgagtcccccccacttttttccccatttgtttttggcccttttacttttgtttccgtttggattcagaactcttgagctctttcttgtgccctgaaatcttctttcttccagtcccttcctcgtgcgattcgcttttatttttctcttcaagttccttcctcgggcgatttgcttgtgatctgtgttcttgcttgtgtgatgattctcgcaacgattttttgttaggaaatcagacgacaagttcccttttttgacttaaaattccaccttgatttgatttgtgtatgggagatgtgcctgcaacgatttttctgacgaaatccgtttgcttttcacctcttttgttcacttattatagaaaaaaatagtcgtactaccatagtgtttatctgtttaatctcaacagaaatttaaacatttactttggacccgtaaattcagcttatttgccaagatgaagcattttttaggtccgttcaaaaaagctcttcctttattttttcactatatcattttagtagtggtagttttccttgtctgttacgatttgtgtatatgtaataataggcaaaaaaaaagaagaaagttctacctgaaaaaagaaaaaaaagtatatcgcgttcgtttgtgtttgggtattcgatgcggactcgtggggcgtaaaaggtgttcgtttgggtagcggccgccgcgtcggcgccagctgtagacggcggcggattctgcgcaccgggccgcggtggccggtgtcgttggatttacccccattttatcaccatcgggcccttctcttccttaaaaaaaatgtatggatttttcttctactatacggagtattttgtaattctagaagaattcagttatggataataattgaataaagtcataaacctgctcaaacccttaaattttttctttcgaaatcaaactataaggaaattttctaggcggtttcgtgttgaactggagtagtagtagtagcagcggctcccgagtcgccgtcacgcgcgttgccttcccctcgggaggtgggccctccgcgtggactgggtgggcccacggtgtcagacgtgcgccagccacgtgttccctcgtgtcctcctaccagagttcgagttaatttgattttcctggtaggaaggggagtaaaaaccgtggaaaatttgtgtgtgtttgcctaggcctttccgttggtttcttcttctgacttgctttgcaaggtttggttggaaggatggatggatcgcccgctttccccgagattctgttgctgttcccccgcgtgggccccaccatgccctgcccgccgcggtggaccaagcaagggccccacgtgtcagcgttttctctctagtattagtatatatttttttggtacatgaaatcatttttgtttttgagcggaatacgtaaaaaagtgtctatttttgtaaaataatttattttatttctcgttctgtagataaaagttgaaataattttgaagttgggtgtgtactagtagtatgctcggcttttt

SEQ ID NO: 69203 - DNA, 743 bp, Oryza sativa
cgcagaaatatcctctcgtttgtttaaaaacgttcatccaaacggttatgaaaatttttgacaacactcacacaacatatctatacaactccacaaaatcttaggttcaaactcatctcatactccgacatatatatatatatatataaaaagataaattcagcgtatgaataataggctaatttaaacttaatttttagtggaccgatggatatctctatactctacattgtcaattttcttttagaatttttcacaactatttacatcaagtttgaaagaaaaaggtatacgaggggacatccccttgagggattagaatccactccccttgcaaggttgctaagcctgcgaccatacatatgtatcatgtatccattttaattgtacttaattcggttagagattgagaattttagaatatgcaaatgtttttatcagcagaattccatagataaaaatatggcatttatgttcatgcatataactttaaggtatgggaagtcctggccttagcttgaaaagccaattgttataaagtttacatcacaaatacctgcatgaatgaatcctaaaggtaagacaccagcaaactttccgttggaggtaggccatcaggaccttcggccaacttgctaaaacaacaacagtaacaagtgaaggagcttggggaaggggcatacgacgaagcttaggccatggagcaaggccacaccacgaagcgaagcaccgggtggcgaaac

SEQ ID NO: 69204 - DNA, 2576 bp, Oryza sativa
  unsure (1)..(2576): unsure at all n locations
agcccgacgcaggccgagttcgcgtcggcgctggcgttcgcgatcggcggcatcctgccgttgctgacgagcgggttcatcaagccgtggggccccagggtcggcgtcgtgtgctgccgcgatcagcgtcgggctggccggcttcggcgccgcggacgggtacctcggcggcgccaacatggtgaggtccggctctagggtcctcctcggcggatggctcgccatgctcatcacctacgccgtgctccggctgttcgcgacgatctttcacggcatgaacatctcgtcgtcggcgtgatgatgcgtgtgacgcagaaatcgatctatctggagatgaaaaagaaaataatccaggggttgtgctagctagctgtttaattaactactcttggtttgccagtagtgctgtacctagtggctgattattaactaccgaatccctggataccgaactgggaataatcagggggtgtaagtgtaatggttntttgatttgtgatgaggcaagaccaggcaaatggtctcaaatgagaatattggtgttaattattgtataccgattcccttctcactttgcctcccgtttgtttttgatttgtctgtgtctctgtgacagttcagaaactagctgatgctcttggttgcaatatccaggtgtgccactggcacgttgaattgtgtttggttgattggccagcaaatgccaaagaatgcgttgaaggtgcatccgggattgccaatggtcaaaggaacttgtaccaatggaaaagaacagtttagaacacagaaaacaagaacagtgcacagattgtcatatgccccctcagagagtccagtaaaaggcccagttcatcttgggcctatttatgccacgaaagcccatcttcataaggaatataggccttcttcttccacactaaagttcagatttctttatatagaattaaagttacagacttgcgaaacttacactacagaaaattacttttgaggtgtaaaaaaacaagcactcgaccgatccaacgaaaatatctggtgatcacagatctgatgatctgttagcctcgagatattctgcacctgatttctcgatcttatagcatagaaaattatcaatccagtgacccggttgcacaaatggaaggtagaataatataagaaaaaggacgatacagctggaacgttgacaaaagaaagataaacacggttgctttcactacaaattaaaatggtataatactactccactaccaataaaagttccgctacaaccgtacgcaatattcagatcttagcaaattgaactggagagcatttctcaaagaagaaaaccaaaaagcctaactgaaagtctgaaattcaactggaatggatctctcgacgaaagatttcattttcttttggagtcctgaaagccaaaagagagaggccgctggttttgcgagccatgagcccatgaaggctacgcttcccacgggatcgtctgattcgtctccctcctctcgtcggttcttcccaacctctcccaacttctttttctggattcttgtggccgccacgcgccaccgcggtttttgtaccaactggggtacgaacgagagacgacctcgcgcgcgcggcgcgaaagtcgcatgtgccaacggcatcgtgccggcctcttccaccggatccctctttttctctatctctcgtggcggccacacgcctcttgctaatttaagccccccaacttgcacgtcggattcgtcgcgatcccccggacagatcgcgttgtcgcatggcggccacgcgcccaccgggtagtttattcccatcgcgacgaatatttcggccatgtttccatctcggagcacgtaatccgggatgctttaggtgaactgctccacgcctccacgtaccaactaccacgccaacgccaaagccaacgccaaagctcaccgtggtgtgtggtggccctttcttgatgaaagtcgtctgctccctgtacagcagataataatatgctcgcggttttggcgcgccttatgtttaaaaagttttatctttgaagaacagataataatatgtttgaggtcgtggctggcgtgaggtttatggaaacattatgtttactcttggtcggcttatttttatatataagttgggacagctggattcttatgatatatctagattagtcgtcggtttgcttgttacatgtataatagtttaaggctcgtgagtcgtgatgtcctcgagcttagctcatgtgggcgtggctaaggctccaaatgagctaggatgagcatatatatgcaaaagttcatgagcttggttgtgtgatgcaaataaactataagattaggtacaaaactagtatttatctgcataataaaatagtatgtaggagtgtaaaatatctttcatagcatttttcttgtttgctaattttaaaatttaaattgtgttttcctcctttttatcatggattttttttctattggatacagatattatctcattaacaagctttcagccaagctcagatttcaaatatgttgagcttgagcttgcttggaagcttgagtattctatag

SEQ ID NO: 69205 - DNA, 2276 bp, Oryza sativa
taattccccaaacattcaggagtcagggattcatccaagacacgcgttaagctcaaaatcaacatccactactaaattcctaatcttctaacgctactacctcagtacactggtacacaagcatcgtacatttcgtactggctgtggctgataagcgcacgtttttttttcaccagtacaagcagggaggcgacgccctgggtcgcttgctgccggcgccccactccgcgttcatctgcggcacccaccgctcgcggctggcccgctcgtcggcggcgacagcgacgccactgtgcagctgctcccggccggcccacgccgcgtaaccgtccggcaccccaccgatctgagccagcagcccaccctgcacgaaggaaagcagcgaaatgccaattgccacatgagtccaagcacaagcttctagcgaccttactgttttgaacatgcagacagagtacgggaaattttcaaatagggaaagcagggaacaatctgctcgtgaggggaggatgaatatgatatgcaggtttacgggaaattattctaaactcttaagaaaatatctttttgttgcttgaggcatatcacttcataaacatgtgaattcaaattcaatttatatattctcataccgaaaaaatatattaaactacagctagctagttaacgtataaatacaattaaatttatttttttcgttacaatatatataaattgaattttaacttgtatgtttatgaagtgatatatcccatattagtacatcttctcaaatttttttataactatttgagcgacatacaaacaatgagtgaacgtccccttcaaagtttaaaatccaccctcatggatttatcgcttagtattttatttttgtggtctccacaggatattatcctgacaccctggtccagcaattacatatattttttgttattgctagctgtgtgagcatgactacaaactacctgcatggtaaaatttgtccgctcacgatattgtgaacagattggcttatgtgcccacgacggccggcagggcctgaacagagtttggcgcgccgtgctttgcctgtgcttcgttcatggtgctcacaagaacgtgtgtggattggtttttcagggtttcatgcatgaaccggactgaatacgtattcaggttttcgttgccatggaaagtttggatcgttaacagtggatgaactgacctgaaatagcccgtctgaggaggaggaggcggcggtggcctcgtcgacgaggaagtcctcgacgtgccaaccgggcagcgtcttggtgaggtactcggagatgctgctcccgtcgctcgcgctccccgcggcggtgccggcgacgctgctggggctgcagctgtagtcctcccctgcttcctcctcctcttcctccgacggcgcgggggagtccatcggcgccgacgagaggcgcacgccggtgaggaggaaccggccgtgccgcctcgtcagctcgctcgtggtgtgcaccgtgacgtcgcactcccggcacaggatcgccctgtcctccttgcagaacaagaaccccctcttctcctgaagtgacgagagtccacacgcttcagagttgcagcaagcaacagaagcaacccgaggaaaaagagcagcagcctctcgccgcgtgcatacctgacagatgtcgcagagcggtggcttctgggcggacgacgacgacgccaacggttggaggagggagaatcggcggtgcttcccggcgagcttgttcgcgctgtggacgcggcggtcgcacgcgtcgcacagcgcggcctcgtcggcgcagcagaagaccgaggcggcctcggccgcgcacacgtcgcactgcaccttcatgtctccccgtccagtccgatcgatcggcagagacagctaacgaagcgggaaagaaagatggtcgcgtctcggccgggaggggatgcagataaggcagaagcgcacaacaagctcaggtcaatgccttgggttagaggactaacgacgatgttgcaaggagaagtagagtggtaggttattaggagtggacgagtggtagttgtagtgcacgagagagtagatgtgtttatatattgggcggcggcagtggcacggccggttttaggccgaggtgaaaggaaaataaagctgaaaaggcggtgtcccctgcaaatcaacctaaccctgatttgtgaaagtcttatgaatcgtgttcgtgctgattgggagatgactatactacatggtagtgatcagggcttgtgagagaagtaacctt

SEQ ID NO: 69206 - DNA, 745 bp, Oryza sativa
aaaagaacgggacctaaccacttgttagtaatatgtaagttctatccttcaaccttcagacttcattcataatttatatgaaaataacgtgtcctatagcgaagggaagaagaagaaatacgagccgatcaacgctgaacttttcttttatcgcatcatatatgcatgaacaaggcccatgttgctgattttgtaccaccgaaccgaatagtattaatcatatgtttgtgagtttgtttgttggagtggatctaaattcaagagacattatttaataggggacatttgcacatgttgtgtcctatggcttaatagaatgacatttttttaacaacactccaattaaatcttatatgcacgtactatacaaggtagcacactaagttcggtatgggcccagctgcaaaagagcgaggagtaccacttcccaaaatcgcattgagatgatcttgagaaacatctcgatctcctacaacctctcataatcgatgctttgatctcgattcctctgtcgccttgcccctactaactaccggattcattcattggactcaacagctctagaacgctagtgcatttgctcgctcacaccatctaagggggacaaagaagaagagttccatccaatgccacttcacgttgcacgaatagatccgggcacaaacatctccaatccaatggtactttggccctagataaaacattgctccctaaccatttctggcacctccagcgagcccttcgt

SEQ ID NO: 69207 - DNA, 715 bp, Oryza sativa
ctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcttggatgaatctggcctccagaagtcgcgccacctcctcgcggatgaaggcttgacgttccggggcctgccaccgcactttctgccggaccggccttgcgcccggccgtacggcgagacggtgctcaatcacctccctggggaccccggtcatgtccgccggtctccaggcgaagacgtcggcgtttgcccgcaggaaggagacgagcgcgtcttcctatttatcgtccagaagaccaccgattcgtgtggtcttggacgggccgtcgcccagggcaacctgcttgatcgggacctcgtcgcacgtgatcatccgatgcctcggggcggctgggacggaggtgctgagcctctcgtcgccacccgcgggcttggatgccgcggcgaggtggtccgcgcgctgctccatgcaagcaagcgcg

SEQ ID NO: 69208 - DNA, 900 bp, Oryza sativa
gcaggagccaagcaggatttaaaaataattacataagtaagagtcgttatgacctctgcatcatcccaaagtctaagaggagtgttttctgcacttaccacatcccttacaacttcattatatattgctatagctgaaaattgcaagacaaatgctttctcctcatgctgcaaaaagaacaccatgcctatcagcctgacagtacaaatgtgtctcgtttcaacaccagctatggattaataggcactaagagagggggctgattaccttgccaatgtaatcataaatatctgctaccgtatattcagttatgccagtcatggtgtatgtctttccactacttgtttgaccatatgcaaaaatactcgctgttacagaacaaattaaaaggaaataaaatgtgttcagttagtttatgcaatcttcaatcaaaaccaaattggataagataggcaataggtttggacttaacagttaatgccactaactacagagagggcaacctccttggccccttgcttgtatacttcgttcgtatcgcagtcagagcggaataccctatctgcaattggaatagagttgtgtcaaaaaacacagctggaaagtgagaatattaaagagcatacttgtagtacgagcaaactaaactcccacttatctgtattctagtggtgtgtagttgtccactaccaaaaaaaaatgtccaatacatttgtaaatgtaaacattcaatttcaggagggttagcttaatttctaaaggtgttctgtcagattttttttactgggacaggaatgtgtcgatgtgttctgttacttgtaacaaacgacgatgtataagtaaccaattaccagtgattgcactccggcaggtatgttaaattctgagattttacatttt

SEQ ID NO: 69209 - DNA, 1494 bp, Oryza sativa
gaatcgcacactaactaggcctaaatctagcaaccgccccgcaagcagagcagctactctactcattccaatgttgactatcgcggctacttcccgagaacgcctaatcatatcccgcagggggcagcatcgcgagctactgccagatcacaatatcacatcagtgagctaggcactagcagccaagtagcagaaaccccgtaatgctcaagccacagcaagggagggagcaagaaaaacaaggtgaaggcgacgagtctacctaccctacaggccgaggcggaggcgcgcttctggaagcgggagccgccctgcagtgcccgccacggcgcgacggccgagcttggagacggccgccatggcggtcgatatatgtgtcggttaactatcgagggggaggacgagtagggggttcccgtcttcctaagatgcgccgtggaggttccgttccgtgagcagcagcggcggccggcagcccgccctccccacgacggcacgatctggcaggtttttgggcgatatcgtagaggacggtggcttttccttttggccccctcccttcctttcctcgttttcccttttcccacacggttgaggggagagagagccggagaggagaccgttgattcccttgtccccactccccacgtcgctctcgctggttgctccttgccgtgcgtttttgcgcgatgcccctctgcttttcggtgtattgcgagcactaaacatacggaggcacggagtagtggatcatcattgggttgggtattcttgtttgcacaggagttgaggtctcagactggagtgactgacagactcacggcggccagactggtgccttcagaattcaggaagcagggattaccactagcggcacgagggatttgatgatgagattaagatgggaatttaatttttaatcccaatatcttgtttggtagaggtgatgaaaattgataaggaatttagttagagattatgtcattaataaaaacggatggctgagatttgcttaaacaaagtgaaggaggaattccctcccaattaactgcccctacccaggtattgaaaagaaaggagttccttcctcaattctccatcctcatcccaccaaaattttcatgtctcccaaacaaacaaaactcttaatagtctcatccctctaaatttccaatccctcctaaaaactttctccaaccaaacggaccgtagggggttaggcgtggatgatgatgcgtggttgtgtttaggaattttgtttgggagaaagagggaagattcatcttgatgtgactggcagttacagtcccttagtggtaaagcaattgctaattggatttttctgagaggttacgtgaacttactcgatcggtatatgtttactaggcgtgctgccttaagcggtgccatttgcttaattagctagctcttgtggctggctgtatgcctgtatatgttttcttgtactgtcgatctgtaaatggtcggggctgc

SEQ ID NO: 69210 - DNA, 3319 bp, Oryza sativa
ctgcggcccctcaaatactactgcaaaacattgtagcatattgcattagtagttcaattatagaggatccatatcgggagtagggcatatatgtttgtcggtgacatgggaccggggatatcttgactagaggtttgggcagccgcggtcacccacgtggcctgaccccctcggggggtcgggcccgaggttgatgaggccgcccctccctctatctccccgaggggtcgggccgctcccgtttcgaccccccgggggctggggcgccccgaccccctgagggtttggcgccacgtgtgtgggttaggtgagcacagcggcgctcacctaaccgcgtttattgcgggttggacgagcgcctcacgccgcatttaatgcagcatagcgcatgcttatccggtccgtgatcggtcgcagtgtgtgaccgatcacagaccggtcagatcgcgggttagggggcaacaggcggcttgacacacgcctcgccccgtcccgtcggaatgatgagagcctccaggcactcgtccctagccagagccggcgtgggaactcctagagttggcacgtcagccccggccagatacattccaggcttcatcgcaaccattgcaaggaagtcattgtatgaagaagtgcagacgtgtagcatgctaaactgacacgtggtggacaagaatgaccggtctgtgactggtctgacgccggtcgcgtcatcagcaaacaaccgtgcttccacgttgcacctgcttccggcggagtggaggttggtatgacccatcccgtcggagggtcattcggacagcagccattgcaaatctccgcccattaatgagggaggacagggttatcccggtgtcaggcgaaagtacgagccaagttttggtcaaagtaggatgggtccccacccaaaagaagggtaggtagaaatggtgtatgtggtatccccttgagatataaaaggaggaccatgcctacgaagaggggggaccaaaaaaaaggagggacggaaaaaaagactagaggagacctgagcaagtagactggagaaaagaggagtgagaggggctctagagtgggaactctcttgctctccaactctttgtaactccttcatacacagatccaccagaacacaggagtagggtattacgcttctcagcggcccgaacctgtctacatcgcccgtgtcttgcgcatttactctctcgcgaaacattccccagaccgatcgagggcgaagaacctcacttagcgcccccggccgaaccggcaaaggggggcctgcgcggtctcccggtgaggagccccacgctccgtcatctggcgcgccaggtagggggcgcgcgtgggtttttctaagccctcgtcctctttcgtgtgcgccaagcttctcccgctcagcccaatggccgaacgggcagtggcgcacaacctctctccgagcgctagcggtgacgacagcgagcagaacccgcgtcgtcgagctcgtactccaccgcccccctctcgccgaagtcttaggcgggaggaggcgctcgagggggtcgaaagatccgcgacttcgccgcacgcgggcgatggagaaggacggcgagacggggagcgtcgtctcctcgtctacggtgatggcagcacgccccagggcgcgctccaggctgcgggcgcgctcttgcgtcacccgcccgtcgtccctgatccagagactccaacccgccgttggctagatgacgtggccaacttggtcatgacggcgcagcagcgcctaggcgccggcgggcggtcctccgccaccaaggccactggcgttgctactgccggctccgtgtcgtcgaggcgaagggcgcggcgagcggcagccgttacccgccgttcatctgccattccctcgtcaacgcctcccacccaagaagatgtgcgtgaggggccggatgcccgcctcaatatcgagcgccggcgcaatgatcgccgtgctgcccacgcatcggagggcgcttcctcgtccggagcgccacttcggtccgggcacgggggccagccccccgtgtccccggttggcggtgccggctgtcgagcctttgtggcgagccttcggaacgtccgttggcccccaaggttccggcccaccatcaccgaaaaatacgacgaaagcgtcaaccccgccgagtttctccagatctacacgactgggatcgaggccgccgggggtgacgacagggtcatggcgaatttcttccccatggccctgaaaggacaggcgcgggattggctaatgaacttgccacccgcgtcggtccactcttgggaggatttgtgccagcagttcaccatgaacttccagggcacatatccgcgcccaggtgaagaagcggacttacacgcggtacagcgaggggacgatgagtctctttgctcgtacattcagcggttttgtcaagtccgcaacaccataccgtgcatccttgcacacgcggtgatctacgcgttcagggggggcgtgcggcacaaccgcatgcttgagaagatcgcctccaaggagccccagaccactgcggagcttttcagctcgcggaccgtgtggctcgcaaggaggaggcatggacctggaactccaccggttccggtgtggcagcttcggccgcccccggatccgccgctcggtcagggcggcgggacaggaggaggaagaagaggtcggcccattccgacgacgagggtcacgtcctcgccgtcgagggcgcttcgcgggccacccgaaaggggaggcctggagcgacaaaaagaaggaggccggcgctcccagcagggagcgcccgaccagcaagtggtgcaccgtgcacaacacctccctccacgacctcgcggactgccgcgcggtcaaaagtttggctgagcggacgaggaagtgggaggaggagaggaggcaggagcgccgtgagggcaaggccccggcggctccctccagcaaccggcgaagtgaggccaagcagaaggcccccgccgagaacattgacgatggcgacgatgacctagggttccaggagcccggggccaccatcgccaccgtcgatgggggagcacgcgctcacgcttctcgtcggagcctcaaggccatgaagcggagcttctggccgcggcccctacccatgaggcgacgcggcgggcgcggtggtcggaggttgccctcacattcgaccagaccgaccacccgccatgcattgcccggggaggacagatcgcatggtgggttcccccaccgtttgcaacgtgaagttggggcgtgtcgtcatagatggagggagcagccctcaacatcctttcc

SEQ ID NO: 69211 - DNA, 1456 bp, Oryza sativa
cgggcatgcttctcgggttcttggtctctgcccgaggcattgaggccaaccccgagaagatacgagctatagagcggatgcgccccccagcaagcttagggatgtgcaatgcgtcactggctgtatggccgccctaagtcggttcatatcgaggctgggagagaaggcgctacccctatttaaactcgtcaaacgctccgggccgtttatctggacggaggaggctgaacgggccctcactcagttgaaggcgtacctcagttctcccccagtcctggtcgccccggagccagatgagccgttgctactctacctggcgggaaccccgcaggtggtcagcgcggcgttggtcatggagcgcgacgaggacgaccctcgcttcgcgcatccccaccctgtgtcgactcgacccgggagagagcagggaggagaggcccccgagccgaacggtggcccaaggcccccgacggccggagctggccctccgcccgcttgtccgaaggtgccaggcgcccccgacccccaggatggccacggggccactgcgggaaggccgcgcctgtcgccctctgaccccgaggtcatcggcacagaagccgagtgcgccccgcgcggcctctcggagcgtgacgaggacgatcctcgctctgcgcgtccccaccctgtgtcgattcgacccgggagagagcagggaggagaggcccccgagccgaacggtggcctaaggcccccgacggccggagctggccctccgcccgcttgtccgacggtgctaggcgcccccgacccccaggatggccccggggccactgcaggaaggccgcgcctgtcgccctccgaccccgaggtcgtcggcacagaagctgagtgcgccccgcgcggcctctcggacgaagagcgccctggaaatgcggcccctagtgaagaagatcggccccgccgaaaggtgtagcggcccgtctacttcgttagcgaggcccttcgggacgccaagacccgataccctcaggcctagaagatgctttacgctattctgatggcttcgaggaagttgcgccattatttccaggcgcatcaggtcacggtggttacgtcctaccccctcggccaaatcttgcataaccgagagggtactggacgggtggtgaaatgggcaatcgaactctctgagttcgatttgcactttgaaccacgccacgcagtcaagagccaggccctcgccgactttgtggcagagtggacaccggctcccgagcccgtctccatccccgaggccagctcgggcccttcgcagctgcctcacaccgcctattgggtgatgcagttcgacggctccctgtctcttcagggtgccggtgcgggggtcacgttgacctcgccgagcggagatgtcctcaaatacctggtccgcctcgactttcgggcaaccaacaatatggcagagtacgagggactc

SEQ ID NO: 69212 - DNA, 1110 bp, Oryza sativa
gacctcgtcctacgccgcgtccaaaagcgtgctggactgagcaagctctcaccaatgtggaagggtccgtatcgagtgatcggcgtccccgggccgggctccgttcggctggccacgggcgacggcacagagctgcctaacccgtggaacatcaaacaccttcgtcgcttctacccctagtgggggtcgggtgtcaggtctcgggctcgggccaaccccgcaccccgcccgggcgtgcagggttggccgggggctaccacatgcataagcttatcttttttctcttccgtatttcaataaaagcattttcgatttcctaaggactgtgtctgtgccattgtttcctttcgaagaatcttggcttgaattagcacgctcgtgctcgatcctgccctcagtggcccgggccggctaaaatcgccaaacggggcccagaaccgagccgtgccccggggcgtggtgaactccgggggggaatcggcaaaggcccacaatcgggtccccataaccctcggtcaccgcgctcccggcctggccagtctcgacacgtggatctccccaggcactagccccgacccgcgccgtttgaggctgggacctgggcacgagtcctcgttcaagccaagacacagaaggaccgcggcacagaccatcctcgtctcatatacacaacgaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcgtcgctgtcgtccgcaccaccgtcgccgccctcctcgtcggagtcgagggcgaacgcgagccgaggggccgtaccctcgaagctgtggacgatgtggacggcggcgtcccggacctgtgcgcgcgcgccatcctcggttccaggagagaactcgtccagcgctgcccacggggagaagtccgggtccctggcctagtagcttgccagtacgagctccaccgccccccgggcgaggtccctcgaggatgacttgatcgtctcctcgagctcctcggg

SEQ ID NO: 69213 - DNA, 903 bp, Oryza sativa
tcagtggggcagcggaaggcatgggggagagccgcctcggtaaggatgccgcacggctcgtcccaccgatcgacgtgccggactcagggacgtcccccgaagctggcccgtcctgagcgtcgcccgagaggtcgggcccgagcggtgcgcccgcggcctcgtcgtgggtggcctcggaagtcgtcgtcgcctcgggcggagtcgggtcggaggcttggcaggccgcccggcgtgcgcgcgccgcctccgtctcccggacggactcctcggcccggtggagtcgggcctcctcccaagcggcttcctcagcctggcaagcccggacagcctcctgggcagcttcctcggcttcccggaggcggtttgcggtttctcgccggtcagctctccgcctccgggcctccgcggtcgccgtctcctcggcctcagaccggccggacttggaatggcgggaagggcgcgacgggatctcgctgaggtagaagaaaaactagaagacgaaaaacgggtgagtgaaaacttgccttgggagatgggagaatgaatacggccgcagtgggcgcagggacgaacctgcgaggaggtcggctaaacgaccaccttgggggggagatgaggtttccccggtatggttcggtcccccccatcttgtggagccgcttcttttttcgcttcccctcgggccgcgacgtcggcacagcaccctccgggcgcctgctgctggcacgcaccgccccgccccctcggggaggagatggggagggggtatcctcctgtttcctcttcccccgggcgtcggtagggcggctgccccccgggcccccgtcacggggcccagaagcacgaccccctcccggcgtagattgttcccccctgcggctcccgcccgcgccatcgtggcct

SEQ ID NO: 69214 - DNA, 815 bp, Oryza sativa
gtcactctgggtctttaggcggcattgactttggttctgtcctagtcagcgtaggacccacgcggaccccacatatcagtgacacctcaccttcttcttccccttaccacctctcccccatcatcacggcgcgagcagcggccggcgcgtgcgactgtcgccgtctcgtccatcccactgtcgcgtcactctttcctcctcttcggctccctcctcttccccctccggtccacctctttctctctctttctcttcccctccatcgtcgggcaccattgccgcccccctgtgtcgtcatcgttggcggtagggatgagctacttcggtagctactccacctacctcgaaaccatcttctccgtcgtgctcccgccgctcgactcgattgcctgactaatttctgccattgttttcatgcagtcagagctcgtcatcccatcggcgctaacaacgttgttctacgtctccaacatcgtctaatttgccaaggtcatcatcttgagacgctgttgtagtcaatgggcatcgacgggaagcggacgtactacatcctcaccgtagtacaaaaaacggaccggcccagcggttgaaccgagaaaaacggaaccatcactctcaccaggtcagtttgttttaaggaccgcacatgcaatggaaccggtgcaaaccggatgaaccggatggtttttgaggaaaaacggcggccctggctattttgaaccgccggttcgtgaagcagatggctagattctaaggcccacttggattgttgcggcccaattatcttttatttgcctaaaatgaggaaaaagtgc

SEQ ID NO: 69215 - DNA, 1218 bp, Oryza sativa
aaaaattgggttcgaatttttctctggttcgcttgtgattttgtgggggctaaagaatcaatccttcggggctcggagcgatggacgtggaccagctgatcctgttcgtctttgtgtgctgtttgtcctcgaggtttgctggtgagctctgtgatattcaagtcatgtttgtttcccgtgctgtttcttggacatcgccgtcgtgtttgccctccgagtgttgttcttaggtttgattgattgaactacggtcggtgatttgttttctctatgttttgacagatgcgtatgatccggtagatccgaatgggaacatcataatcaactgggattttcagagcatcgagaacgtctacacggtgcgcatgcctgctagtgagtttagtactgccgttaatttttcactgtttgggatcatcccagtagtagatatgcagtcgaataaaagattcagaatttcagacgtaccatcgttgcaactatcctttttatctcgattctaacttttccccattatttcctccggtgaaacttatcattagtacagccgaaatacgatattctgacaaaaaaaatttgacgttcgcaaccgccaacaccacgaatcaatcgatatatcctgtgcttatgcaggtcatggtgagcgtccacaatcaccagctgtaccgccacatcgagcagcccgggtggcggctgagctggaggtgggctggcaacgagatcatctggggcatgacgggcgcggaggcgacggagcagggcgactgccaccggatccgtggcgccacccggccgcattgctgcgagaagcaaccggtcatcgtggacctgccccccggcacgccgtacaacaaccaggtctccagctgctgccggggcggcgtgctgtcgtcgctcacgcagaacaaccggacgtccaccgcggcgttccagatggtggtcggcggcttcaggcgcgccacgtaccacgacggcgacaggggccccgcgctgccgtcacgcttcggcgtcggagtgcccgggtactcctgcagcaacgccaccaaggtgaacgcgaccaggtcaccgatcggcaggaccggcacgtccagtctctgcgtaaggcttctcccctttctttcttatcgcggcgcgtgcgttgagcgggagttctgagcgattcttgctgccgcgcgcgcgggcgccgtgtgcagtgacatggcaggtcacctgcacgta

SEQ ID NO: 69216 - DNA, 855 bp, Oryza sativa
tacacttccagcaacaaaagaacccaagatttatgaatgctcagaggataagaataatttctgtgctaacaaaacttaccttcacccacgttgacatcaatttcctgtacaacagttcaaaaaaaacaaatgattgatttcgtagatagcaagcacagcagaagacaattcaaaaaaggaacgcaaaacaaaatataaggacaaatatttcatttactgaccattgctgtcatcccacaatccaagcagctccaaggcccttgctcccagaatcaacacatgcaagagcaacaaaagccaaaacaaagttgctaaaaagtacacatataacccagtcaatatcacacagagaacaatagaccaaaaaaatgaaaatgtcatgtggacacatctaaaaattatagataagaatatcttgcacatctgaaattagagacaaaaattcctcaacagttgctatctcagataacttgtgagataacgggcaccacactaaacctaaaaattccatgctaagcaatggaagtaaactagagacagtatgtcaagcttctatcaaggaagaagcctcaggtcaatctatattctaccaagagaaatagagataacagaaaaaaaacagtacaaaactaggcctcattactaactagcaaaaaaaaaatatatcaggcacatatctaagaaaataaagatgcctagggttccccaaactacaagtctctgataaaaccaatatcaataattaacaatctaactaccaatagtcagttacagtgcgaaataataaaaattacaactgtaactaaggtatatttccactgtaagtggtgtgagttgcactgtaagtgtgtttta

SEQ ID NO: 69217 - DNA, 743 bp, Oryza sativa
cccgttcaagaagagcagacggaatcggtgtaaaagtgaaagggaaaacgccaaaggtgcaaaacgaagtactagtatcgacatgttgcagagttagcagtgcattagattatcagtttagcacccaccacttcttgcaggtttaatcagtgtcggatggtccacttgggacagggccagtcggcagagccttatcgaaatggttgtgtgctttgggcctcacaaactgaccgaattaatgaaagcaatgcgacaacagcaaaaaacaccatgatcactgatcgagggggtgttgcgagaatcgaactcgcgacctctcgcacccgaagcgagaatcataccactagaccaaacacccagtttgattacttctttatcttgtattttcaaatcctaatacaatgtagcatgagtctgcagtgctcgcaggccgcagcttggtgtattcagagcccgggaatattttgagctccaatatatacagagtacagacgaagcagaagacggtacaaactactacaaaacagtgaacagcgacgtctttatgcatatcatgcgtcttctccggaacacgcatgcatacctccccgaacggaaaatgaaattgatgacacgagtaaaacctaaaaagagttgcatcacccacagcaaccactccgtgccgatgtgtcatgcagcacatacgcctcgcctcatggagtgacttcatcgctgatttgcttgggacctaccgatccaatcga

SEQ ID NO: 69218 - DNA, 797 bp, Oryza sativa
caaatcgcgcgcatcggcaagggaaaaaccgaccgacaataatgagcggctttcttcaagaccgctacattacttgagtagcgcgcgaattgggacgagccggttcgtttcgcctggagatgtgatgatgtgcatcggtcggcgagcgtagttaacgcgcgcatgatatgtcccatctcgactgccacggccgcacatccgcctcgtgcgccgcaaacgggcgagcaggattaatggaggagtgggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgttatggcacggggctccgcaccgctcgacggtagcgtgctgccgccttctcgcatcgtgagcgagaggcaagccgggctgccgcgccgattcatgccggaatctgccaccggccgggaggtggttgcgctgggtgagggacgcccggcgccacactacccggggcggtccgtattcttccttcccttcgcaatggcagggctggtcccgtcattctcttctttcttcatggatgttctggagctttatgatctccagatggcgcacctcacccccaacgcagtaatgacgttggccatcttcgcgcacctgtgcgagatgttcatcggggtgcgcccatctc

SEQ ID NO: 69219 - DNA, 1243 bp, Oryza sativa
gttttttaaaaaaagtggatagaaaagttattttaaaaaattgttaatttattttttaaaaatttaaaataataactacttaattaattatatgctaacggtggatctaattttgtccattttcttaaatttttatccccttctttcaaacacatccttaaaaaacaagaggagttactgtagtaaattattaaaatatcgtgtgctttgctagcagcttcttatctttgattatgggtaaatgttttgtcaacaccatattccaccttctttattgcgatcgaatagctttacctcttactcctctttttcatggactttgacaaacgcttcgaaatggtgattgctgcagaactgacgcaacatctctaaactaccctgaaatttcccaggaaaacagcccgtgccaaagctgaaaatgagctggaaaaagacgagtttggcaattctataccgccttgtttacgttttcattccgtcggtgcttcttcaccagtcaagtcgttcacttcttcctccaaaaaggaacatcagatggaaaatcaagtacgatgatctggtcaattgtactattaaattaataatacaacgaccttatccattattatcccatagcattattcttaggactcattccactaaaagtcctgctacaattgtaccgcatgtactattaataatagaatcttttagaggttctctcctatctttaagagatacaatacatcctcaccacctcaccaccaatatccctttagactgtctccaacaacgcgacgcatactcatttatccgtcgtgcacagtgattttgggtaaaaaaaaacagcctccaacgggagaggcaaatgcgatacgcatattgggtagcggccaaagcgctaggcaaatatacgtctcctctctccaccgaacactggagcggagctcgcgcagtcgcgcggtgggccagggtgaggcagagctggtgcggtgaggcggagctcccgcggcggggcggaggtggcgcggcggggcgggagcgccgtcggggagcaccgtcggggagcgtcgtcggagcgcgccgtcggggaggaggcgtagtgggcccgtagtggcgttagggcggagtgcggccgacggggagagtccgcggcggagcgcggtcgtcgcagttcccgctgctccgttctgagcatcgccgccacgaggacgagccgtgccgcgagccgccggtgggtgtgctccgcctgccaccaccgctc

SEQ ID NO: 69220 - DNA, 1201 bp, Oryza sativa
ggtttaattatattgccaatttgtggtagtgataatagtacacaacaagttgatgaatgacatggtgttcaacaacacagtacatggcacatgtttttcacccggtcatatatagtatattatcacaatcaatatgtatgcaaatgtctgcgtcggaatctgctaagtacatcctgcgttccgatataactagtgtatatatagtcgcgcattcatgcgactttaacctttctctatgctaaatatctctacatatattatttatatggaaagcggttcagttttcttttggttttaatctttcacttagtatatctcatatttttaataggtggcttttaggggttgacaagaaaaatagtaaactgatatttgtcggagcttcggccatttgttgggctctatagttgagtagaaatgatatggtttttgacaaatcaccatctattttctttataaaggtaatttttagggcaactcattggctccggttttaggtacaattacaaaggtgtgatgaagatggagaatttctgaaagttgcatgtcgtaagttggagacgtcggttatgcaactttttgccaactatagatggagattcacaaataggcttgaataaatgtgatcttcttattttggattttcctatttaaatgtttggtgtgttctattttatttgaactacacttttatctcgagtgctactttataataattggttgtagctcttcttgagcaaaggttgagatattatattgcattatctaaaaaaatataatatttgtagtaataaattatatttactatatgccttaaccttcctctatattgaatgcttttatatgctagttgaactaattaattatattgtttatagatacactaataaggaggtggatttgtgatctatttagtataaattgaggattcatttgtttttaacactaaaccaatatccattcacttgctcatgattcatcttaattcttacttatgtttagttagttaacctataaaattttgtaagttttgttttattttattaaaattttaggtaatctaaattcataatttttcagttcagaagatctgctcattgccaaaaaaaattgagatggttaatttttgtgctgaacaaaactggagatcgatagtttatactccctccgtcccttaatataagggattttgatattttgc

SEQ ID NO: 69221 - DNA, 9999 bp, Oryza sativa
ctccaaacttccaaaattctaaaaacaatgagtttttattgtacgtaaggtacatttaaaaggttaccagtcctgaaaactcaaaacctccagtgttatgtagcaccatccttgccactctcccattggatggctgagattcattctactgtttttgtccttttaccaatcctatgctcattatttactacattatgtggctctttatgcttgcattatcagattgtctttcacttgttaagattgttaccggtgaccagtattgttgtaactttgagaccactattatttttaattaattagattatgatgcaagaaattttaatagtatgcaatatacttcaataagatgacatctatttgtgtatttagatttttgaagaaaattgtgaatggttaaagattaactgtgaataccctgcaaaaaagtttaaatatgaatagtggttagtgataagtactaactctatcctaaaatatgagaaattttagagttgaacacgggtattaacaaagtaggtgaaattaaatgggggagttatgtgattgtatgagaagaggagtataagaagaatttgaagggtggaagattgttattggttgagaagagaatgtataggtggagaagttgttatattttgggataaatattaaatgttagaagttgttaaatattttaggatggagtgagtagtatacaaagcagtagtggaagtatatatatgatcataccgagaagaaaactaagctacacatagtgttttcttttttgagagggcacatagtgttttttctttaaaaaaaaactcattagatacacgtagttaacagcgacacaaaagagaaaaaaaataaatgtcactagccagatcgatcggtcggtcgtttccacacgtgcgcgcgtgcggcccggccacttgcgcgacgatgtgcgtgtgaacatggaaattaatcgctaatataaacgagtttctagctagccttcgcgctcgagccacactgtcgtgaagaaaaaacggttttaatttcgtagtaggttcatataaaaacttactctaacaataatatttctcacgtgaaaggtaaggaccacgtgccataattaaatcatgctaatgaataatttgtacacacgactgacttgtagtagtactgaactagctactactccagctaggaatagagtactggatagctactgcgtgaatatgtacgcgtcgatcgtcttgtgatgactaccaggtcgtctgttgactgatcgatctatagatagatagatacagtttgtttttgacggtcaatgtatacgtgcaaaacgccgaagaagctagtggactggtggttaaacttgaacaagcacgttgcttaattaattactccgtccgttcacatatggtatcctcatcatcccgtaatgtatgaaactactgcagaaaggatcttcacaaacggccaaagctagttttcatatcagggagctccactcagaatgtttttttttacttttttagacttttttatgttttagttttattattagaccactcccaaaagtattttcgaaaactgaatcttttgattaggcgtgccagcgatgtcctgccacgtcatcagtggtggcgtgacaagaggctggcgtggctggtatgatagagttatttggccacaccaaggggctggcgtggccaaattaatacttttggaaatggtctattaataaaattaaaatataaaagtctaaaaaataaaaaaaaattcctccactctcaagtaataggtgtgagttgtctacgaaaatcggtattttaacgtgcgagcatcacatccggatgtaacaaataattttcacagatggacatcctaaggaggtcattataaagacccgatttttccaagtagccaaataaggaagcaattatttttttcaaaaaataaaaaaaataaaagaattccaaaaccctagccaggtcatcgtgaggccaccgccgcagtccacacgcctcagctcctccgcctccattttaactacgctgcccttccgcctcctctccgtcgcgctagagcctgcgagcaatggatccgccctccccccctccccccgggttgggggggaggggagatcagccgctcttaagcctaccgacggtgctgtggtcgtggactcgtggtcactgctcttggtgccacggtcaccactaccgccccaagcccgaagtccgccatcgccattcagagaggcaaggaggctagtcgacccattgggagagagagaagagtagagaggaaaagtagcagtgagtgaggggagtgagagtgggagtgggagtgcgaaggaggaaataaaagagaggaagagagggaatgcaaaggggagaggaaaagaacaaagatattaggatgggggagcgtgcaacaggtaggaggagaagagaaacccccttgtgaaaatcaatttcgtagacatatctcttaatcaagagatctgtctatcaaaatagctattttctcaaaggagcctagtaagaaactcgtctgcgaaaatcggttttgacaaacaggccttgatcgaacatcatcaatgaatttttcatatggatcacctttcaaaataaagagaggtgtccgaaaaaatacctttatagttgttgcaacgtgtcaaacagaaagaaacaaggaacagagggagtatgaagaatcattctaagttaatacgaaagtataacaacatctccaccatcaaattagttttatattaaataaaatattaagtatatttttatgatatatttattttacgtcgaaaatatttctatattttcttcaaacctgattaaatttgaaaataaaaaattgaaaatgtcttataatatataaaacagatagagtatgagttacggagacgtctaaataacaaattctagagttctaacaaactcgatcggtggaacgtgacatgttctagagctcagactattcgtcgcgacatatattttaatcttttttaccgcattgctatttgccagcgagatcgatcggactatacatcttccgagccatagctagaggtgctggttcggcaagtatgtttacatgcatgcttatgatgaatgcgtcgtattatatataaacacgagcctatacgtacgtatgtatacacgttagtattcacactgcaagtgtggacatattttagtatttcactactagagaaaccatcgtccaaaatccataatagtcccgatttgaataggaaccgggactaaagatgatttttaatcccgattaaaaactttttgatctttcatcccggttggtaacactaatcgagattaaagatcatttttagtcctggtttaaaaagttgttgggatgagtcagggctccaattatctttaatcccggttggtataaacaactgggactaaaatatcttttgtcccggttgcttatacaaaccaagaagttcaccccgatctgcgcgcctcgttcttgatcagtcgccgtcaatcttatcccctccttcttcctctctcctcccctcccattaaataattaacaccctcttatctccatctcagtcatctcccctctcctctcaccttcttcctcccccttcccctctcctccccctccccgcctcctttccaggcggccgagcccggtggcggcagttggcgcgtcgggccgcgcgaagcacggcggaccgcgcggagggcggatggggcggcggcgtggccgcgctggcgagcggatgggagggcggctagagccggcggccggcagcgccctcccctctaccaaaggggaggcgggaggaagcagccggcagcggcaactcgattttgtttttttttttgaatttttgatacattggatctgagaatttttagaagttgtcatccattggatatgtgatgtatttcttttagaatttgtatgtattttttttgagaatttgtgatgtgaatctatgtttgtgatgatactttgattttgatttgaggatatgattggggatacagggagcaactcgatttgtgcggttacaacttgatttgggaaaaaataataaaaaaaatagtgactaaccgggattggcgttgccaccaaccgggactaaagatgaatttttaatcccgattattttacccggtactaaagatttcccggatactcccgattacaaaactgagagtataggggttatcaaccgagagaaaaaacgctttctccaatagtgattttacactttcgtgtaccgccgaaaggacgatccaggtttcagatttaattcctccaaattaactctgtacgtccttctaaacttgattttctcgagctataaaattctcttccataccataattattgcgacaatctttaagtatctccattagtatttttcagccgtagttcatgcaaatgagatgcgatggcatgcgaactaagcaactggttatgttcgtggatcagattatatttgtccgtgacaaatactaagactattttttaccaaactacaaatactagaattaattagtattatttatgtcgactaattatccatttaatgataggcagtatattggatacacaagctttaacggatagggtgcgtattattgcgagtagaaagtgcgagagagattgaatgaaaagagcgaattgagtcaatgcggtacattttatagatggggaagggatgacaaccgtagatgcgatggttgggaccatcgcgtccgttgccaaggagcgccgagtgtaagaggcgtggttgccttatacagatgagatcaccatgtagtttcttaacacgtatgtttacatgcgtaagtgtatatgcgcgtctcgttcatactgtggtatatcttttaaaaaaagaaacggagaaaacttgcgcccttaggcagcaaacttggtagctagccatttgaacacacccctaaaatcctcatgcaagttatttgattatgagacgctatgaaaattttggccattatttcaacacccgaaatgctgtccagcttttggatacttatgatgcccatatccaatttttctgtgccaaaatattttgcaccaagtcgtcaattaaacattgataatcgatcgattaggataatactaatcgccaacccgtaaattacacaggctactgttatttatgttataaagatttaaaattttaatttgtgtgaaatacatcggttattataattaactttcatgttcggaggacaaatataactgtttcataactcaatggctgtcatattatgatccatttaatcaatggctagatgtgtacatgagaactcataggaaatatccaattagtatttggtatatagtacgaaggctaatcggtgcagccgcgctagaagcacacactcattatattttgatttttttagacactcgtactatctaagagcagacactcgcttaagcctataagcacacacttcaaaagaaaatctttacatacatgtgtactatctaaaagcgcatactcgctagtaacaatttttaagcaatttttctataaagtgatttatattagattgaaatttatctaaatgaacattttagaaagttatttttgatatattttgattttttttgaagacttactcaaatggagtacaatttttctaatataccatttcaactgaaaggtcatttcaaatttaaaaaatcgagtaaaacttctactaaaaatttgataccttttaactcctatatcagaaaaccctaatttttaaactttcaaataaaaacttacaaactttcaactcaaattaaaaagttttaactcatgagctaaaaaaacccaaattttaaaactctcaactcaaaattcgaaacatttaatacaaaatttaaaacttttaactcatattttaatacttttaagtcaagccaccagtagctaagttagttgagtcaatcttgtccaagtgtttacattaaatttattattcatctttcattaaatttctttctacatatagcgaaactcgatgcaataacatttaagctcttgtcagcaattctatttgatggatctgtaaaaaagtgtcaatactatactccaagaagtatgtaattttggtaaagtccatagtgatgactcataatttataaaaaaaatcatattgatttggttaagcatgtacgtacaggggtagtttttacaacaaaactaacaaaaaaataatttatacagtgaaatgtcaaagtgacttctggggtgattttttaattttcatcctacataattcacataatatttcaatatatatctccatcattttttataatatcctatatacctacatagttcatcatcacttaattaatgctatttttctattcttttattaagccatatcacttcaattgtttatagcacttagatgattgatttatgatccaaatatcacccttcttttattgtctcataagccatatcacctcaattgtttctaactcttatatgattaatctatgatccaaattatatcccttcttttcttctcccataaaaccacatcatcttactttcatatttgaatcatcattctatatagtatttaaattatcataaaccaaatcaacttatataagattatgttgtctagatattttacacattatttctatttgttattatcatactaaactcacacaacaacttatgtagtttcacatggtatatacagatgtgctaacattgcttataatctgaagagaccgagggtatgttatttttttctattttcttttgcaattaaattgaaggtgacaccgggaaattataggatcgaacacaagtaaccaaacctactagaaatggtaaatggtagattacgttagtggaagtcaaataatcgaatcttgatagttcaaaacacaacccaatcttaaaaaccaatggaacacctgtccagtggtatatccgacctactagagtcggtgtgaccgaggcctggccagtctgaccgcatatcctctcgcggtctgaccgtcagcctaaaaaacagcacgacaaaacttatgtaaaaactcgatttctcttaagccaactgttggatcgagttacaaacttaaataaataaactagacaaaccaagaaacaacgccaccagagcgatttgcaaacttatatatggtttaagagaaaacaccctctcgaaagtcggctgtcttaaaatttcagcaaatctgaacaaaacctaaaacttaagcaaattcgaatttagcaagatccaatcaacaaagtattagaaagattttggatgaattaacttcaacaaaatcgtagaaaattgaagaataataattccaaaaccgtttacgaaaccacgtctctcgtgatcgtggcctgctagccatctaacaaagctaccatgcacacatgtacagcacacatacatcatacatgcacgtactgcatgatacagtaccttcgctacaccagtttttcttaaccaatttcctccgtgaacatagtatccaatttcgtcaccagcatccttgatcatctggactcaactcctccttgagtctagtcccgatctcaccgttgatcgaagttgacctccaagaaccttaactctagttaccttctcacatggtatcccaaccgtactagaactttgctcctccccgcgcataatcccggtcctcactattgataagtcacatgcacacaatcagacaaaataaccatttctgtgctcagatatcacaacatgatcgacgcacattacccacactcaccaacatccatgcacagtacattctcaaaacaatttcatcgaataaatcatttgtaaagccaattgttcatcacaaatattaatcatgataataatttttaaaaaaatgcataagatcattgtcatatcttgtctcatcttgaaataatatccgtggttaattaattagtctttgcccctcctcctgtaactaacagctaacgcacgtttccaatgtgtttccaagctctattgtattcacactcagctatctgctgcatatgtgttgagatatggagtagtccattagcctatacagtcattagcattagccattaagcttgactaaccttagatttttgttaaggcgctttcacacacttatatacgccctatcacactgtcactattccccttgtgcatatgcggatgaaatggataaaaatggccgaagacatttctaaactgcacctcatattctccttgattgattattactaaaatgatcaacgagtttcactttacccgactagtcatatgcatggatgcctgcgttgaaacggaacattaaaaccggttcaattttttctacccttcatcgggattttggggggacatggtttattttgttttctcgcttggttagtttttgatcgaggcatcgtttttttcctcggttagttctttagagcaagttcaatagtatagcccactactagctctaatttatctatagccaatctaatagccaattcatacaatagttgcttactatactattgatatatggtcccacctgtcatacacacattccgtcttggagtccgtactgcagctggctataaatctgtagcccgctgctcttctctcttatccactggtggagaaaccatctttgctcggtagcccaaaatccacaatagtcctggttcgaataaaaaccgggactaaaagatgatttttagtcctggttaaaaactttttgaccttaaccgggactaaagatcatttttagtcccggtttaaaaagttgtcgggtcgagttaggccccaactcatttttagtcttggttggtataaacaaccggttatttataccaaccgggatcaaaaatcaaccgaaccgcgcaccagtccaccgtcctctcctctctcattaattatcccttatcccttcgatcccaccgtcctccatcccttcgctagctaccttatccctctcagccttagcctcctccatccattctcctttccccttcctcccccttctcctctcttcatcctccttccacgtgaggccgggcggcggcggcagggaggcgggcggccgagcaggcggcgggcagccgggcaggcggtgggcggccaggcgggcgaggcccgtgaggcgccgggcgggcgaggccagcaaggcccgcgaggcgccgggcggccaggcgggcgaggccggcgaggcccacgaggcgccgggcaggcgaggccagcgaggcccgcgaggcggcgggcggccgggcaggcgccgacggggccggcgaggcggcgctccccaggtgggcggcggtgctcccggggcagcggcgcttccggggcggcggcggagcccgaggcggccgggcgggaggccggtgaggcggcggacggccggcgctgatctctgtgatgttttttttcttgatctgtgtgatatgtgcggccgatttgtgcgatgtcgatttttttttcgatctgtgtgatgtgtgatgtgtgaatgaatttgtggagatgtttttgtgattttgtgaatgatttgcgatgtatttggggataaaaatacagcttgatgtatttggagattttgtgaatgatctgtgatgtatttggggataaaaatgcagcttgatgtatttgggaattttgggaaggatccgtggtgttaaaatgatttgtggataatatgaatggtggtgctcgaaaacatgaaagcaggaaaaaaaagaaaaaagaacattagtcccggttgttaactctaaccgggactaaatctttagtcccggtttttaacactaaccgggactaaagatccatctttagtcccggttatttcaaccgggactaaaaataggtatctttagtcccggattcatagtcccggttgtataaccggtactatagggggttgcgaaccggtattaaaaagggtttgtccaccagtgatcgtttatctcattaaaaatatatttatagctgctcttatgca

SEQ ID NO: 69222 - DNA, 9794 bp, Oryza sativa
cccgtttttattttaatacttagaattggtgaggataggaaagaaggacgactgtgcttgtgctttaaaagtagtagatactacctccgttccattttaataatagttgtggtacccgtgcctaacgtttactgtttatcttatttaaaaaaatatgaaaaaaattaaaaaataagtcacgcataaagtactatttatgttttatcacctaataacaataaaaatacaaatcataaaaaaatttaaataagatggacggtcagacgttggatacaataaacccacaactgcatttaaaatgagatgatgttttttctttctggcatatagtattcggtatttcatgacagcagaaaaaaaatccatcttaacacagacagaaaaactgcatacatattgatgaattgtgcttagttttagaccacatatttccgttggaaacaaaaggatcatctacagattctgctgctccttcggaacacagaaatccacatattctttcttttttttaaaaaaaaatacaagtgtaattaatagtttttcccccaaaagattatcgcattaccaaaagaaaaatgctacgcataggatcattttcttatggttttgatacgatcaaatgaaacggcacagactgtaagggaacctaacgcgagttcacgcgcacggggcagtccaagagcattcatgggccctaaagctcaattcacctcttttcatctaactttacatctttctttgttgaaccctaaacctaatgttccctattccatggtttcatctaatatgcaagtctgcaactaattcagatagcatacgccatcctaagacgaaggtatgtcatcttatttgcttgatttccagcttgacaatcatcttctttggtgcactagtctctctcttttatgttcctaggcaatctccatggccataaaatgattgtatttttttattatagatttaatctgaaaatttgctttgcaagacatgccattattttcaatttaccagtttcagcaatgaagaccaacttgtctactaatgaagtacaagatgacattgccaaatctgatgtggatgatttgctgctgagggggtccaaaatgaatcagatgacacatgataaattcaatgttgagcaccaagtacaagtactatataagatatgattaggaagaagattgctttggttggttgtgcaatcaggacaacgagatagcagcccaaaacgtcgggagcttgtgtgacatcttggcccaattaggatgagacctgtgtagctcatgtgagttgtctgcgcatgtttagtaccaccttactagtttagcacgagtggaaccaacttataaggtcttttctctccaaccatgtcactcccaagttaacccttttacacgaagcgaggacgaaaatgtaagtggagttgtatgtgcaagtgggtccgcccatcggttgggctggctacgcggcgtgcgctatgcctgtgtgtcggttgggctggctggagggaaggctcttacagcttggactttttacacgaagtccatgtcaggttaacccttttacacgaagcgagtacgaaagtacaagtggagtggtatgtgtaagtgggcctaccaagcgaggacgaaagtataagtggagtggtatgtataagtgggcctgtccgtcggttggatgggtaagttggaccgacggggacgtcgggtcctttaaggaggggtgtatgtgacatcctggcccaattaggataaggcctgtgtggcccatgtgagctgtgtgcgcatgtttagtaccacattgctagtttagcatgagtggaatcaacttataaagcctcttccctccaaccatgccaggttaacccttttacacgaagcaaggacgaaagtataagtggagtggtatgtgtaagtgggcatgcccgtcgtttggtctggcaacgcggttctggttctggagggagggctgttacagcttggactttttacatgaagcgaggatgaaaatgtaagtggagtggtatatgtaagtgtgcctgtccgtcgggacttggactttttacatgaagcgaggacgaaagtgtaagtggagtggtatgtgtaagtgggcctgcccgactgttggactggctacgtggttctgggggggagggctgttacagcttggactttcgatatgggctcaacagtgaaaggcgatctgttttatcgaaaaaacattaggagagaaacgtttcatcatacaaccatcgtagaaaataatcatatgtacaacaatgctcttttctatgaaaataatcatacgtacaacaacgctcttttctatgggtacacatcatgtattagtgggactatttttgcccctaagctcaagtgccaactagatatggttgggctacacatttcagaaaaaaaaggggtatggttgcatttgggcttgttgggccttacggaggatcaaatcttttaccagcttgatacatgtagatagaaataacaaggttgattataaccgatataaaaagacgattaaaaccatgttggtacaatagaagataatgtatagggcaccacaagagatatgaacgtgtataagacattatctaccaataatgctcgacattattgaaacaccataaaagatatgaacgtgtatagggcactatctccaataccatggcaaatctacaagttggagtcaccagaaaaatcagtgatccaaacaccaaagctgttgccactgaccggacaatccgcaacctggtagacaaacattcctaagtcttcatcaatgatccaaatgcaaacatcaataaatagatagaaaaagaaagtaaaaaactctagacaatgctagcttcatagacatcataaaagaccaatcataatctaactaatatacctaaatcttctaaatactttatttggaagaaacctaaaaaccttactggagtaagtcgaaaaagggttccctccccttgtcattggccaaacactagagacaaaggagaaggggaacgaaggctaatggcagttgaggccaccctcagcgattacaagtaatgaaatcttgtggaaacattttttcttcaattgaaagtattgcacattttagttgaaaataatttgttttgaaggtgaatttagcatttatagttgaaggtggcatttgtttagtttgagttatgttgtattttttagttggaagtttcatgcagtttttgatatggaagatgaaattacattcctaacttctactccctctagtttttaatatttaacaccattcacttttgaacatccatgcaccattggtcttattcagaaaactagtgcaaatatgaaaaaaaatatgtcatgtttataatatgtttaataacaaaacaaatcacaataaaataagtaataattacacaaatttttaataagacaaattgccaaatgtatgtccacaagtcaacaacatcaaacattataaaaactggaagaactatattataagatgaactcaaccaaaagtttccttatgatatattaaattaactgttttggaggtatgtcatgaggaccttcgactaacctgccgaaaccacctaagccatcaaaaatatcggtcaagtcttttgggcgaaacccccgggcgaagccgtagggcgaagaccaaggggttcgtcactaagaatcgggcaaagcctggcgatgaagatcaatgggttcgccaccaagcttggtgaccggccgaaggcttaccaaggacgaaggccgtcaagcgaagcatgaagccgtcgtctggagtagaagatgccttcggctaaggtcccgagaggcctagtggcccatggaggcccttcaccacctaacggccagcccaggaagatcatctcggggcccataaagataaaagacacagtatacccattgtaatatccctatcataagggtaacaatataaaatcccctgtactaaccaaaccatagtgggtatgagcctgtactagaattataaatagccccatagggccatgtaatgggggaccccaaaaattttaaccaattaatatattgttttactattctaaccacccaacgggtttccacgtccttcgacatgacgcggttatcattcgacaacattaactaagaatggacataccctatcttagaaagaagagctaaaataaacaagcctccaaagcttccctcttgctacaaaatgtttcaaactataaaacctttattttattttgctacaaagccattgctacaaaaacatagcagtgtgaagtttcgtatcaagcatctctaacctttagcaataggtgatatctaataaaatgtatgttaatttatattcctataggatgtattttagtttttgaaaaatatttaaaactaaggctaagtttaaattaggtgtacaaacggttgaagacttgaaaaatgggataaatcactagcgtataactaaatgaatattaattataataaacttaaaagatggatttgttcgatttttttttaaaaaattatatatacaatttattttcataaaacacgctcttcgaaaaaagatgctaacgaataacaagagagttgctgaagccaatggaccaaacaaatggggcctaactcctacctcatgtttttgttatgaaaaccaaccccaacatctaatattgcctatatcagggtttacgattccgacgaaatctggttggatttcgcgaaatttcgacgtttcgatgaggctcaaaagtagaaaccatataagatttcgaagagtttcatccaaattcaaatttgaattgataaaaaagaaaaaaaagaaaaaaaatcttataaatactatgatattcatataacctattaggatataaattttttaaaaaatgatgtattatgtgtttactaaaacttagctcagaaaataaaagaataaagaatttaaaaaaaaaggaaaacacttacatgggccagaatacatgtactaggcccagttactgatcgaaatttcgatgatttcgatctgaatttcgccaaaaccgactggttttgagaacttatcggcaaactcagggaatttgtattcaaattttggtttatgaaatttgttcgaaatttaccggtttttcaccggatttcgcgaaatcccgaattccgccggtgcccgaaacggaagggcctgtcggaatcgtaaaccctggcctagatagcattttagaaaaacttgctataacttttatacactaaatgcaaaaagtcttgattcctagaattatgagaagcagctagttagtactttctctgttttatattatatatatctagattcattaacatatatatgaatatgagcaatgctagaaagtattctaatatgaaacggagggagtagctagttttgaaaaaccaggagagttcgtttattagattttattattatatcccacaaccatttcttttaaataaaaaacaagacaaaaccttaggttttggaaagtcttcacttaatattattacttactgtatactcccttcatctacttttgatagtcatatttcatcttggcacacagaccaacgataagtgattctacttatcatctatttaaacatgctactagtcattcctcgtgaacaagcgattcattaatattttcatttctcgatgcctatgtagccaatcttgtgtggaggaatagagaatcacgcattaaattcgagaaagacattaagatgataggttgttggattgaaatatacttatcaaaaatagattttttagatttggaaatatgactatcaaaagtagatggagggagtatataatagcaataacaacaacaacaataataataattaaacacaggtaaacaaagaaacaaaatcaaactccttccccccaaaatccttccaaaattcttgagaaaagctccaacctttcctcttcttcctcttcccctccctctcgctgcctgccgcctctgcttgctcagatcttctcctctccttcccggattccaccctcagttgttgtctcacagtctccgaatcgctgggcggtggagccattggtgctcacccacgggcacgggcgatgggcgccgatggcggcggcggcggaggccggaagagctcgtcgccggccgggaagccggcggaggcggcacgggcggggagcctgctcgccggactcccctcgcggggcaacttcgtcgccgacagcatcgcgtccagcatggtgcgttcgttcccccccacccctaaaatggaccagcctttttcttggcatgttagaagggttcttgtgaaaagccctctgatttttatgattttttattattattttttgcgcagggaggcctcccggtttatgtctgcctgcacgacaccgctcctccaggtttgtttgtgattttctaggataatcaagctttacttttattattgtgatgatgctaatttgttgttttaggaatgagggctgattgtagtgctagtggtgtgtactgtggagagacagatttgaagtagaaggatgatcctttctactagggttttatgtagaattttccttgtaagaacgcagtcatcttgcctaggttttgttctttcgattggcaatgctgttggcatcatgcttaatttgtggttactgaatttgttttgctgatgttaagagttggaatttctatgggtttactcagaatgtctcttgcaggaaagctaaagtctatatttgttctttggatttgtggtggcactgttgattgttgtcatgcttattttatggtttcctggagtagtttacaggttttcggagtgagaattgcaggtgtttgtgaaatattgtactgaaccattctttggtggttaaatagatttaaatcttctggatgtaaagtgtaggagtttagtagcttggcaatggggataaatggtttgctttccattcaatgaaatttagatttagtagtgtttgggagtgaattttactgcctttgagttttctagtgattacctaaagtgagctgtccctaaggaaaaaatgaagctacagagaagaatttctgatgttgctttttttttcttcggatcgagtgagacattgtgctgctgtcacaaaacttttgccatgtgtttcttgggagtcttatcttttgaatatcatttttggacgtatatgatttacattttatagtggcagttgttagtatatgatctattgtcagaccatgatcttttacatattttcattacttatgttcttatgataaagctgattactgatgacacaaacagatcattttaaggctgttttgttctgttcattgactgatcaccgtttttgtcattttagagggacaagttatagacacagacaccacaaacattttaatcagatctctccagttgagcaaacagaaaaatgaggcaaaagatgtaggatcaaggactccaggagaaagcagcaaggggaaaaggtacatcgctcttacgacatctttacaatattgaacctcatttttgcaatgtacaatgttcagttttagagtttcaattaacagcttcagattattttcttcatgacatggttacttgtgaactgagcatgtccctcctgaaacttttttgatcaaataatcctccctggaacttgcttcttaatctagcgttgtttgtcattttcctcacttgatattaagctattgacttactgtcatttttatcgatctgttgaacagaaattcatccatcatagttattgcctgagcagaatgtagtttagctctatttttttgagcaaaaaccatctgcagaaccttcgtcaaatatcaatggaaacattgttttgcatgaaggccatcaatttgatacaagctgttggatgattttggaaacttgtttccctttaaaaaaaaatctatgaactaagtaaaatccatatcgtagtctcttggatgatacaagtgctaggctacagttaaaactgtaagataggcaattatcagacgaactctgaaaacatgccttgacctgggattaacttggggaatgccctagtctatttaattgaagggcggtgtgctactgccatttgcattacaaaaaagttatgccagacaaacctattgttctcctatgttttttttttttttagattttgatttggtgccttttctgtcattggaatttttgtgccatttagattgcttgtgatgccagctagtaggacaaaaatcaactcttttcaattgctgacttgtagagaagttgtctcctaaaacttcttgcaattgtcagttaaattttatcctccatgtagcttatgttccttcttttttatcaggtctgcttccagacttttagatggcaagaatccatctaaaagagctaacactggcagcacggcagggtcatctgcccatggtaactatttgattcttctctgcaccctttcttatatgagtagtcatgcatagttttatgagtaatatgtgcattgaaggaaaaggcttatcagtaatttatttgttgctgttgtacgtttgcagtgttaggtaaataatgttagttccttggaaaagaaattgctgttttccctttgttttcttggtctttaaatttggagttgtcaaacttaggctgtgttcttttggaggggttgcgaacccctccccttcgcacggaaaacggagcgatagattaacacgtggttaattaagtattacctataaaaaacttgaaaaatggattaatatgattttttaaagcaactttcctatataaactttatgcaaaacacgtaccgtttagcagtttgaaaagcgtgcacgcggaaaacgagggagatgggttgggaacccatgggaaagaacacaccttaggccgtgttctttttatgggattgttttggctgattagctgcatgcaaaatgagaaacataattagcatatgaataattgagtattaattattaaaaacttgaaaaatggatttattttttttaaagcatcttctacatagatagtttccgcacgaaacataccattttttttttgagatgagagaaacataccatttagtagtttgaaaagtgtgttaacggaaatcgaggaatagctaagtttaatcagctctttagaacttgcccttaatttgggtgagaagttgaagttattataggacaaataaactggtactctactttgagtggtacttttctgtaaaaaaaatggcactgagggcatttatgaaactatagctgatgcagatagcaaaaattgcgtgattcattgtcgctttgctaacttttatgttgctattatatgacctatttcctgaattttcagaagcatttagacagttgtatacatattttgtttttataatacgatgcaacatttgtttctttttctgactacagtgatgcttctggccagcttagttatatgaagtaagaaatcaatacatcttaaattgaagtatccaagtataaattccaatatggctactacgtcatatatcaaaatcttaaaatataaataacattatgatagttttgttggtaaaattgattaatttgagaaaccaatgatgtggttttaatactgagtactggtagataattaaaggaacgcactgccaaataccacgcaaatgtcacataagctggagaataacatttgctgtgatattttccatccaaaggcctcaaatgaacaatcatgcaggccgaactattttcttatttccttcctttgatgtactccatgtaatgtgcccatcag

SEQ ID NO: 69223 - DNA, 7585 bp, Oryza sativa
tgcaattcacagattttgcaatggcatttaccagcccaagtttgcagtggtattttccaagttacccttctttgagatggcactagcaaatttattgtgtatatccctttgtatatgatctgaataaatagtgaaactcagataatttcagatgattaaagtctgctctaactgtgcaagcctagttttcttgtaccaaattagaattctgaataacaataagattccatatgtttttgaaaaaaaagattttgacctatattgtacatagattattcagttaacacctttttttaggtattttccctcatcatctgagcatcaatattatcttgagaacaacataatccacaaaattctgagcatcaatcattttagtactattgaatataatatcaactttgatcttgcaggggaattgggatctgttttttctgagcagacgctccaatcatttacggtggagaagttgcgtattcttctgaaagagagagggctctcaccaaaaggcaaaaaggtaagtacagaaaatgcttaattttgtaactccctctttcagttttaagaacttgcaaaatcttgtttatgcctgggagattgctagacgtttgacacccaagggtacattgttctgctgtctcatttaaatctagaaaattttaatagtactttagttttctagtcataaatttatgactagtgagtcccagtgtgaatatttctgttgtaaatatttttttcattatattaataaagcattaacagcaggggcctcccctgctgtgttgtctttttaaaaaaaaagggaatcatacatgtgtggaacacgctgcttaaataaaaaatcatatgtttggaattgttgataatcatatacctgaatttcaagaaatattcacatctttttgattgatcgactttagcaattggaatttcgatctctggtgactggtagcctagcggtgggtcatcaggtagagcagtttgttatatgcttgggtgagggtgtttggcttcatcagaagcatgcacaatgtactgttggcgactgttgctgtggtgctgaccattatggtgttggaattaaagggaaggaaccctcagattgtggtgggtaagagatggtggtagtggaatcatatcaaagtgtggtgctattgactagagaaaagttgatgcaggaaggaaaaaactggagattgtggcggagggttgggtttggtttggctttggccggggataataaatgatggagctgtagcctgtagaattaggccttgtttagttcccaaaacaaaaacttttcacccatcacatcaaatatttggacacatgcgtggagtattaattatggacaaaaagaaaaaccaattacacagtttacgtgtaaattgtgagatgaatcttttaagcctaattgcgccatgatttgacaatgtggtgctacagtaaacatttgctaatgacagattaattaggcttaataaatttgtctcgcagtttcctagcggaatctgtaatttgttttgttattagattacgtttaatacttcaaatgtatatccgtatatccgatgtgacaaccaaacccgaaaatattccccaactaaacaaggccttagatggacttgagaggggtggattttgcttagagggtatacagaagggtaatgattacttgaatagacatggtggagaggatgttggtttgggtgcgctgacgattgaggatatatactgaaggttttagatatgatgtgtgcaaaccatgcagaaggagacatgaccatattggacagctttggtgggcattcaaatttttaatgcaatatgatatctaattggcaaatggtaatttgtatggtgatgaaatcacaaacacacaagttacagaaatggaaatacaattgttttgatgtttttagggccacagttgtgttttcttgactaactatgattagtgaaccttgtaaacaaataaacaatagcatgagaaacagaaccctcaccccaaccatgatcagcactgtttgcacctacggacactggatttcacagggaaactggaatttgaaatggagtactttctttgatgagtagaaaggcatgtattgaaaggctaaacaccggctgatagaagttgtcaatatatggagacaatagtcttatattcgctgcccattaaacaaaataatactccctccatcccaaaatgtttgatgccgttgacttttttgaaaatgtttaaccgttcatcttattcaaaagatttaagtaattattaatttttttcctatcatttgatttattgttaaatatacttttatgtatacatatagtttacatatttaacaaatttttttgaataaaacgaacggtcaaacatgtttaaaaaagtcaacggcgtcaaacattttaggaaggaggtagtatgaaggatatcacacgttcgaagggttgttcactttactgtctatcttttgaacatttagttatgaaccaaaaaagaatagcactcatttattttgagatcactcatctaattccttttcttgctaaatcaaacttttgtcccttgttgcaggatgaactgatcgcccgcttaattgagtcctcggagtgatctgaactgcgatcggaacctcattttgttggatgttgtaccgtagtgacgatcatacaccatgcaagtgaacttctatcgcagacctcatgtaagcatatatttcatacagtgccgaaatgaaagatctggctgatagtttccacattgcaccttgttcgatggagctccttcaacgtttgcacgacgtgttgtgtttaacactagtgttacccagggcaccaagtctgtctacgtccgattccctcttggtgaatctgaatctcctattctgacacttcgtttcgcatcgtgtcggtgcctgggtacacctgtgcaccctcacctcgtttgtactccgtagctttctgggtgagaaaggctatttagaccattcccaacccaagacactagacatagtttttataaactccgcgtcattatcatcaagaaactagtactaggcactattcttccaatgcaaacacaactattccatacatacttatcccacacgatgtcttggatgttgtgtagaaattatgtctcatgcaagatatggttttcttctctttcttcatttattcgccacatcatttttcgtcctaggtggcagcttatttaatgctatggacatcatcctagttattgggttgggaatagccttatgttcctacggaagcgtctttgaccgctgcgcgacgaggcctctttggatgaggtgcttgcggaatttgtgggccgctacccccgcaaatcatcgcggcgcggacgacaatcttcgaccttgacgcggtggtgggcgacggaatcatcgacctcgtcgacgtgcaacaaggagcaagctagcttcgcatgcttgcgtgtatcctcattctactcttttatgttgtcaactatgctatgctgcagaattacttcttactactatgtcccagaaaaaatcaaaccctgggtttgtgtgtctagatttagacctagagttcgatttttttttttgggacggatgggtacttttgttgctccaaaaggactcatcgacaccgaacggctgcgtccatcgggtcacagagcatacagctcatgtaccgcgctacactttgcatatatttcatcagctcatgtacaactcaagtagcgcgcgtggtacatgagctgatgacggaaacgacatgcgacctagcttgtttccatggaaacaatgctgcgaggtgactgccagcgatagatgacggtcaggcaaaatatctcggaggatacaagtggacagccacacaatgcatggaaccagctagggggccacatcctgcttctttggagctctggtgtgatcgaagttcgcgacatcagactaagacttctcaatcacgaccagaatcacactactgaacagctcggataaagcttcctcctgtaggcggtttataggcccacgagccatagaggaaaggaatacttccttcaaggaattaggaggctaaggctgtgttcgttgctcctagttcccaacccctctcgctcgtattccgcgtgcacgcttttcaaactgctaaaggtgtgtttttaataaaaagtttctatacgaaagttgcttaaaaaatcatattgatccattttttttaaaaaatagcaaatacttaattaatcacacgctaatagaccgctccgttttccgtacgtattgttccttttgggaactggctagacgaacacagccaaagccggaggatgacgagctgtggctattaattggtttcaacatgatttataaggcaaacgataaaaaataacacgaacctcaacttgaggtgaatgagccggttccgtgctgctcttaaccactgtgagctcaaagagatccaccttcaaaataggaaaatcacttggagaaatgagagagtttagctgacacttgttaagatggacagattcttctgcaacgaggaatgggacctcacctttgggcatcacatcctccatgcgttgtcttttggaatatctgatcactaccccttgcttatctccaacccgggcaggccacggagccgagaaccttcaaatttgagaacttctgggtaagactatcatgattcaaggaggtggtcctgcatgcttggactcaacaaacgacacaccacgaacctctacaccgcctagctagcaaacaaaatgagacgtcctatgattgctttaaaaagatgtgtaaagggcgtttgctcaaatatcacatggcattggacgtaatccaccgatttgacgtggcccaagagggccgacacctaattaacacaggcagaacacaggctccgcgcggccctgaaaagaaggctcctaggttttgcggtcattgaaagagcaagggaaaaacaggctgcaggtaacaaacattacagagggagatgcaaacatgaagtacttccacggcaaaatcaatgcacgcaaaagaaaaaaccacatctatcgtttgcgcaagcagagtggttgggccgtcacacataaagaaaaggagctctccatcgctgagcacatccaacacgtaatgggccggcctgaggctagaacacacgatctcaactgacctttcctaggaatcaccccgctagacattagcagcctagaagaaccattcacggagggcgaaatccagaaggcgactgtacgacgtaagaaacgtgcatctaaatcttctcaactctacaaatgtggtccttattccaaataaagatggagcggaggaaattggagactatagaccaataagccttcgtcaaaatcttatccaaagtgttggccatcagattgcagccgctcatgcattcgatgatctcgacaaaccaaagcgctttcatctgaggccgaagtatacatgacaatttcatgtacgtcatgaacatggtgagaaagcaccatagaaaaagaagatcgattctgctcttcaaacttgacatctccaaggctttcgactcggtgcaatgagattacctcctaaccttagtgcataatagggggttcccatagagatggaaaaataggataacgggcattctatccatttccatatcaaatatccttctcaatggaattccgggccaaatgattcggcatggaaaggggttgcagtagggtgatcctctatccccgcttatgttcatcttggcaatggatcccctataacgaatgctcaaaaagccactcaaatagggctgatcagtaagctacgaggcagagcagtacgcttttgcacgtccatgtacgccgataacgcgactgtcttcacaaacccaagcaaagaggatgttcaggccttctccgacctactccaccactttggacaagcaacgggattatgtacagacctgcaaaagtcacaggtggcaccgattcgatgtgatagcttagacctggacggcatccttgatggcacgccagctacgcgggcctccttcccgatgaagtacctagggctccttcttaccacaactaggctatgaagaagggacctccaaccgctctatgacaaaatcaatgagccggattgcaggatggcgaggaaggcatgtgggttaacccttattggaaatcaagaagcgggttagagattatggttctaatcatgacttagtagataaaaattaactgatgcagcactaagtatgaaaaaaaacataatatctagacaatcaaggatttgactgattttcagggtggtagataccttagttaatctaacctggtaaagcgatttagccgataccgacataaaccctaaaacgaatctcaaccgatataagtaaatcgagctatcaaactagttaactaagatatatgacaaacaggtgcttacatttacaagattagagtgttgaagccctagccgtgccgatgcaaacagccatgacaagtataaactcgtcgaaaaactagaaaagttaaaagggtggcaaatttgtattgatcgtggagatagtttacaatgaccccgggtgtacatatttatacccatgggtagatacgagtctttcttgggcaataaagaaactttcctaaagataaaaggaaaacataaagtccttataagacattaaacacactttcctaaagataaaaggaaactagcagactcttactaattaatagataaactgacatatcacatcctgcttgaatttggtctcttctagataagcttcctttaattgattaatttccttaaccgaatatagtaagaatacgactattggcgacttgataattctcatcagccgattctaggactttgaagttgatattgactctaggcagatgatgacttcagggcttactaaatttcactgttaacacatatagtattagatagtatctaattgctatattttgaatcgaagggaataaaatttagttgacaacgctgtcgacaggggatacccgtagactggatatagagggtattggggtacgctggtacgaggatctacgtagtacgacatcaagcaaacaggaaacagggattatactggttcaggcctcttgataggtaatagccctaatccagttgatatgggattatatgatggaaaccacagattacaaagggaataacagaactcgatgatgccgacgagaccatagtcgagttggttcgactagatcacccggcgatttggctcctgtaggctccgacttcgtaggctgtggtggatgtgttggcggtgagattcgatgccttaggtcctcccggggggtcccttttataccgcggatcaattgatctctaagtcgaactcggagatatcggaccccacacgatatggtaacgacccagtcttgtccgcgtaggagttctcccatgtatggattctatttctgccacgcgatagatttccttaacgtatacagaaactgcccgtatatgcacaggtataccatattggtatacaacatacatccaagggtagagggtataccttattcgtaaccctgaca

SEQ ID NO: 69224 - DNA, 19825 bp, Oryza sativa
atgtagacacgaatacggatatttttttcccgaatacgaatatggtatcggggtttctgtcggatacggatatccgatgaatagtgctattcggatatccgcagaagccatgagacataccatattttttttatagttcaatgacgttcaatataccttttgaaattttaaaagtagtctatcttttaacattagtccctgctactaatattatttaattttttaaaaaatataaataatactatatttttataaaaaatgagctaattatatatgatgatatttgtttctactagaagttgagttggttttcgtgttctaagataaaattgtttccgtattcgtgtccgatcatattcgatttttattcatattcgagataatccgtatttgtttccgtatccaagctattcgtgttcgtttctatatccggtaaaaaaaatgaaaatgaatatggtatgagtattatccgtccgtatccgatccgttttcatctctaattcatatcaatgatgagcaaattatatctattcaatactcttttgcaaaatccaaatgctagctgctaatgctataggattttaagaacttaactatatagttcagttctattgtgcagtgaagaaacactattttacaaacaattaaacacacgggcattaattttttctccagagaatatgaaatgaattcagggacatttctgaggctaatttacgcattattaactgctgcttcgcaaaaccactgtttttggcgcaggaggcaaaggatcaaaaactaggggcgcaactcactgggcgatatgtgcaaagagtctagaactaagcataatctatagcgtatcacaacaacgaaaggccgatcctgatctggacaaacgatgggaactgcgtttgttttgttctttcctgagacataataatttaataatggccacacgcccacctgctacctaccttgtcatgtttgctctggattgtttgtcagtacgagcatgcagttctttgctgtgttggtgactactagaaggctagtgtgtagtgtgtgtctatgtatacatgcacaagaacgaaggccgtggcgactacgagagatattatgttaatttattataccatttcagtcttgtctagctttgttaaacttgggaagcttgaacgaagaataggaggggctattatgctattttgtgtaacagtacttcaactcaatatagtgacttatggacaacataatttttcaaaaacttagagtcggggacatgacaatattgacctcgatgagctttgccacttactcgacaacccaggctgccttacttctcccattctattttccgactgctcctaccatgagtccgcgtgtatccaagagcgtcaccgacatcctccaagcttgtcttcaccgcccactttgaacgggcattagtgttcctgatggatggaggttgacaaaaatcatgaccgagaggcatggttggaattttttaaaatttcaatggcacgtagtaggtttcgtgaatggtaatagtatttttttaatatgatatatttactatggcacgatctaattaactatttaaataatttaaatgggttgtttatcaatattttcgtagctagcgaagctataaagctgggtgcaacagaagatccagatgaagttagtcagtacagtgaacggcatcgggaaatgcaggcagatgatgtctgtgatgacttcatggagcactttacaagtcacacttgacttaaaaaaaaaactctcaatatgcaaatgcaagcacacgcttctatatacttatgttagtatgtcgtgcaaaactcttgcaacttggaattcaatgataattagaaacataattccaattgttagctaggatcaactaattataacacatgctggaaaaggaattccatgatacagaggcacatttgcatttaccaaatacattcagggttgagagagatgtatggtcagctaatacaaggcaaacttgactaggcttttatagagtacctgtagaacggcacaaatgcaaggcacaagtcaaacaaacttcaaaactgttgaagatgattggatgaacatatatgtgcaaatttgcaaaaatacagtggaaaatgaacgatggcctaagtcagtattttgactatttttaaataaatcaaataaaatactctctccgttgtatattataagtcgttttcacttttccctagtcaaactaatttaagtttgatcaaatttatagaaaaatataactattttcaacatgaatcaagcatacttttaaaatgtgttaaatgttagttttgatgaaactagtttggtgctatagtaattactaattttttctatatatggtgggtcaagtttgactatgaaaaaaaattaaaacgacttataattttaaacgaaggaagtacatcttaaggagtttaacatgtaccagacctatacatttattaaaataatatcctagttataactttccaacctatacacacatatcctaataagaacatttataaagtctgttagttacgcaactacactacaatagaagcaggagaccactctgttttggaggatgtaaaaaattccaactaatgcactaatacttgacaaataaacttcttccacataccagacataaaaggaacgagtatcataatgaacattaggtgtgataatgctatctactccctctatcccaaaatataataatttttaagtggatgtgacatattttagtacattgaatttggacattcctacctcatccccgcagaaaaacaaaatcaaaactttgtactttaaagttaccaagaaaatttctttttatttttttttgtctcctcacaaaaaaaaagaagaaacaaagtcttcttgttaagtttgtactaccatcgcaccagagagagagagagctggaaatggatcccctttaaaagccgttgcgttggctctgccgccttggcaacaacatccaatttccaaaccaagagagaagcagcagcgatggcgatgcggcagggagcgctgcgaggcccctccgattactcccaggagcccacccgccacccctccctgcgcatcaacgccaaggtgccggccgtgatcgcagcagcaagaatcgcatcttcttccttgagtttctactcgtacgtactcgcgttgagttcttttgtcgcgcaagtaaaatgtgttttttggggggcgatggatgcgtgcaggagccgttcaatgcggaggcgacgaggcgggacctcgtggcgtcctacatcacccccgtggatctcttcctcaagaggaaccatggccccatccccatcctccacgacatcgacaggtacggttcttgatttgtatttcctctctttgcctgatttatttttgtcaccttcttagtttcaacttaaaatggtttcagtcttttgttttgtggatttgcagctactatgtgacggttgccggtctgatagagaggccagcgaagctttatctgaatgacatcaagtgagtcgtgtgtcagtcatcgtggctgtgctatgcatgccttctgtttgatgatatgcctgagaggtgatcgagttttttcgtgctttctttgtgtgcaggaagctgcccaagtacaatgtcactgccactctgcaggtggattttggtgtcctggtggactggtggtgtgtgtgtggattcttagggccgaattttgtgtgacatggtttcgattggttcagtgtgcagggaacaggaggaccgaaatgagcaagagcaggaaggtgagaggcgtcggatgggatgtctgcgctctcgggaatggttagtgtgcttcacttctcaatcttctttgtgtcttactattagcgtggtggaatacggcaaaaggaagaaagaaagaaaaaagatgcatggacattctccagttaagtgtgtataggaagttgtcatcactcaccaatgtaataaggaaacctgtcttatatgatcttagctgcaattttgaatagaagtgagttccatgagattgataaaggatgtgctgtaaatgtttaacttaattcttctgcacttttttactgtcttcgatgcataatcatcatattcactgtcactgaatttatgtgcttcattttagcgacatggggaggagctaagttatctgatgtccttcagctcattggtgtgccatatcatactgaaattactccatcaggaggaaagcatgttgagttcactagtgtagatcagtgccctgtgagtttcttgagacttcatttatgaaaaaaaaaaatatatatatgacagctttagttattttttctataacatctttttcaaaatattattaggaggaaaaaggtggcccttacaaagcatcgatttctttaggccatgcaacaaatcctgcagcagatgtactggttgcatatgaaatgaatggtgaggtaggaccataggagataataataggttatatcttatataccatccttacatccatctatcaggatatttggttatttcatatatctgtgcatttttctaatcatatccctattatgtgtttttgttacaaaggtgctcaagcgtgatcatggataccctctccgtgtcgtagttccaggtgtgattggtgctcgttcagtcaaatggttggacagaattgacataattgaggaagagtgtcaggtatgcattatctaacttcttgtcaatatgtaaatatattttcagtttgccaaaaagatttttgaaactcgttcattttcagggtttctttatgcaaaaggattacaaaatgttccctccatctgttgattgggacaatattgtgtggtcaaccaggaagccccaaatggactacccagttcaggtgttaattcttaaccgtcttgtttccacacagtaagagcaagagcaactatagcaaattgagcaattcagaaacaaaaaacatcatgttcctaaccatgaaaagtctgagtatacaaggaatttccagtatacatcatttcgatacaacagcatattggaatgaggatggcatccgtattttgtgctgcttatctaaatatcacacagtaaactacatgaagttctgtttccaatttacattgtcatatattctattttgccatgcaaaaccttactgtaacagtaatttcctctagtaatttactgtattgcataatattgaaaaattgtgtgcactaattaccttttggaccgactctgatatttcagtctgccatatgctctttggaagacacaaatgccatcattccaggagaagtgagttcagcttcttaactgggcttttttatttccattttgcttcatgacttacccctaacgctttgccttattgtgctcttcaggtgactgtcactggatatgcgttgtcaggaggcggccgaggtattgagagggtggatatatccactgacggtggcaagacttggttcggtgctgtccggtaccaaaaggaaggtgtaccatacgtcgcaggtgacataagtagtgacaagtgggcttgggttctcttcaagactgttatcgatgtgaaaggtgacacggaggttatcgtaaaagcggtatgctatcttgctagttcgtcctacttgcaattcaatgttgttttttctgttccattttacatattggctgcaggattgttcattctaatataaatgtactgaatcttgtggcacaaactatgcaggttgattccagtgcaaatgtgcaacctgagagcgtggagaccatatggaaccttagagggatcctgaacacctgctggcaccgtgttcgccttctgacaatacacaaccttagaagccttttgtgatgatcctacacatacacctaactagtattatctctttaaatttaccgctctatgttgcactgtcgttccgctttcggatctgcattggagaaaaagagtcaagagggaccaataatataatgctggctgacttgcttggatgctggaataaaatcccgtgccaccttgttatcctattctttttgagtaagaaatatgtgtgtatgaaataatgggcacaggctagatcaacctcatttaagagtgcaaaacagtttgcctctttgttttatttggatgcaacaattggtcaacatacatggaatggtttcagatttgtgtaaccatgtagagaaatagtgatctgaagatttttcatatgctcgtttggtactgaatcatcataatttcaatcttttagtattattactcctacattttagacaaaagctggctgaagccgtttaagttacttttcttctttttttttttgaagcggaaaggagttctgtcgttttatattggtagagggacagaaaaacagttatgttactcatacttagattaattaatctatctatttgggcttctgatccatgaaaatttgcattccgtctctgtttattcaatctgtaatctcaaacatttccaagaatgtgtgattgaattgcagaatgagcttggtatgcttactaagtacaccctccaactaaaaagaattaaacttctaactgtgaatatggacataaaaaaagatggagtgggtaaggatttgtaccaagataagagggcaaagtgtttatttatcctcttttctccttgtcagcatttatcaaaactgaatcaacattacaagcggtgacaggatcaaaagagcaatatttatgcaagtttggatgtattttttgattgcatgtaagatagaagcatatgaggtgatcatgtttaaaggcctagcttgtgatcgttgaattgtggtgggttgatggcccccccccccccccccccgaaaggccttgttgggtcaattccatgagggagggatttgaggggatttattccagatctattgtggtgtgaaattattcctcctcaatcccctccaaaccgaacaaagcctaagtgtttatgaaaataaattggtatagcccttatatatatgtttagatgtcctatacgttcagcacaaaataatattatcgttcaatatatatagactaaaagaaaataaaatttattaaacgcaacaatatgtagaagcaatcacaacaaacgggattttcataatccatggcaacgccattagcattcaaaagctcttttttttttactgacaaaatcagatggtctaaggcagtttaattatgactttttttttggcaccttctgtttctgaatttcagatgcccaattccactttcccaaacttttctgcatatattctggctgtattgctgataataaatattagaccaaagaatcaacaaccgtagagttatatagaattgaaggtacatggcactctccttgagcacatttgcagatatatatgggcattgaaaattttgctggactctaggagtgacgatttaggtatggaaggcaccaggacggatcagtgggcaagtgaggtggtttatgcaaccacaaggccaccagtgattttgatcagtgagctgtagtgtactaccgtttataatttttatcctaatttgcaatcaacacctaatagtacttctaatatgtttgaaaggtggctatatggatcaaattttggtttgggacaacagctatttcttgggctacatggctaagttgcaatgacatggtgttgataatgcaaaagcgtgttatcctatatgcaggtaatttcaggtccacacgctatgttcggcattagattttgttgcaaaaagaggagaaacgggattatgcaagaacatctaaaaacctacagctatgtaaatatgtaataagacatggctatgtgcatctgtcggtgtggaggctggggtatatttatattccattatctagaaaggatgtgcatgtgtaggccgcagttgataggaataacataaacaaacactatagttgttgatcatgtattagtcaatgttataaaaccagccccgaaatcacatcggaaaccaaacgcggaagaaaatgccatagaagatccaaacacaatgacgacaccgaggtacgatatttaataacggagttcagttgaggcctacatctccggggtactgattacgggcgctccttccctatccagcatatacagcgtatcagagttacaacgactcacggccggtcaccgccgccagctgctccctctcgctatgctaagtcgccatgcggtaacaacaggcacgcgccctctatttatgagagattctagaatagagtctgactcatactctggtcctaatacctattacaactttgagtcctaaactgtaaccgactacgtacacatattcgacacaaactctatcaaactccattttggcaaatatgccacagcaacctgaatttgttccttgctcgaacctccatgtaccaggacttgagttggttccttttcgctgctcacaccgagccgccccgataagccttcatcaggctcaccgtaaacaagagactccgctatccctgtaatttcttcttcttgactccacctgcaacagtgcttcaccctatctcatatcaccacagtcgtcttgccaagccaaattggatccttcctagctgtcacatcatacacttcccgaagactatgttcaactccatctaccgtcttaaatttgacttgatctaatccatggtcagataacccgcgttatcaccaaatagataaatcaaactcacctacaagtctaaacttgctttaaatctagtactctattaattgttgaaacttgtctgaaattgggctgaacttgttaactgtggtctggaatgaacatggtctgaatttgctgttgagattggtctgaacttggtgtcaaattggactgagcttatattgcatttgctgttgaaattggtctgcatttggtctcaatggtcagaaattggatctcgtacgtcaccattagtctgaactttaatttcttgaattgaaaaactcggaacatcatgtaaaatttatcactttttccacgattgcacaaaatcaaaattactgattgtaccataatgattgcacagattaaacaacactggataactggctaactgcagttcattgcatgcattacaggaaaacacattatgctgctagattactactagtacattatagttccctaagatattggcaaatgctataatattacaaacggagttgttccgttgttgacacaaaattaccctaaaatacagtgtagataggacgaaacaattggagtttcaaccggatccaatcgactgaaaccttaccattacatcccaatccaaattaagccagagttttcgcgggaggggactggggtctggtgtgtgtgccggggggtgggggtgagggggctcacctggagggcgtgcctgttctgcttgaacttgaggaacctgcggacgcagaagaggacctgctcctccgagagcgggcacctctcgcggagccatcggccgagctcctccaccattccacccgacggcagctgcgccgacagcctcgcgtagagcgcccacctcgcaccatccagcggtcgccgctccgggctcgcgtactggagaccgcgcgcctgactccccggggcctgtgagaggcgccactacatcagagacctgacaacatggtgttctgcttcttctcgtctcataattatgttggaattaatagatgggctaaggcctattcgaatattaattctttggaaaatcacaaaagcccacctcatgggatggcatacatgtggagtttagtaccactttgcttattctaggagaggggacctccttaaaagggaggatgccctcctagccacttgaagcatgtgtggtggagagaagagggggaacacgcgcttgcttgctcgccttgcctagcagggcagaattgactcctcacccttacacagatgcagccttcttttgcagttttgttttgctgcaggaaaattcggatttgttttgttgttggaaacattccggaaaatccggtgcatgaaaacggcgtggagtccggatcagttacgcacgacttatccggtttggttacgcggagtggagatcgtgcgggcgccctgatcaagcgacctatctctatataaaccgagccgctgccttcacgcaacacacgtgaaatcaatctagggtttgcctcctcctctgtgctgcgccgtcgctcgtagactactccagttttgttttgctgcaggaaaattcggatttgttttgttgttggaaacattccggaaaatccggtgcgtgaaaacggcatggagtccggattagttacgcacgacttatccggttcggttacgcggagcggagatcgtgcgggcgccttgatcaagcgacctatctctatgtaaaccgagccgctgccttcacgcaacacacgcgaaatcaatctagggtttgcctcctcctctatgctgcgcgtcgctcgtagactactccatcccgctggcagggcagaattgactcctcacccttacgcagatgcagccttcttttgcagttttgttttgctgcaggaaaatttggatttgtttcgttgttggaaacattccgaaaaatccggtgcgtgaaaacggcgtggagtccggatcagttacgcacgacttatccggttcggttacgcggagtggagattgtgcgggcgccctgatcaagcgacctatctctatataaaccgagccgctgccttcacgcaacacacgcgaaatcaatctagggtttgcctcctcctctgtgctgcgccgtcgctcataggctactccatcccgcttgcaggcgtgcacctgcgatcggaagagcaggtttccggaacctctgccttcgacgtcctgcaccgggagaagcggcagtaaggtttttgggaagcgcttcacgcgactgctccctgtttgtccgcgacggctcgccttcctcttcgttcgcgtgctgcgcgccttcgtcgacgctcgcaaccgcgagtagttcctgccgagcaaccggtctttccgccaccttggtacgtgttcgacatgttgcgcatatttgatctgtttatgttttactgcttagtttacatgtgtagatctaatgatgcgttaatgctagtatacatctgtaatgtcatgatttatttatggaatatattaaatcattatatgcctatattctcaacaatccaaaaaccttattataggcgctatgattttactatggctggttttgccgatgcactgaggccggataaatttaccggtgtgcactttaagagatggcagatcagggtcactctgtggctgacagctatgaaatgcttctgggtgagtactggcaagcctatgggcgttcttaatgctgaccaggagaaagaattcgatgaggccactactctctttgtgggatgcattcttagcgtgcttggcgatcgtctggtcgaggtgtatatgcatatgaccgacgctaaagagttgtgggatgcactgaatactaaattcggtgctactgatgctagcaatgtgtcacgtcctgataaattcatcccgaaattaaaaatcattttctaaaaggaataatagaattaattaaaattcgaaaagaaattggcaaacactaaaatacgtacaagaaaaattcaaatgtggcccggagaatttttgttaaattctccttggtctaaaaggagccctcaaattttacttgaattttcagagcacaaataataattaagaagatataaacaaagttaaaatggttttataaaaataaaagctctaaaaagtcccttttcccccctctcctcttgggccgcctcggcccatctccttccccctccctctcctctccccgctgcccattcggcctcctccccgcgcgcgcgccgctgacgggcgggcccgcccgcctccctcgctgacgggtggggcccacccgtcatccccttcatcccgccgctcccgccgcctcgcccgcgccctagcgccgccgccgccgtgaatcccgccgcccccgtccgccccgcgtgcaatcaataggggggaattattccccgggatcccctccccctttccccccatttttccctctctctctccctcggattggtttggaaactcctcccctaacctcgccggcgccattaatggcggccgggactcccgcgcccgtttccccctcctccggccacccctctcactcccaaccctatataaaccctccccgtgcctccctccaccgtttccgccactcgccgccctcattccctgtcggaatcgagctcgcgccgtcgctctctctccgccgtcgccgccgagctccggtccgccgccgtcgtcgccccggaccaccttccccctcggcgccgcctccttcggcttcgccgcatcctcgccgacctcgtccacccctccgtttcgctcgccgaccgccggagcaccgccgaccccgtccacccgagccgcgccgccgccttcctccgctccggtcgccgtttccgtcgtcgccatcgacccggggtgagccgtggaccgccgcttcttttccccccttcccttcccctccctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgccctcgggtgcagctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccattttaaattaaaaattaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacactgcagcttcggaggatccgctcttcgtggaagttgaagccggcgtttgggaaagcgagcaaggcaagtcacatcatccttgaacatattgaatcccagtttataaaattattttaatttaaattaatgcattatcgctttatttaaattcccgcgttaccactgttttatttagccatgcctatttacctttgttatgaccttattattgttgttattgttattattaccttgttcaccctagaataaacaaaaccccaactagtgggtactctattcatggttccactagtatgaatttaggtagatgcttcgctgattaataggacaacattaggtggttttataactttagacttggggaatattcatatctcttggacactatggaatggttggcttatggtggaattggacatacacctctcttcctctttcaaaacccctaaaacctgttttccggtggggtttgggtgcatgccagtcgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcggaggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtcttataaaatggctttgggcaactaagtgacttttaaatgctgttttctgcaaagcttaacccctatatttttaccccttgtacccccttgcattaatcatgcatctgccggtgtggcttgctgagtgctgtggttgtactcattcttgctcaatcttttccccccccttcagtaagagaagcttaggagaagaagtcttaggtggagtcctggcttataccccagttgagcgcctgtgaagatggagccgtaggcccgcaagtccgctgctgtttatgttgtttgtcaggcctaggtgcctttgtaataatgtaaatattatcgatataataaagatgtgtcttttatatcatgtttgtgtggtgtaccccggcttttcctgggacggggattaatacactagcgttcgggaaaaggcaattttctcggtcgtgacaagctggtatcagagccatctcgactgtaggataagccaagtggataaaacctaaggacatattttataaataaaactatttgcgaaagttccttttttctccttcccctaatgctatttgcaaaaggtttactcccttcttcctttttcggatttccactagtacttgatggttagttttgcaaagaagaagatgtcgtcaattgtctgccgaagctccagaaggctgcaggatccgctagtgaagtgagggaagcagtgaagccagcggtgaagcaggagtgaagatcttggagaacccgtcacagaacctaagccaccctctagggtagagtcgttagtcgtgtgtttccttgcttgtgtgtgtagcgcgtggtttgcatcagtgggttgtgatgtaaccatgctaggttgtttgcttaatcaacttgcagaataagtgaaacaaacaacacatcagcaagaagagttagttcctttaaggtcctgtccctagttctggtctattctttcctggcttgtttcctctctcacctcaatccctatcacagatgtttaacagagaaaaaggaaagaatgtcagcgggtatgcctctagtaacttaagtttccaactcaatccaccactggcctcaagagagttaacaagggcacacccttggtccattccaagcatgctgcttagttcacagctaccattggttggaagtcaagaccaaaatcggtatgtgtttgatcgagcatttgccacccaggtcaatgagcttccaatgccagaagagcatgtccccttttgtcatgattgtagagaacaaggacactatgccctgaattgtccatgggtatatgccaaagaagccccttcctttggtttagcagggcagacatcgctaaaccagcctcctcacaccaagtcaagcttgcagcctagtgtgcaaagtagagagcccaatggagagaatccattgaataccgggaaatgctttcctcctagcctttcgcaccacgtggggtcacgtactaagcaagccaaaggcaagaagagtaagaatcagaagagaaaagcaccgatgcgaactgaagaagaagtacgtaagatgactattaccaacaccgaatggcctccagcagggataactattcctagacgtcaaagaggaaataccttccgaggtgcacgacagttgacccagcacctcttaagccatggcggcagagtatctgatagtgaagggtcagatcaagtctccttggattatgaagatgagtctccccgacatgtcggcagggatgagatggaatcaaaagcatgcccccattgtggagaaattggacatgttgctagcatgtgtctcacactctgccctcattgtgaggaagaccatccaccaggtgaatgtcccacccgcaaggtgacatgttttctgtgcgaaggtacaaaccatgtgcccaaggattgccaactcagtgtgttgttgaccaagaccgcagaaatccaacgaacaaccctacgattgtctcatcagctagtcagctccaacaacaacatcgacgatatcatccacagcaccaatgctcctcctgctgcacctgactctgcaataaatcatagcaataataccttcagcaccaaccattctctgcaccgacggcctcagcaaagaattgtcgtcgatggaagaagttgtgtctctccccgacctactccaggccgagcaaagggcaatcaacctcaggagggcgataccaagcagaagaccgttatctgcttcgaatagcaatcagaaggaagcttctcctgtgaatgatagcaatatacagtcctatcacatcatcacagaaccaatcaaggatgcagtcactagaacaatgccagctatatctctccagaatcagaatgagtatccatgtttgtgatttttagttcgctacttatcacgtgttgtcgaaagtttgcagcaatcatgtaataaataaatatattcatgtctataaacagtgagcttgctatgtttatggatgattcctgttgaggatacaatgtaccgatgttaagcaccttccctttttgtttaaggcagggccttgtattcgtgtaataagggagaaatgtgtaatacagacaagttctaagaggattcttttggaagatgcagatatgtgatcatgtgtataattgtttactgacaaaggagacctagggtctcgtgtcagaggaactatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctacaaacagttaagaagatccaggggacatcaatatttgagaacatagtagtcgatggttggtaattagtctatcaggtatcagaaaagggtcaaaggtgatatggcagaagaacaatttggatgctccccatctcgaggaagcactaaagaggatcatcggcaattaaaccctagtggcatagatacagatagcaagcaatgtatttccctgaaggtagtcagtgcagctttttgacgaaccacttcaaggtttctctgaaagacagcacgcccaaggacctcattgccccagaagcatcctcaacacccggagcgaagagtacctggttgagaaaggtcgaaaggtgattaatggaagagatcggaaaagatgtttggttactgggaaaagaagtagaacgaaaggtgattgataaaggataacgagaaccatgatttgtgtcactcgaggaagactcccgatagcgatcaaccctacaacagttgccctgtcattaaagtaggtgaattcacgagtaagagagatgaccacaggtagaagtacttctatggggacaaggatggaaacttttgtgacatgaccaagaagtcaagaagtaaaaccggaacagtggaatctaaagctcggttcaaccttgggctttgtatcagatgctactagaataaaagcacttgcactagtatcgttcaacgcactttcctagcaatcgatccatcgagaaagaacacatcaaggctgaaggtgtaaaggaatacgttgaatgctaaatgataacaacataaagagaatagtgggaagtaaactaaatgtaaggaaagtgaatccgagctgcttgttcgtgagagccattcccagttatggaacaagtgatatgtttgaagataatctatagaggtcagatcaaaatcacatctaacaacgaagcttcagatctggcaggatcacgatcagacaataacaagtccagcagcaaagtcattcgggaagacgtcaaagcatgtcaagtgggataaattggttctcttgggaagcataacttatagtaagagtggttgacccttgcatcgaatagcagaagtacctagcaccggagaccaggaaagctaatatgagacagttaatggcaagttgtcaatcatggtatccttagtaagcgggatatcatagtctaaagcatatggtggtaagctggaaggaaacgccaagcatggtattctcatgatgacaagcatggtatcctagtaatgacaagcaggttacgacacatgacatgaagttgataacttgtgtgaggttgacgccgaagatatgaatcgtgagaagttctggaacggaagcatcattaaactaccgcaacctagtctgcgtcagctaaaaggtgcaccctggttcgagtcaggtgaaaagaagattccacctgcaacaggagatcgagccaagcagtccagagtggagaagttttgttaggcaagtttgttatagaagacggagcggaagaagtcagacaagaagagaagaccgcccaacctatcttcttgctaacctcctcgaatctcggagacgagattcttgtaagcggggtggatttgtcacgtcctgataaattcatcccgaaattaaaaatcattttctaaaaggaataatagaattaattaaaattcgaaaagaaattggcaaacactaaaatacgtacaagaaaaattcaaatgtggcccggagaatttttgttaaattctccttagtctaaaaagagccctcaaattttagtggaattttcagagcacaaataataattattaagaaattaacaaagttaaaatgattttataaaaagaaaaatcctaaaaagtccttttttccccctccccctcttgggccggctcggcccatccctccccctctctctcctcttccccgtggcccattcggcctcctccccgcgagcgtgccgctgacgggcgggtccgcccgccaccctcgctgacgggtggggcccacccgtcatccccttcctcccgccgctcccgccgcctcgcccgtgccctagcgccgccgccgccgcaaatcccgccgctcccgtccgccccgcgtgcaatcaagaggggggaaatattccccgtgattcccttcctctttccccccatttttccctccctctctccctcggattcgttcggaatctttccccctaaacctcgccggcgcatcaatggcggccggatcttccgcgcccgtttccccctcatccggccgccctctctcactcccaaccctatataaaccctccccgtgcctccctccaccgtttccgccactcgccgctctctctccccgccggaatcgagctcgcaccgtcgccctctctctccgtcgtcgccgccgagctccggtccaccgccgttgtcgccccggaccacctctcccctcggcgccgcctccttcggcttcgccgcatccccggcgacctcgtccacccctccgtttcgctcgccgaccgccggagcaccgtcgaccccgtccacccgagccgcgccgccaccttcctccgctccggtcgccgtttccgtcgtcgccatcgacccggggtgagccgtggaccgccgcttcttttcccccttcccttcccctccctcggccgccgctccgccgtgcctatggccgccgccggcgaccataggggcgcgggcgcgccgcctcccgggctgcagga

SEQ ID NO: 69225 - DNA, 7027 bp, Oryza sativa
atgtgatcatgtgtataattgtttactgacaaaggagacctagggtctcgtgtcagaggaactatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccttgaaggtagtcagtgcagctttttgacgaaccacatcaaggtttcactgaaaggcagcaagccaaaggacctcatcgtccccagaagcgtccgcaatccacattaaagaataccacctgttagagataagctgaaagatgattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgaggcatcatgaagtaagcaagacgacctaggtaaaagtgtttctttgaaggcaaggaatgaaatctttaactcggtatcagatgctacacggagtgaaaagtgcaagcaccggttaccaggcaatgccatgtcttgggagatgatccaatgggaaagaacacatcaaggttaaaggtgtaaaggaatacgttgaatgctaactgaggacaacctgaagataatagtgggaaataaactgaatgtaaagaaagtgaatccgagctgcttgttcgtgggagctattcccagttatgaaccaagtgatatgttcgaagatagtctacagaggtcagacaacgaagcttcagatttggcaggataacgatcaaacaataagaagtccagcagtaaagccatttgggaagacgtcaaagcatgtcaagtgggagaagttggttcggttgagaaacataattcaaaggcaaagttatcgacccttgcatcgaatagcagaagtagctagcacccggagagcaggaaagttaatatgaggcagttggtggcaagttagaagtaaatgacaagcatggtattctcatgatgacaagcatggtatcctagtaatgacaagctgatatcgacgcataacgtgaagtgggtaacttgtatgaggttgacgccaaagatatgaattatgagaagttctggaaacggaagcatcattaaactaccgcaacctagtctgagtcagctaaaaggtgcaccctggttcaagtcaggtgaaaagaagattccatctgcaagaggagatcaagccaagcagttcagagtggggaagttttgctgggcaagcccgttcaagaagatgcaacggaagaagtcagacaagaagagaagaccacccaacctatcttcttgctagcctcctcgaatctcggggacgagattcctgtaggggggtggatttgtcacgtcctgataaattcatcccgaaataaaaatcattctctaaaaggaataatagaattaattaaaattcgaaaagaaattggcaaacactaaaatacgtgccagaagaattcgaatgtggtccggagaatttttgttaaattctccttggtctaaaaggagccctcaaattttacttgaattttcagagcacaaataataattaagaagatataaacaaagttaaaatggttttataaaaataaaagctctaaaaagtcccttttcccccctctccctcttgggccgcctcggcccatctccttccccctccctctcctctccccgctgcccattcggcctcctccccgcgcgcgcgccgctgacgggcgggcccgcccgcctccctcgctgacgggtggggcccacccgtcatccccttcatcccgccgctcccgccgcctcgcccgcgccctagcgccgccgccgccgtgaatcccgccgcccccgtccgccccgcgtgcaatcaataggggggaattattccccgggatcccctccccctttccccccatttttccctccctctctccctcggattcgttcggaatctttccccctaaacctcgccggcgcatcaatggcggccggatcttccgcgcccgtttccccctcatccggccgccctctctcactcccaaccctatataaaccctccccgtgcctccctccaccgtttccgccactcgccgctctctctccccgccggaatcgagctcgcaccgtcgccctctctctccgtcgtcgccgccgagctccggtccaccgccgttgtcgccccggaccacctctcccctcggcgccgcctccttcggcttcgccgcatccccggcgacctcgtccacccctccgtttcgctcgccgaccgccggagcaccgtcgaccccgtccacccgagccgcgccgccaccttcctccgctccggtcgccgtttccgtcgtcgccatcgacccggggtgagccgtggaccgccgcttcttttcccccttcccttcccctccctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgcccttaggtgcggctgacgcgtgggacccccggcgccggccggtgtgagcccgggtgcgcccggtccaccatggaccgtggggctgccgcgtgggccccacccccgtggacccggtccgcgcgcccctcccctcggctgaagcaataaatccattttttttaaattaaaatttaaatgaagaaattcgcaaatattcatttaaagagcatataaacttcaaatggccataacttggccatttgaacttggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttggaaaagcgagcaaggcaagtcacatcatccttcaacatattgaatcccagcttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactctactcatggtaccactagtatggctttaggtagatgcttcgctggttaataggacaacattaggtggttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccggccactataaggactaagctcgggcctctgttgcaaagcactaccgtactaccacatgtctagtgggtaaggcttagtttgtggctcagtctggttataaacaaaagtacacggatggagatggatgaagtcgggggtcgatggacatctctaggacaaatgaaggctacacgagctgcggcccggtagtcgagatgtcatggcacagggccggtgtcctgctgctgggggcttagtcctgcctacctgtcccgggggttccggccgtaggtggggttgggtcggtactcttgtttatggctaggatgggttgggaactatgacacgtcttccgtccgtataccgtggtggtatgtggcacatggttacatgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgctagttcggtctgaatcatcgtaggccttgggctaaggcaggctcgtgtgggttcacgaccttgattaataatactgtgtagctctaggatcgtctttataaaatggctttgggcaactaagtgacttttaaatgctattttctgcaaaacttaacccctatatcattaccccttgtacccccttgcattaatcatgcatccgccggtgtggcttgctgagtactgtggttgtactcactcttgctcaatcttttccccccttcagtaagagaagctttggagaagaagtcttaggtggagtcctggcttataccccagttgagcgcctgtgaagatggagccgtaggcccgctagtccgctgttgtttatttttgattgtcaggccttaagtgcctttgtaataatgtaaatattatcgatataataaagatgtgccttttgtatcatgtttgtgtggtgtaccctggcttttcctgggacggggattaatacactagcgttcgggaaaatgcaaaattttctcggtcgcgataggtattcaggtagcagatccaagcagctattgaaggaggcaaaatcaagtttgacgactctaagaggccgatgaatgttgatggcaatccttttcctgttaatatggtgcatacaactggccgaacagccgatgggggccgtgcaatgggttttcaggtcaattcgactaagattatcaattaatatcagaggaagtatgacaagcaacaggagaagcattacgaagaagatgacgatggctttgatcctcattggggttgtgagttctttagattctgttggaatgaaggtatgaggctgccatctattgaagactgtcctgggtgcagtgatattgccgagagttcaagccaatcatatataaggggcaatcggctaaggctgatgagagttcctgttcatcaaagattgggtccagtgagtcaagatcgtggccagaaggacagcgaaaatagaaaaaatcaatggtgtccatctggtatctctacgaagaatcaaaagagaagggttcaaagattgaggaacagggagcgctttcaggaggtcgagcaggaaattaaccatcggctaaagaaaacaaagccgacgcaggagtggcgtgttaagaatcaagttcctgtagccgatgaagccacggccgatgagccaaaaaggttggctaaaggaaaaatcgttgtagctgcttcggtcaacatggttttcacattgcctgccgagtttgggatcaagcaagccgatatcgatgaagttgaagaagaatcggctaaattaattttgtcgccagagcaggcagtttttgataagccagaggggacagagaatcggtatcttaagccattgtatataaatggttatgtcaatgggaagccgatgtccaagatgatggtcgatggtggggctgtggtaaacttgatgccttacgctacattaagaaagctgggcagaaacgatgaagatctcatcaagacaaacatggtgcttaaagactttggcggcatccatcagaaaccaaaggagttttgaatgtggagctgacagtcggcaacaaaaccatccctacaacattctttgtcatcgatgggaagggttcttacagcttgttgcttggaagggattggattcatgctaattgttgttttccttcaaccatgcatcaatgcttgattcagtggcaaggcgacaagattgaaattgtgccagccgacaggtcagtcaatgttgccagtgccgatttagctctttgggagatggatggtcttgattgtttatctggaaaagtttgggatggagattttctaaaagtgttcgattctaatatacgccaattgaagatggaaaacacaagctattattttgagggcatcgtggagggttcagatgtctacaacaaggacacagtagatgatctcaatgacagacaaggacagggttttatgttggccgatgatttagaagaaattgatataggtccaggtgatcgaccaaggccgacatttattagtaagaatttatctgcagagtttagaaccaagttgatagagctgttaaaagaattcagagattgcttcgtttgggagtattatgagatgcctggactcacccgatcaattgttgaacatcggctacctatcaaaccaggggttaggccacgtcaataatctctgaggagatgcaaagccgacatgcttgaacctatcaaggctgagattaaagggttatatgacgctggttttattcgtccttgccgatatgctgagtgggtttctagtatagttcatgttattaagaaaaatggcaaggtcagggtgtgcattgatttccaagacctgaataaagctaccccaaaggatgaatatccaatgccagtagccgatcagttggttgatgctgcgtcagggaacaagattttgagttttatggatggaaacgtgggatataatcaaatctttatggctgaagaagatatccataagatacttttagttgtcttggtgcaatcggcttatttgaatgggttgtgatgactttcggcctgaagagtgctggagctatatatcaaagtgccatgaattacatataccatgatctaatcggctggttggttcaggtttacattgatgatgtggttgttaagtctaaagaaata

SEQ ID NO: 69226 - DNA, 12252 bp, Oryza sativa
  unsure (1)..(12252): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaattccgttttggtaccacgtaccgttctgtcactaaaaaatatacacaccaggtggcatactgttatgttttttatgatatcatagttattaagtccggattgatgaataaactaaacaagctctctgttagctggtcaagtggttagatagtcggtaataaaatatttgctaccaacagaagcgatgagacggtgggttagctagcgcgcatctctcagcccctgcgacctgacgatgaatcccaatggttaggcatatgcgccttgagaattgaattggggcctcgaccagccagaccaacaaagaggctccggttattgttgaccgttggtccagtccaatccccttcaggtcttgaagtgagtagcctagaacagagcgatgcttttctaacacatctttgaggttggaggtctcgtcagtagacagcttgtcgctgatggtgacgggcgactccgtatcaccatgcaagaaggtataaggaaagcctgaaagaagagatttgagctcatctggaggtcatgaatgtggatcagttttgggtaactcgatcatctctctatgatcgtcctagctcctcgacgaatgcattggcatcattttcgaggagggattcgggggcctcaaaaggagagatagccatcacttcctcaattggctcggaatcaggaatgggttccatcatagaatttttcaatcgcaagatcaaaatgaaaaacaccattttcccgagtttaatgtcaaggactccggtatgcggcacatcaaggagaagtttctctatgggatggccaacgaaaagatcgaaataagagactttcaaaacattgaagtcgaggatagcttcgacatcattgtgctggatcgacactctacgaagaatcccataaccttcgatgatgggactagaggggctccagaagtttttgtttgttggcgcaaatagttcgcccccgaagcaatttaatgcaaaggttgtagacataatgtttgcaccaacagtgggattatatagagtttgcaccatggcctctctcatcagatatggaatagttaaggactgggagctaatatgaattacttcagaagaaacctccatctccattaaccactcatcactcatgatggtagttaatttctgcaccgtctctttgaagagattctcatcgagtggtgcgggagaattacacgggaccggtggtctcttttggtaggaataatttgaggtgtttccataatgttcaaaaagatcatcatcaaactggaatgggaatttcaaaggttgaatttcttctaccttcagttctcgaggtttgggtgagaattcaacggtcgaatccaatatcggtcgtcgatggttcctcacgtgtattctttattttcaagacggtttcacaacgaacgaaggaggtgttctctaggatacaatccaagagctccctactttctaacgtcgttttgtgtgcgaacgaacctccggtggaagtattgagatacatggcagactccttatctaaacccgagtgaaagtgttataacaacgcatgatcgggtgcagacaaatctaggctgtcttgagttaacaagaacaaaagagcccatactgcaccattggatttttttctcattctgtcaaaagttgagaacctccttatgtatagagactacacgggttaacaggaagaaatcaaggtagaacctaccttttgattcctcccattcaccatgcagttttcttccggtatgggtgtaccattgctttaccccctctataagagagaagggaaacaatttccaatttaagcttgtttgtgtcatgcccgcgattgtcaagcatgagtacaattgctcaaactaacgcagatgatggtagggattttcgatttcacgtcctaagaaggattgttcccgaaccatggctataaaatcagtatggaatttatagctagatgaatggataggttttgaagaaaaaggtgactcacataacttggcccttggaatagaaagattttgaaaagaaaggtgctccatggtaggtaagaagagaaatgaaaagatacgaggatgaatcaggttcgaatatgatatagcaaccgttccttggcaacggtgctagaaatgtttgttggtatttgatacggcacaggtcaatccgcaagcatatggagaccgctgtagcacttgacctcagagtattttaagggtattgaatcacagggaacgtgtgtgtatatgtaagagtagaattctattcaaggacaacaactaatgatgggctaaggctaaagaggattcctatgggttaatttactagactggagttaaaggtaaaaccctatcgattgctttgggcactggctctcccctagtctgtcaatctgagttcggcctatgactctatgatgtaactgaacatggagggatgtaaaggacggacaaagctgtcaccacctagcacctacctcactttccgtggaccacacaacaaatgaatgtaaccgctaacctagacaccatgcctaagttattgattactactctagcctcgcataggaagttaggaacttccttctttatccagagtcctagtactagagcacttaataattcaactaagcgaggaacccataacgatgtgaatatgtctcactcaagcaaataaattagataccataaggagatctcgaatacttattttattaaaagaagcatccgtcgaggaacaagcttgacaagaaggccaacaacacatgcgcttctctagaattccagtggaacaatgtcaacgaacccggcactcctccggacttcccagagagaacgtcgatatttgggacactccttctagagcttccccttactatctacctaattccacatactaaagtgatgcctaaaatatgaaattgagttgtacttcacttgagttgtgtgttttggatgtgagttgagcctctccttttatagcctccatataacggttggaatgacagttgtggaggttggtgcacccacaaccaccatcaacaaccaatagtgggtcgccaagtgcaaggaggtggcggggagaggggaggagggtggtgccaaccttggtttggtcgaacccctcgttcgatcgaaccaggcacaccgcatctagccacccacattctctagtgtatgccaggtgagtgattatggcggttggcaatggattagctcaaatttagtcgattttgactgacatgtgggctctccgatccttgtgcttacgtatgattggtcagaggtacatttaatcgcatgacgagtgtgttttccttcagaaatcaactacataccactatttaccaagactagaggaaatagttagtaataaacccctaccaataagtttgatattatatttggtattcttttatgtaggagttgatagtgaaagttcgcacttaatgaccatcaacaataatcacagatatccaattaaacaacccaaaaccgattccagtcagaaaccagccagttagatcgtcaggctggtcggtttgaccgcacaacacacgccggtctgaccggcctagtctatccggcctgaccagagcacataattagcaccaaaccacttcgccaataatctccaaatatcaaaaccaataacctaccatgccaattgttcatcatcaaaatataatcaaaacacacattgattttacaatagaatcatgtcagatgatacaaattgatcgatatagtgagatgatagtgtgcacatgtaggtaaaaattaactatactacgcaattaggttaagaaaccacaataataaaaatcataaacttgttgtgaaaagatactaatgaagctaagatcataggggttcactaatatgatcctcattcaggcagtgtgctgaacatatgacatgcacatctgaaaatatttccatggaacaaatgtaacagaaaattgaatcatccgacaacatatggttggatctacaaagcaaagaagaaacaactaactttaaacaatcaaatggtcaaatcgaacagtgtaaacaaaagaagcacacatgagcactgcaaattaaggaggaaaaggtcattggaggtggtggtatccgaagcttagcgtcaacatatatggctactgtctgttagcaataaggtaatgcatgttgttttttcatcaggccagtgccacaccacgtgcgaggcacgccagggcaccacttgccatcaatggagaaaaccagctgcctctagcaccacaactccacaaggagaccctactaatcaaagaagaaaccctaagtacttcacgtggtacatgggcctcatgtggtggctattgcgttttgttcatccaacgcctaaaatgtaatctaatctagtgatccaacggctgagaattgatgatgacgtggaacattgaggtttgagatttagggtcttaattgcatttagtgtgtcataactttataaagaagggatttagtcattggaatattatatgcacacaattgaatgtaataatgataaatgtctgttattttattaaactctgaaatggcacatcgatatcggtttgtctcagaaagttccatccctagaaataaatcagaatagcctccgaaatgggaatgataaatgttgacagtcaaaaaatggaagttcttgctagaacctttggctgcacaagtggggagatgcccttcacttatctaggtttactaatggggaccacaaaaccaaagattattgactttgcccctctggttgacagagtggagagatggctcccatctatagctgcttttctcaatcatggtcagagactaacaatggtaaattttgttctatatgctccccctaatttctacatgtgcactcttaagcttcaaaaaaagtgattcaacacatagacagagcaagaagacactgtctttggaggaagtcaaatgatccaaacactaagatccactccttggctacatgggacctagtatgccagccaaagaagaaaggtggtttgggcattataaacctggaactgtaaaacattgcccttctgaccaaacatctggacaagttcttcaacaaaaaagacctgccctaggtaaaactaatatggaacaagtaatactctttgtctgactctcctcatgctcacacataaaaaggatccttttggtgtaaggacatttttagattgattcccatcttcagagcagtctcaaagatcactattggcaatggggacacggcccttttctggaaagataactggtctggcaagtttttacaagatgaaatgaactccctattctcttttgctaagaataaggacatctcctgtcaaagctttttagagctcgagagtttagaacaggcttttcacattcctctctctgttcaagctttacagcaatggcatctcttgtccaacctcattcaggaattgcgcaacacacaatgtttggatcaatggtcatatcagtggaattcgcagcatttcctctccaggaaattctataatttgttctttgctcaaatccagcatgctgcacccatctcttggatatggaaaacaaatgcaccctaaagctgaaagtattcctctggttacttttgatggatagattaaacagcaaggacctcctacaaagaaaacatttcaatacccaaggaaatgatagatgtgtaacttgcaactccttgaccacagaagactcattccatctgtttttcacctgcagctttgctcagcaatgctggcacaacattggcattaatgggaattttcacacaaccttcatggacatgataatagaagcaaaagagaattttcaatttcctttcttcatggagacttttgcaatctgctgttggaacatttgaagcagaagaaatgattttatttttaataatgttccagtcaattttcaaaggtggagatctgatttcaaggaagagtttactctacatatgcatagagtaaagaaatctgaacaaaccctctggcaatcatggattcagccttttgattaattatttcccttccctctgtaattctcttctgtttttttctccttttgtaaattgttcccttggtttcttaacaaagcacagtaagagcctctcctgttgttttacccgtaaaaaatgggagtgataagtttgatcactcgacaagtgctatatgctcaacggctcttaattacagttttacttctgtttaaaacaaaatttagatccataaaaactcatgcaatttctagatataacagtattttaaacagtcatttttagacaagaaaaaaaattgaactttctttaatgtgcatgcttggatgggggaggagtggcagcgggggagaaggagggaggacggtcgagggggtggaaaagcggtggcggagtggatgttgtgcgctcggtcaaaaagataaagaggaggaggggcaagatgcctaccggtttttttaaaaaaccgacacctatgcatactttataggtgtcgattctattaaaaaacaataactatagtattggtatcagttttttctctataactgacacctataatataagtataagcgacgattcttttaaaaaaccaacacctataatattgttattaattttttctgtagaaccgatacttatagtatttaaaggtgtcagttctatatttttttcaacatgtgaaagtggaaataggttcataggtgtcagctttaaactgacacctacgaaggattagtagtgattggctggtgtggctgatgcgttatacatcaaaagatgtatacgcgcgattaatttaactggtcaagcccatgacagctaaaaacaaaacctttcttggacaatagaaaacgaaaacatccgcctctgccatataaaaacttgaccaaagtcaggcatgattatgaagcactaattagtgcacatgatctaggtgtttggtctccctaatctcacaaaacaaagacatccacgaccatgaacacgcaaaacagctcatgcgacattctgtccaaacaacattatacacgcagacagcctatgtaccacatacacacatacaggaaagcaaatcatattaattagtcacggatgaacaatcacaacatcgacccctgctgatggtgatattttacatgatggccatctttcagtaacttcatctacaggaaattattatttttatataatttcatgaatggaatatatgcccccagtccccagatatatatatatatatatacacacacacacacaatgaaaattgttttttataagattgacaaacatggtacaatattaatttgacatccctataaaattttcaagtctaatataaacacacttctactcacaactgaattagtcttgtttgtgtggtgatagattccccacatagatcagaatccattttccatgaagcacaggtgctgattcacatgattttccatataggatcgagcatatttctgagcaatcaaagatataaagatcaaaaaaataccctgttccccaaacccaacaactacgtaaatgcatgtccctctcaaaacctcaaattaaaattgactcacccctaaaagttttccagccccctcagtgggccccactacacacgatcagcatgaagtgaacacatgctttcacacaccatagtctctctatatacatctctctctatatatatacgcactaacaccaatagctaatgatgcatgtaaaatacataaccctcacttgatcatcatcaccaataattccccatttgcaacacacaccatggatttggagagctgcagctacgtgctgccattgctgacgtgctgcctcttcttgctctactccataacctgctatgccttggcggcggcggccggcggcggcggttcttgcggcggctccgacgatcacgccgctccccggagctacccgctggtcggctgcctgctcgacttctaccgcaaccgccggcggcttctggcgtggtacacgggcctcctcgcggcgtcgccgtcgcagaccatcgtcgtcgaccgcctcggcgcgcgccgcaccgtggtcacggcgaacccggtgaacgtcgagcacgtcctcagggcgaacttcgggaactaccccaaggggaaggcgttcacggacgtgctcggcgatctgctcggcggcggcatcttcaacgccgacggcgagcggtggttcgcgcagcggaagctggtgagccacgagttcagcgcccgcgtgatgagggaggcggtgggcgtcgcgctggagcgggaggcgcgcgcgaggctcctgccggcgctcgacgcggcggcggagggtggcggcggcgtggtcgtcgtcgacgtgcaggagctgctcaggcagttcgcgttcaacgtgatctgcagggtggcgctcggcggcggcggcggcgaggtggcattggcattgccgctgtcgaggctggccgcggcgttcgacgccgccgcggcgatcagcgccaggcgtggcgcggcgccggtggccgccgcgtggaaggtgaagcgcgcgctgggcgtcggctcggagcggcggctcagggaggaggtgaaggtgatacgcgacgcgatcatggagttcgtccgtgacagcagcagccgccggcggcgggagcagctgctggcggcggcgcgcggccgcgacgacctggtgtcgcggatggccgcggcggggtaccccgacgaggcgatctgcgacatggtggtgagcttcatcatggccggccgcgacacgacgtcgtcggcgctgacgtggttcttctggctcatgacgcgccaccgcgacgtggagcgggaggtcctggacgaggtcgacgcgtgcatgggcgacggcggcgatggcggtggcctcgccggcgtggacctcgagggctcgcgcagggcgcgggtgctccacgccgcgctctgcgagacgatgcggctgtacccgccggtggcgtgggactcgaagcacgcggcggaggacgacgtgctcccggacggcacgcgcgtggggcgcggcgaccgcgtcacctacttcccctacgggatgggcaggatggaggccatctggggcgccgacgccggcgagttcaggccggggaggtggcttgcggcggcggcggcgggcggcggcgtgtcgccgttcaagtacccggtgttccagggcgggccgcggacgtgcctcggcaaggacatggcgttcgtgcagatgaagttcgtggccagcgccgtgctccggcggttcgagctccgccccgtggcgccggagggctcgccggagttcgtgccgctgctcaccgcgcacatggccggcggcctcaaggtgacggtgaggaggaggcagcggcaaaatggcacgtgcgagacatgaagccaattttagtatttttcttaataggttcttaatagatgacgctgttaacattcgaatatacgtttgactaattatctttttaaaaattttttaatgtaagtgtataagatatgaatcatgcttaaagtatttgtgaaatatattgtatatggtagttagatattaatatttgagtcataatatcttatactgcgaatatttgactcattgtggattccttcagttcttccatatctgtaatttttctttatcttcttcccatgtactcctatatgtacctgcctccgcaggcttaatacaataagtcaaatattcacagtattcctttcttcctataatattcaatatggtatcagagtgggcgatctagcgccgctcgaacgcttccgccactgctgcccctcctccccggcgaggagtagcgatctccaagggcggccatcatttttcctttattttttccatcgtctgcaccgttgcctggaggaattgattagagtcataatagaatatgattgatttgtgtgtggactccttcatatatgtaatcttttcttatcttctcccaacatacttctatatataccggccctataaaggcttaataaaatgggtcaaatattcgtggtatttctctcttcctatactattcaacaggataaaataactcacaataaaatagataataattaagtaactttttaataagatgaatgatcaaaagtgtgttaaaaaatcaacagtgccatctatatttaaaaattgagggagtacttattgtatatctatacaaatattctccattgttttgatttgaatagatatatgtacctatggtgactttaagttgaatagatatatgcattattttgattaaatttaacgaaatttctactttttattttctgaagtgccgagtatttctagtaaaatcattgggttaagtattacgatctttttaaaatagagtaaattacacctatggtacaataagtagacaggtgggtgcgatttagtacaagaatttgagaatgggacgtttaagtgcaataacttggcaagggtgcgctttaataaaagaatttggtactttagtattttagtacaataacttggctagatatatgctattttggttaattggtgctatgtatgttttttcacgatgttaatttgtcatcacgtagcaatcccgaagtattatcttataatgtttgatgtaatctataagaatatattgctcaactaatttgcaccatcgatttagattattttttttcaccgtctcaaataccaaatagaaaatttctacgcagtatgacaaaaaaaaaagtatgcctatacaaatctacataagtatgtcaataactgaataactgtgtgtacgtaaaaactgagttcatatagttaaaaattctcaaaataattaaatttttacaccacttctcaagtagttgtacccatacgctcatttattaaattcttatactatgttgcacccacttatcaagttgttgtactaccatactcatttatcaagttcctacactaaattgtatttacttgtcaacttgatgtaccatgaatatatataactaaactattcttttaagtatgtgtattatttcactaaggagaaaacgatggggagtggcttaaatgacgccaaagaaaaacaacagacagaaagtagaagataatgttggatagtataggagaggagataacaccatagctaagcattattaacacttacgttatgacaccaatatctcaattttgtagattttccattgacaagatcgtcatgcaaaagccagtggcggactgatggatgttattgtgtaattttcgctatgttttgccctagtacatatgttaaatgcttttgtgtacattttttttctaagtttgaaaatctttatctttatttgtaaatattcctcaaatcaaaatttattcatttctcgtccattttctaggaaaagagagttaagtttggtctataatgtaggatatataagaggagcgtgatgaggttaaatcatcactggaagggtgagaaaagcgatcgaccaacgtaacctttttttcaagtaccggaataattagacatacgtagttcaaacagtattttcaaagctttaaaaattaaaactctatatgtttaaaaacgtggtatccactttatgacccatattcacttcaatgtccttcccacgtactccctccatactcgtaaaggaaatcgtttaggacagcgacacggtctctaaaacataactttgacttcttattgctataaaaatatttattgaaaagtgatatatgtatacttttatgaaagtatttttcaagacaaatctatacatataatttttacattttcaaactcaacaacttgagagttattcatgatttatattcgtaaggtttgacttaaacattgtcctaaacgacttcctttataagtatggagtagtatggcggtagctccacatggccaacatttgccctctccattatgaaaatactccccctggtttgtatgtcaacttaaacacagttaaccacagtgacggttcgctaggatgtacataaagaaagggcttaagagtcgagtcttgggggagcctaatacactattacttagtttaactatttaattagttacataattatatgtgttat

SEQ ID NO: 69227 - DNA, 751 bp, Oryza sativa
  unsure (1)..(751): unsure at all n locations
cctacaactacgagatggtccaccgcgtcggctccttcgccgtgccgctctcccgcgacgaggaggccgccatgcgctcctaccagttcgtccccgtcgagacgcagcacggccgcctcgtcgtctctgtccagtacctccccagcctcgctgccttcaatctcgagatctcctccttgtcgccctccatgctgatcgccgactacgtgggcagccctgctgccgagccaatgcgtgccttcccagcttcgctcacaggagccacaggttccgctttcccgcaggcgctgtccaatcagccgcagcgcccgcacagctgggcgacgccagcgctctgcccgcaggcgcctaggcagcaagctagattttcgccacctcatttgctcaacgcatcacccactccatcgccacccaattttcccagcgggtatcttcaatctcgtcctaagggagggtctgcaccaatgagcataccacaggtgggtgacaggaggagcccaattcaccggccgatcacattgccaccaacgtctccgaggagagtaggggagacaggaacatctagtgcacaacagtctccatcagagagatgcccctcgtttgggagggcagatggatttcgaataatggatccctatgcaagcctgtcgccaggacgcaaggtgatccatggntttaaagcctacaatatgctttcaacttatattcgatacttgcgtatgccttatcttcatcactgctcaatactgga

SEQ ID NO: 69228 - DNA, 855 bp, Oryza sativa
ttgcctaaccccgactccgaacagttgaacacttgacctcacatatgtcccctgattaacgatttcattcattttcactacccaagcccccgtctcacctcattagcaatgctacacagtgccagataccgctcctaaacctagaggcttaacctcaccgggacactaagattgccctcgaagtctcgaactgctagggtaaatcgttcatcaatcatcttgtctgtgtatccataatatccataaaagggccaattcaacaagagaagaaccgatgaaattataagcacaaatggataaggcactggttactaacccatatgttgcagttgcacagactactgttattgattttataaatattgaaattttccagtaaactaattttctagtaaattatagcgcataaattaaaataagaatatactttacttcaattacagctttctagtaaactaatttcgaatttggaatacactaataaaatgctaaattccaagtccaacccggtataattaattttaaaattgttatgttttggaaaagactaatctaaacggtccatgctatcttggcgagaatacacttcctccatcccaaaatataagcaatattagcatagtgtcaagtgatacttttttactttaactatttatagaaaaaaaagatcaatcatataaaattgatgttattagatttatcttaaacaaactattataatatgaaaactctttttatttaaaatatcttatttttatatatattattgatcaaaatagcatatcgaagactgtatcgaagttaaaaatacttatattttaagacggagagagtagagcagacgtcctcatcata

SEQ ID NO: 69229 - DNA, 1144 bp, Oryza sativa
tatgtgcacgatacacaggcatacctgggtaatgatcaaagtatgaatttcccatttcctgtgtagggtagaactttacatcattgcgcacctgccgtaattttactaatggtgtacgaatagaagcctgtcaaatagcttaatatattcttttcgactaaatggtttgctgagagcatccaataacctctgcttgaaatctgaatccggtctactgttgatatgtgccggccatataacaccttgtgacccctgcatattataatatttttaagtaataagagaagtgcatcatgtaaacaagaggagaaaaaacccttatagtagattttattgtttgtgagataaatgcaaaattgccagatcaattggagaacaatgaaatactttagcatgtacattacataaccttagtatttgagactaattcttctttgaagagtccatatgggtgttactgttactgttccataattcaagtaggggaaaatttgagaaatatcatcacaaagatatgtgagcctggaccctctcgtgtcaatgacacatccgatggtatttttcaactcagtgatttttgcggtggtaataggcaaattggcccataaagtggaggggatgttcagcgtgaatttgctagagaatagtgttctggttggtacaatacagtatcagcttattcatacatgtccatcaacaggccttttgttgaatcgtactgaaatatcgaagactactatcatcttcttttgcgtatattctattaggcgaaaaacagagaactatttctggactgaaaacgtgtatacgctgctcaattcaaagaaacaacagtgccacaggtaacaacgattggagatgtataaaaaattctcaccggggggatggaagggccggcattattggaattgcttgaactcatcttcctcttcttcttactatctaatgttcgcacggatgcgtcacccaccgccacccagtgcatacttttgggtccggaagaattaccaccggctcgtctgaatccatggccacctctttctcccgcgcatcctcgacctcgctgctgctctcggaggacgcggcgcacgggtaggtgacgacggcgccgtcaatctcgagcaccatgttgtcgttcaccacg

SEQ ID NO: 69230 - DNA, 33224 bp, Oryza sativa
  unsure (1)..(33224): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaatgcacacagcaataaaattgaacagatatcacctaacttatcgagttgcctgcgttgcttttgctaaatgaaaacacatgtcaataattgagaaaaaccattttggagtcatatcacctaacagaaagcacttgtctctatcacatgattcacgccttgtgcatatttttatgttgtgtctatgcaagcgtgtgaattactgttgggtaggccatgggagtatgatagagatgctttacattgtggtaaaactaattcatgcactttcacatataatggtaacgagttagagttgctaccaatgagccctgctgatattttgaaagatgattatgagagagtaaagattaaaaacaatgagccctaccacctgcaagtctaaaattatatgtataaaacctatgctggaaaacatctcattgcaagtattctctgatttagcaaaagcattggtttcccctcatccctcacttccaattggacctcacaggccccatggctcatttggcatccacccagcaccccctagacccatatggcagtcacaccaccgccctcgacacgtgctggcgttagaacgcgctagcacaccctgggcttggccacctccaccttgacccgatgacttcgagaacatcctcagaccatcactccacaccgtgtctccatcatccctggttgcgttctagccattcccgctgggagataaagctcttagcaatcatttccacctcgagatcttcttcgggcataaaaaagatgacgtcctcccttacaaatgagtcaagattttccctatctctttgttccctcttctcctcaccacacctaacaacttttgtttttgccttagttacttttgacttgtgggtcaatggcaacgcaacatgcgttccagcacacatgaagagtgtggccgtgggcgtcaaccctccgctgtgatcacatcgggcctcccctggacaagccacaagtcctcagagaatatccctcggttatgctgagtgaggagaacgccctttgtattccttggctcggccatccagattagccttccgtttctccgcaattgttgagcaatagatcgatttgttgcatgtgtaacttcctagtattcctgctaacactatgcatgcaccttcttgctagcctgatggccctaacttgccaacgctgtccgtgcaaacccatcgccgcggccaagccctgcccggtatgtagacatcgttgtccaagtttcaccaagccccgtgtaaccctaggtgagtctactagtacaacccagtcaccaatgcatgcactggtttgactcgatttgagccagagcatgaaatgcataagcatgccgaaacaaccaccgccacctcattgcacaaaaccacaaccccacagttttgtacattttaccttttggtcttgaccctatctaaggtatcgttcaccaccggtgagggctacaaatattggacatttgtattgagccttggaggtcagtatacaaggaaggtgctagagataaggaaagactctaatcaaatcaatcatatcctgaataatggtgcagaacaaaattattagtggttggatctatttcttgcatggggacgattgtgtcggtctaaccggcagtcagaggtgcggtcggaccggccagatggccggtcagattggtagtctatgtggtcagaccggtctgatggttggtcggaccattggtctgtgcggtcagaccggcatgatgaccagccatatcgacgataggagagccggtctgaccagtaaaaggcacggtcggaccgcccgcagaactatggttatcttcgctcccggcatattgtgttgccgctccatcagttgtgctatagatgtgattaacatagacttggctagtacctgcaaccgaattaggttacaaattgcctgtgagagccgaattcggaactcataaattattcaattcttttataaaaataataactcatagcatactcaggtttattataaaagtagcggtaaaggattcatctacggaacttgctacaagcttttgagcaggacgagcaatgtcatcaacttttacctcattgacggtgacttggggtgtaaggccggtgttggcggctattaaatgccaattttatgccgcccatacctacataaaacataagttctaacacatccaacatagtggtagggtttaattttgacagattccacgagtgttggtgtatatttggatgcgggtaataaactgctagagtggggagcacatctagacttaaatagagaagaactacatcaatataagaattgggctcacaacttcatcgaaacattagaaattgagcccaactaatatagaaatggaccgagggagcagatatggaggtccaggaaaaaagcccacaggctgaggagctagccagggttcagccgaaccctaggttcggccgaacccaaatcttggctattggcctcctcctttcacatggatgctctagatgactccaaaatgacagttgcgtggcaattcagacatttccaactgtagagccatcattggaagcctataaaagggcctcactcccttactttacacacatactccgagcttgagctgaattataagaggctctattgtactttattctatactagattagggagagaataaggtagaagaaatcggagaaattccggtgttgtcggtaatcttttcttactttttataccttgttaattactctgatttaataaaaatattcttctgagtaattaagattttgctttgtgagaattatctcttgtttagttcctattagcattcgggatcattgttcgctacattgaatatatagtgtttactttagtgaattataaacacgagagtagtaactaattgcttaaacgtggtgtttaggtagttaattttcagtgattgctgcgtatcccacatatcgttagaggttggtgtagaggtagtgacaacccttaagagcaccgtagtcctccctatctgggtacggagtaaagcgtgttctggtagcagcgagcaagccagtgcctgatattttcttataggattaaaccaagctttctatagacacagtttctcgctaggaaatcctctctaccattttcctatctttgcttcgtgtccttggttgaacctagagaagagttgaacacacatgttccttgtggaaatcgataccttggaatactcccgggtgaagcgctacatcggtatatccgtgcgcttgcggattttatatgtgaccttaagaaataccaatagtcgagcttaccaataactcgttgacgagtcttgacaaagcatcccgccaaaagggcctcttgcgtcgcgatgtctgttggtatttcttaacgacattactagaaatataaatcccagcaaaggcgcataaaaattcgtggtatattatggttatagagttcatccgcaagtgcacggatataccattgtagcatttcaccccagagtattcaaagggtatcgtatttatttaatcctgtgagaagatcatagtagagagaacctgactaataatttatatgttacttgtaataatcatagactaataaaagcaggggttaagataatctaagggtagagtgacacacaaataggggactactcattctcatactaaaatatctaagctaagtggaaataaaatagaaagagaatctattcctatacttctagtatacatagtatacatacattctagttatctgacatactagctaataccctctatccgatgcactcctggtacttcgagaagccactcctgactatcgagttccttacgatagcctgtcataactatacaaccggggctaaatacagaggagtaccctccacaggaaattaacttaagactatatacacgcacggaggaatacccatactaagctgtcaccatcagcggcccacctctcatccacagcatataaccccaaataatgatatcccgtaatctagacaccacacctaaactaccagatactactctaatatcatcgtcatgatataaagtaattgcataagcaaacactatacccgtaccaatgcatctcccaaataagctagcagtacaatcagtataacatgaacataatgtaaagttggcattcataaactcggtaagtatttcaataccataaatgtataaggaagagtattctaataaaagtacaaagcttacaaaagagaagagaagagctactagggccatacccgaactcttccgaaggcttccggactccaatttctactctattcctatttcactagcttgagaacactaaactaactcgagagaatataagagacctcttgcttaaggtgtgtgactgaagtgagaatgacaactccttttatagccttccaatgatggctgtgacagttggaatggtcggaaataccctccaaccgtcttgggggctaatccacaccatccaggcgaagccctggatcggatggcgctgaggagcctggttcggccgaacctggggctggcccaactagcccatgttttggctggcggcctcctctgttgcttctcttcgcagacctgtgtcaattctgagttcttggtccattcatacataagtctgattctcaacatcgtccgattgatttttcgtttgatttgatgtcgattctccgccactttatggttattctctacaaaatgttagtgatcctactagtggaatattattattctaacatggatatgcattgcaagcataactagttctcctctattttggtaatattgacgggcgaaacttatcgcaaacgaccgtcaataacgtcatttgatctcttgacattattcctcatccaaatcctccaaagtgatggggaggaagttgcttggattcacttcatgcttggccatgatgttgatgaaggcattccccaacggagtcgccaaaaatcgtgttggcaacttttatggcaagaagaaaatcacgatcgggacacttaaatgccttgtggtgatatcgagccaccaatcacttcaatctagtaaaagctagatcaagttaggggttttgatagattaaacaggctagcggagccaatttggagaaacaagcaataaacacccgtcttgtgtacgaacggaaggtttacgggatgtacaagggatttcgcactcccttagaaaaggtggacgatttacagtgcaaatcgacaaagatagatgaactaggctagacctagacaaaagtagatgcaatattgaaaaagtgattcaattggctaaatcgtattgggagtagattctttttccaattgaaccagccttgtcccatttaaagggttggtcttgcctcatacaggtcctcctccacgttcaacttaggatagaaaccactacaaacccgaaacatgcctccccgagcaagaaatccagagacccgacgaaaacagactcggaatcggacactatcgatctgatcgaccaaacaacgccggtcagaccgacccacaagtagcgatctgaccggttcacagttgacggtcactccagctccgtgaaggaaaccgatgctcttcaaattttggcaatattttcctaattcgactatagctaccaacaaatcgaagcttctattgctacataaagcagacactcggatgtgaattttttcttcttcttttttaacagattttcatataaataaaaaaaagccagtttattgtgtagtaagttatcaacgataagtatcgtccactttttgtgtgcgctatggatgactaaggtcatgaatacggttactcaagatatcaataaattggtaaataatgggtcaaaggtgattactagcagctattgactaatattttgattcaaaattttgattgaaaaatcctgtttttattatactacctccgtttttttcatatatgacaccacagacttttcatataacgtttggtcattcgtcttattcaaattcttggggtaaatatgtataaatatatgttaaggttagagttgctttgatgataaaataagtcaaaaaaaaacaagcagagagtgtttggtggctattgatttgaacgtgtggcaaagtacaagcctgatgatgaagacgacctcacctgccgacttgctgagctcaaggcccgtggctgagggatttcagtttagctgataccgaattggaaaagaagccagctgtaacgctccgcttttcgtgagtcgttaaaaactaattcggcaaaatcctaattgcgaaaatttccgttctttgtgtgcgagtctaagttgtatcgtggatctcaattcaatcccgttgttccctctcatcgaaatcaaatcctcctcctcgaaatccctattccgattcaagtattcgaaattcaaatcctctcttgaaaaccttgcgaaatatccgcccgactccaaaaatatccaaattcccattttgaattcaaattcaaactccatatcaaatttctatccaaatcagatctcccagtaaaattctattttgcctccttctaattttggatgggtcggatccccctctcctcggcccatctcctctctcagccgtccctcccctcccctctctccacacgtgcgttgcgcgtgcgccgcgctcgagagagagagcgctcgttctcttctcatccttgctccctctctctctctccgtttctctctctcccgtcgaagcttccccaccggcaccgattcccgccgccgccctttcaaatttctgccacgccctcgcatccgcgcgcgcgctcgcgcgtggccgaccacccggtcgccgcccgtgcccgcgctgccgcctgcgtcgcgtgctgcaacccgcccccactccctgtgcgcgtgcttccaaaacacggagctagagctcgcccccccccctctctccctccccaaaacggcatggtcaagcttccgttttccccattctttttctctctttcccaacctcaaccaccgcacctccaatgccgccgcttggccgctagctccgagcacgaccgctagccgagctcccatgaccacctaagtcggtttcctcccccaaaaccgctcgcgcccataaaacccgagccgagctcctccccctctatatccctctcgtttttgcctgccgcaccattgttgccgcccctgccctgcagtcgccctcgccgtccggcaccgaagcaccagggaaaccggtgcgtgcggggacgcgagacgaggactccgggcacctcttcttccccttccccggcccaaggccggagagctcgccccgcgccgtcgaccgtccatcactgcccgcccggctcggtagtgccttccttctgttccttttttctcgctcgctctcgcccctccttggctcgcgttgtagctcggctagcctcttgaacacgcgtagacgctgccgctagccccgccgccgcccggcatggcctcgccgccgttgccgcccgctcccggaggccgccgttcatcgccggccctcctcggtgctcttccaccccatccgacgccggaaatggactccttgaaccccggagatgctcccacctccttgaattgaatcctcgtcgcccctccgccgtttcccccttttctcgccgccggcgtgcgccgccgcgattcgtcgtcgccggcccctcttcgaaggatccaagccgttggctcatcccctcccgtggccccccttgtaccggtgaactccctctcgattgaatcgccgcgttgtgcttccggtgaagtcggccgccgcccgccgtccattttccggctggcctcgtcttcctcctctcgccggcccgcgtggcagccacgaaggcggcacgttggcgccacctcagcatggaccgggtcgggctaaccccggtcagccgcctccctccgctcccgctcgcacgcgcgcagtccaccgcgagccatgaggctgcgcgtgggcccgccgcacccgcgtccaccgcgcgccgcgcccctcccccaaaccctagcgccacccctcccgtgagcccttccttcggtgaacccggtcactgacaagcgggtcccactcgggaccacgcgaagtggacctagcccaccggctccccctccctctctcccttccgcgcgcctcctgggcggcctcttctcgggccggccagcccatttggctcggccgagccgcacctttctctcgggccacgcccatgccgcccgagggaagtctatttcgtatccctccttcctttgtcccataaatcagtgccttattccaaaattccatagaccatttcctttggtcccgcacgttggtgactgtcaataatattcttgagaatattatttctataaattccagaaaccattcctcttatatatatatatatatatagttcctcggccctgaagttgaagatgaagtgaagcgaagattagggtttcgtcctggttcccagccgtcgcctgtggtgttgggtgttagttcgttggttccgctgctgctgttgttgttggtgtttcctcgtccgcgtcatcgattgcattctcgggctattctgagctgcaatctaagttaaggtaaataagtcctctatatattttaaggattgcaatgaatcatatttgtcaccgtgggtaccagcactatgtcctgggactggtaccgtgatcgcggtttcgtaggaagcggttcgcgccgtttttcctacgacacgctcctgtcaggtgctgttgtacggcggtgccagattggggtgtgacaccagccagctagcctggcagccagcccaaacccaccagcctagcattgctgaaaccctaactctcgaacccccatccccagccgcacttgcccgtccgccgcttctcctgacgcgccaagccgacgcccgcctcctgccctcaccatgccaccttcgcaccaacagcctcctcctccgtcctcctgtcacgcatctgttgccgccgatagtccttgtgccgagctgtcgactgccgcctctactttttttcccccattgccccgctgtgccggtcaaagcctcgcggtgcgtgatgactggtgtgtgtgtgtggacgaggtgagggcatggactatgagcagtaccacctcagtaatgtttaccatactgtttttttttttggatttatgtgattatttttgggattattggtttgttgacgtttgatgtcacggttctggtatttgcatagtatggggatcgtcggtgctaggatatacgcgagactgaggtaaaagagacagagaagaggatttttatacaggttcgggcccctgagttgtcaggtaataaccctacatcctgttggccgaagccggtcgttgatcttattcaccataatcacaccagtacaatatttggggtagcctatctaattgttgtcgacatggcagtctgacaatctgactcgtagtcaacaactgggtagccttcctcctcgaatccgtgcccggcgagatcagagagagcgctttcgtctctcctgacagtatccggagacaccgtaggggactagccgtgcttatccctgaagtcgatatccggcggcgtgtcttggcttatgttcgcttctatgttgtggcttctatgtcgattgtgttctatggtgggtgtgtcccctctcctcctagggggtattgtatttatacacataggtgtccccttgtccaagtagaactagggaaaccaatatggatacaatccgagtagtccttgtcgttttcatgtagaactctggttatttttctttattcggaactccctcctatatccacaggttgtttccttataggacatggtatgtggtgtaccctgccgagatttggtcaactactattaggtatgtggtatccataacccataaccctgacatggttggtgtagttctgatacttatgctcgattggtttgttaaccaatctttgatttctttttattcgtccagcatccgtgactaggattttgtattgatgtctaattttctttttctttgatgtaattgctcgtgtgtggatggagggcgctgcttggtcggattgacggaaaaaaaattatcgtgacaattggaaatttataaacttttaactagttattaaggtggtgtttggatccagggacttaactttagtctctgtatttagacactaatttagagtattaaatatagactacctaccaaactaattacataaacgaaagctaatttgcgagacaaaatttttaagcctaattaatccataattagagaatgtttactgtagcatcacataggttaatcatggattaattagactcaatagattcgtctcgcgaattagtccaagattatggatgggttttattaatagtctacgtttaatatttataattagtgtccaaatatctgatgtgatagggacttaaaaagttttagtcccatctaaacagggtctaagatatagagtttcttctcctttcctcatctgcatggcccaaaagcccgtaatttggctgtacagcgcagcttgatggcaaaccagcccatgcatcaggttccgttttcctttggaataagcccacttggactaccttcagtggtggtcgaatctaatccgtatcccttaagcacagtaccggatatctggacccatcaactattaaaaccggtgcaatttgactcgctcagcagttttggagggtggtttcgctaacatggcgcctacgtagccgtgttgacctggtcttcgttccacatgacgttgatgtggcgcttatgagcattagaattaaaaaatatatgagggacccatttgtcatcctctctccgccccacatgtcatcctctctcctccccttctttctcctccctctctttatcccttctcagtttctctgcccatttctcttccccttcggactcacacggggagcgggggctggatctggcggcggtggcggcgggcggggcctttctgcgagccgtggtcggagctgcacgtctacgggtacaacagcaacagcggcggctgggtggacccgacgcgtgcagccgtgcaacctcgagcggagtggcggcgaggtggcctggacgcttcacggcaccgagaggcagagaagccggttgttctcccctctccttcctgccaccacggcgacaacgttgagatgacggtcagcccaaatagtggcgcaggcggtagagagaagctagcgcccagacgacgaccttcatctgctccacctagacatcaccatcgtgtacaccgactggtatggcggcacgtcttccagcttaagggtggacgtggtccaggtatacccacgggcctcgttggcccgtcccacgattttggcatcaatgggcagatgggtcggtccaaacaaaaacaatcagctctacagggtacccgggtcggcttcattaggacactgaacaggctgagcgcgacaccccttcctctggcggtggtggcgcgagcgccccttcctctcaccgtctcacggcggcggcgaggcgcccatcaagcgcggaggcggcgaggttcagcttcctctcatggtggcgccgctccatcgtgcctgtcggtcccccttccccactagcaccagcgtcaccgctggccgagccgcgcctcttcactaccatcctgtcgtccaccaacctccttgactccctacttgctaccctcctttgccacctctccctgcgcctatctccgccgcctccttcatggcgatggcgacacgacctcatctagcctcgatggcggtctccatgtcaacagttcctcctgtgtctggtgatggtatgttccaactagccaacaactcctcttttattgatttcaatccaagaaagcatgtttttcttcttaatttcgatctactgtttccttgccaagtattggcggattgctagctaataattctgtaattcttttgtaacgtgggaataagttcatacaaattgaattttcagtttcagcagaaatttttacagttcagttttagcagaacacttagttcagtttcatcagagagtttcacttcagtttcagaagaaattttaagttcagtttcagcagagattttatttcagttggctgatttcttgacaaatgtgcagaccagagctctgcacaatttcttcctcccacccttctgttccttttttatgctccttctgtgttttctatattcggcctggagtcctcatgttgaatacaagtgttatcttggtatgagattctaaagttttgtgtattacatctgtgatttgtatggattgacagagttgtgtgtattccatgtttgaaattgaatattcggcacttggtagaatctgatgatgctttgttgttcatcacgtgttaattacaaaaatcaatgatagcacatactgatgggccgacccattctacccaatggatccaatggacaatgggtcgacccactcggtattgttataaaccatttgggtaacatggtctaagtatgggtcgacctgtcccggaccacacccacccatgttccagctttgtggatgcacgagctcattttttttctttctttctacatatgcagtggctggctggttgctgccgtgccgactgctactgttgtgcaccagtagcatttcgtttgaggcttttcagctgcctgagcattagaaagaatccacatacgcccggtgctcgtttgttggttgccttactttactggactatggcgacgagcggagtggcgtctagctgcaggaccttgaatccttgatgcaacagcggcggccttagcagctcgaggcgcagctacatcgacagcgcggctgtggcaactcatccagcttcgaccctgtcggctgcctccagcttctgcctccgcaatccgctattcgctgccaggctcgaatccatcggcaagtccgcgcgccgccgcatgcccgcattcacggccctccggccacgaactgccgaggagccccaatccaggatgccattgacgccctctcccaggaagggctgagtacacggaggcgaatgacaaatgggtcccacgtaattttttcattatgatgccacataatcgccaaatcaacgccatgtggaacgaagacaaggtcaacactaccacgtagacaccatgtcagcgaaaccgcccttcaaaatcaccgagggaggtaaattgcaccggttttatagtttaggggtcgagatatccggtattatggttcagggatacgaataagattcgactgctagttaagggagtcgatgtgaacttattccttttcctttcccatttttttggtgtgctgtccagaatccagattgatcaagaggccgaaccaggcgcgatgatagctgcacaagagacaagctaaatcgacagtaaattactgcaccacgtgttccaatcaaattatggggattccaccggctttagaagataagactagaaaatctacgtgccaactaatttgcaccttggtttttccatatacaatattctatttacgtaaaaatcatacacttatcccttaactggatcaaacgtttagggatggatcgatgtatggtactccctccgtttcaggttttataaaatgttttgactttgattgattttaaactgctttaagtttaatcaaggttataaataaatatagtaatatttacattatcaaattagtttagttaaattagtaattaactatgtttttataataaatttatcttgagtcgaaaacattactattttttctaaacaccggtctagatgattctttaacagtccatcgaaatactgaaacggattaactaatttaatggacttttaaaactaaatattcaagctacatccctcacacccacatggaccaaactctgcaaaccgaataaaaagccttctgaccccttgagctcttcggctgattttgacttgttttaaattgtaccaaatatatcttcggtcatgttctcatattttctggttgttgttcatgtgtgtgccccagcttcaacaacctcttcctgaactgatgtctattatacactcacgtgcaccatcctctaaatcagatgcagcctatttttggacctttagacttcagcacccaaactttcttcctcggtgaactacctcttccttgtacaacagattgattcttgctagacggtcatccttgccatgtgactgttttgcaaaattcaatcgacttacattaatagccgattgtattttctgataagtattacaatcactagtagaatgatcaaacaaattatgccacttacaaaacttggcatatttatgaatattttggttgtttatatagtactattttaacttggcaattctactagggaattatttttataattctatatatttagctcttctcttatgtcagttatattacctaatagatataattaaatattactaaataattcatataaagtctaaaagatgtaaactcgtgtttatgcttcaactcaattatattgaatgcacgtgttggaaacttagactataaaatcaatactcctcatcgaaaaatacatgtacgaggacaaacttgttattcatccctactagtttatccaatattcctcgtatttgccattcattcttcaattgccagtggccgataaaaactgccaatctataactgtatagttagaacacccactaaaacataatgtataccatactaaccaactatataggcgcatgcaaggataccaattacatctaaaactcaagatataagtatgctaaatctcattccacatatcattttcacatctcaactccatataccatttgtacaacatcatatagattcatgcatatatattccacagtaaagcgcgggatgttgtccattatatataaaaagttacaccacacttatttatttggaatgatcacaattaatcacaaacaacccaagcgagcacacacaattttgtctagtttcacaacaataaatatacatgatatagactagccaacggacgtctgctcattgaagaatgagtaacaagttcaaggatagacctcgatgattgacctgaagcccatgactggcatgatcttgtagctactaaatccagcttcaacgaaaagtttcttccactcctgttcatctcgctcaacgccattgacaaacatgatgagcgcgtcaaacaagatctgcacatctctgtgcttttggtcagatgggccaactccgaccactatatccatgattatcacctttccaccggcgtctctagatgggatggcttttttgcagttccgaagtatcttcacacagtcattgtcactccaatcatgcataatccactaaatatagaggaaacacatatatatgtatcaataaaatctgtatgtacatgtatacttctattgataggacactttaagaatattccaattttgataaatggtgaaatagggaatatttttagccataaacattagtgggaccaaactgtaatgtcttaaaataaaatttagagtcgatatcaattacaaattgctgattactattggactagtcatcaaccttaatttgcacccacaagggaaacatagttttgtaagataaatttagagaatttcagtgtagggatatatggaattaattgcggatatgtattttgagagtttagggatctagatgacacaccccttcatatatgtgtcaattagtgataaaataatttacaacaaattaaatgactgattaactccgtagatagaagagatagaaatatacatagatagcaactacatagaaaaaaagttggctaaagtccagttaaacatgtggttcgatatttttagacaaaaaaaccaaaatatacttgagagaatttcgagccagaccagtctatgtaccttgaggaagacagcattggctgctggaatactgtcaaacatgtcgccggcgatgaactcgacaccggtccccctgggtgcgtcggcgacgacgtgggcgaggtccatcacgctacatttcacctcggggaacgccttcgcgatggcccgcgccgccgcgccgttcccgccggcgacgtcgaccagcgagctgatcccctggaacacctcgccgtgctccctgaccaggatgtccatcatgaaggcgctgtccgacgccatcccgtcgttgacgaccgtgttgaacgcggcgtcctcgttggtcatctcccagaagctctggccgtgcgtgtgcttgaacatgcacggctcaggcagctcgagctggagccagtcgctgatccggaagaagggggcgatgaagcacgggtggagcagcatggacatcatgtgtcgttggttcccggcgccgatgaggaggcgggacaccggcgtgagcgtgtacatgggcgcctcgtcggcttcggctgcggcatcgccgggcgccggcttctggacggcgaagatgccagagagagtgagcacgcgcatgaggcggcgcaggcacgggatcttggaggggtggagcgtgaccctggtggctatctgggccatggtggcggcgccgccgtggtggtggatggcgtcggcgatgccgaggtccaaggcggccttgagagccatggacttgatgacggagaaggtgttgccgtagagctcgctcagagcatcgagcgagctggtggcatgttgcccgttgctctgaatgggcgccatggcactaccaattaattttgtcttccttttagtttggaatgggtttatgcacaagatgcactataaatagaggtctcaaattactgtatcaatgcaactcgttctggaaacatagaactactatactaggttatcagagaaaatgaggaaaaatgtactagtttcagggattccaaaattccaaaaacaaccagcacaatatcctatgcaattatgtaaccaatttttaatttaaattatgacatttggcaaaaatgtaaatgcacattaaagtatttgctgttgtttctattatttattgtgttgcttccatttgtcaatatagatgaaatgaaacaaacatgtccgctagaaggatctcgcggcatcatctcgctggagactttgcgtattaggatcatccaaacggacatcaaaacattttagtaacaaaaagtgacaataaagactgtttcgtcatatgtaactttacaaacatttataactaaattagacatactttaatcccctgttgacctaatttaagttattaaaaataaatatactctctctattttatattataagtcgttttgacttttgcctagtcaatcttttttagtttttactatgtttagagaaaaatttagaaggatctcaaaaaataaaattattttcactaaatgtaaaattgaatatattttaataatattttttattgaaaatgatattatattttttaataaacttggcccaatgtaaaaaagtttgactaggtaaaaattaaagcgactgatagtatgaaacgaggggtgtactgaccatattctaactcttacaagtcatctaagcccatctccacactactttcgaagaaatcagttgagacgaccgtgaatgaaaagataagttctctttaaaataagtcaaatcaatacattgaaactgaactaaggctgtgtttgagggagagggaattgagaagattgggaagatacgtaaaactaggtaagccattatcgcatgattaattgagtattaactattttaaacttcaaaaatggactaatatgattttttaaagtaacttttctatagaaattttttttaaaaaacacactgtttagtagtttaaaaaacgtgcatacggaaaacgagatacaatctcccctttctcatgtgaacgaacgcagcctaagtgaagcacaagtggaaaccaacggccagcatatggcctagcaacgaacaacttgggtgtgttcgtagaacaagttaccatccgggacagtgatcacggaaaacggaacaatctattagcacgtgattaattaagtatttaatatttttttttaaaaatgaattaatttgattttttcaagcaactttcgtatagaatttttttttaaaaaatacattgtttagcagtttaaaaagcgtgtacacgaaaatgaaaataaaaggagatgggctgagaaaagaggcatcacaacacagccatatatgcgaagcttgatgcggactcttggcttagccagtagccacatcctagtgaagcattattaatggctcacaaccatcgatgtacaatgtggccaatgggtgctgaccagcaactattggccaaagggtggtgaccagcaaccattgagcatggaaaaaaggacgacaagatggcaatagtaatagaattatctttaatattataaactctaattaagaggacgacatgatgggagaaatgaaatttatattactagggtactataagtatctgtttttctgtggttgataatggaagccatcaacaatggcattgtatttggcagtggtagaattagaatggttcatattgggattattatgagcagagggatgagtcctccactactgttaaggagtttgcgaggtcatttggattgccaaaaataaatactatgcaaacaccaatatttcttttgaatacacataatatttggttctatgtttcgttaatattggggaatgcaaatcattataaataaatatattatacgattcatattatgatagaatatattctcggtattaattaataattcacataacaaaattagactaattcaaaccacaatcataaactttagtctatggcacttcagctgttacaattgctccgcacataggaattatattacatagttaaaaaataaacaagcagatgaaaaagtataaatataattccaagatatgctagctaactagccacacagctatgtggataattcatttgcttacatattatatacatatgtgtgagtgtatgtatgtatgtatcaaaggtccataaaaaggattttgaattacacaattaaagtatacatagtatgaattgttagaaaaaatatgcaatcgtgtctaacttttagtcgttctgtgaaccaagtgacattgtcccatgacctgcaagtcaaaaaattacaaaattgtgagtttgagaactcacaaattggtgtttgcggaacttaaatcaagtgagagcagtgtgtcagctaattcttcttccattagacctccttgccgcagcatcatgccaggcaccgcctggctcttagcaaaagtaagggaacatcgtcaactaaacatgtcctacttgcagtgatagtaagaacccaaagatccgcattattcctggtgaaaaccaactatgaaaaatataaatgtgcatatagcagcatagccaagcttctcctccttccactgtatgtgttctgaaggttcaatcatgtatatatacttcctatttggaaacaatgaaagttcatagctacttgtgccttctttggttggtttatagtaatttactgtttgcgcatcatttagttaggctcattatgtcacctccggaaattcaatagcaatttcatcactaatttgcacatacaattaatcatcgtccaaccatcaactgaggtatacacaaatcgataattcaatatagatccaagataataaaaacattaaattcttatataagaggaacttagtcctcacaaaaaagaaaacagcgacagaaatacaatctagcggtggattcagctcaactcccatgggcaactcaactagattataagccaagcgtcttctcgttcataatcattcttcaactgaggttgataattattgcaagaaatgtacatgcaatacttccacaagccacataacaattatgcaagtgtaatagtatgacaaaaggacatcatatgggggttcattcgcaaaagcagtatttagcaaatatttgacaatactaaaatagttgagtaattaaacaatattatatcacattgcacatcacaacaatgttgcacagttccaaccattttgaacaaccaagcccggttgcacagatctaaccccactcaaagagctaataaattattattaccaatttatttctcattaatgagttattgtgagagcaatcacgaaaaatattgttaggctctcccataaccactgccatggctatttgatcgttttttttaactctgaccagaggtgtacaaatttacccacaatacatgattccacacatcttttcatgtcctgaaatacccccatagtactacaaaggaagaaattgtgacaagactctttgcataacacgtcaaacaaaatatatacccactaattatctgtctccggtagggatagccagatacctagacagggagactacttagcacctaaacaactgtgaacatattatctaccgcttgttgacttattatctgtcaagctcaaacacacaccgtgacaccttccgttgggacatgtcatactacagatccaactattaaccatgttggcttatggttagtacgattaatacttcataacagtagctcacgaatcgatctttaattgttatgagcacgatcaacataaccatgtgctcacaactcaccattagttaagttttagttgaaattatgaacaaccacaaccgtcatcgtgatctttcattaataaccataattaatcatgaatgaatcattgtggccatggtcttgaaaatggcgaatgtgagagcatctggctagcgagcttgtggcatgagatgcacattgctctcagtgagcaccatggcactactggtttcgttttccttttcgtttcaaatgagttgatgcacgacgtacactataaataaaggacaaagggctcaaactattatcaccacagttggttctggaaatatggaaaaaaaagtattttttttattcttgggcaccccgggagtgcacatgttaaatcgtgtacggattgattgatacagtttggtctatttattgaaatagaagctagatgatatgtcaaatcaattctgcctttagcatttataaataccgctaattgcctctatattactagtagccaccaagtcgcattgcgcgactctaattaagtgcctacatgtcttcatttatatttatataatgtgtcgttgtagttgcgccactgtctatttgtgctgaatttctcatgaattcatgggcatgtttcatgagtaccatggtgaatgccagatgccgttatgtttttcagtaccgagcatataaaatttataaaattgacatcattgacagcattttatatattttcttaaagctacatataaaaaaggcttgaatggtggcttactataaattccgagtggcaagaggcaacatatgaaattgcatatagacttgatgtcccattattatatttgtaggtgtgtgtgtataatataattttgaagaccgaatagtaacagtagtacttgttagattgatctccctcccgttgagccgttgggctcaagggggacttgacccgcgccctgatcaggggcgcccagcccaatggctggtgggcccctatcaccctgcgccatataaagaggggtggaggccggggcggcgcacgacatcaggttcgctaccgccgccaactccacccacaaaccctgatccgatcgagagggggcgcaaccagtgacgggaaaacgccaccgccgcgccacgcctcatcgccacctacgactcccactgctacgaccaccgtcgtcgtcgagcacactgtcgccgccgtcctcgtcaagctgagcgacggcaacgacgatggccggcacttcctcctcatccaacgtgtcaaccggtcacatccctaaacccttttcccttaatctctattgttgttcaatcattcaaccaaatagaaccaacctgactagatctaaacctaggtgatcctagagagaatactaacaatggtatcagagctaccctagcgcatagatcggtttggggagagaaatccacaaagaaaaaggaaagaaaaagcaatgatccgctcggatcaaaagatcgaaaccttaacccttgaaccttaccttgtcgccggccgaacgttgacgccggcaaaggggtgaaagggggagggcacagggcaccgccaaggagcctctcgatggccgtgtgcgcacccgcaggtgcacgcgcgcgccggcgaggtggcccgtggcggcgcatcgccgctctctctctctccttcacttcacaggtggaggattagagacggtgggaggagaacagaaaagtgggcgcgccacagcgcgaggtcaccggccatggcgcgccggccatgatgcggcggcgcgaggcgcagcggcagtgcgacggcgcggcgatgcatgggccgtcaacgcagccacgcgcgcgaaagatagagagagagagtggagaagctagggtttcggctagctggcggctggggtcgggtttttgtccctccgatctcggcgcccggctgtctgatcgaaaccctagtgattggacggccggcggcggctggaccaaaatcggcccatgtggggagcgcatggcgggcggctttcccggctcaggcccaggttgcggccaagggaggggtgagggagcgcccgcgcgcatgcaaggcggcagtgggccgaccggcaaaggctgaaagagtctattttaggtccctcggggccgaagcaaaagaaaagaagtccattttttgtccttgtttcagaagcatttgcaattatagttattaaaatgtgtttatttctaagcaagttgaacccacgtgaaaattgtttagagaatagataaatgtgagaaatgcttctgaacatgtattttgtgtattttcatgcaaatttcaatggaattttgtatcgattttgcatgttttatatctgtttaaaatttgatccaaagtggtagtttttttacagagagtgaataacagaattttgttactgttcatatgaattttatatagatcttccgctgcaaatagataaaattgttaaaagttgtgtttttaaaataaattttgaaccaacgggagaatttaattttaggaacattaattttgtgctatgatgttgtaattttctgaccaacgttgataattgcaatgttatagttatggctctgtgttatatctatttttacccaacggtgatgtaggtctaatgcataatattttaatgttaattttgttctcacagctactccttgattggttgcattaaagatattccgacctgaaaggagataactacgaagaatggaaaagagaactcgaccttgcttttatcttgggagaggtggactgggtgttgactaccccatgtcatatagaacctgctgaacttgacagaggtgaaaaagagtcagatgctgaatggcaaaagagagagagggaccatgttcccctcatcttgtcgtatgacattgagcatgcgaaatggtccttagccaacaagaactgcttggctgaggtaaagaacacgattgagccaaccatattgggctcaatcccagagtgtgacaccgtctctgagtacctcaaaagtataaagagctagcttactagttcttcaaagacttatgcgacatagctgataaagcagcttgtgatagagaggtaccatggaggtggtgtaagagacgacatccttaggatgagcaacatagcttccaagttgaagccaatggatttgggcatctcagatgactttctggtccatctggttatgacctcattgccaaagcactttgacaactttattgtcaactatgaaataagtccaaataaatggaatttttaaagagctcatctctaattgtgtgcaagaggagaaaagaatcaaagagaccaatggtggctccattaaccttgttaaagataacaaggataagagccataggtcaccctcctaaaaagcaaaacagcctcagcatctgcctcagcaacaatagttcacagttgagacaggatcagtgtctccactgcaagaagacaagacattccaagaaagatcgtcctgacttcctgatagtgatcatggcaaagaaatgtgagaacattattacatttgtaaatgaatctcattatgattggttattctagatccacatagtggatttattctggagcaactattcatgcatgtaattgtttaaaggcattccgttcgacgaggactacgcaaagaagcgaaagatccattagagttgccaatgaagcaaaagttgaagctgttggagatcttcacctagagctcgtgaatggcttcacacttttacttcgagatgttttttatgtcccatctttgcaaagaaacttaataagtgtatccaaattggattttgatggatatgattgccattttggaaatggcaaatttgaactatggtataataatgcatgtattggtcttgctgtgttgagttcctccgcgaggggttttctcgttctcggtgaacccctgtggagatagatggcctggcgaagtcgatggcgccgctgacggagaaggtcttccagtcgatggattggcgttggccttcctggtagttcccatgtcctgtgtcaaatgtcttaggaaaaaagtgtaatatagttatggattttgatgggattgtaagaaatacttgtggaatatctaactaagctttcttactctggatgtagtgtgtatgagtgtcttctcacttcgcgactttgatcagtcgtttgagttatacactctccctagcccccagccttgtcatcggagaattcttctcggaagataaggctcttggacctttgacctgccttggttgaacaagcactgatcctagcccccagccgtgaagttggaaagtttatttccgattacacggcttggttaatacacacggcgagaactcttacacgaccagatcttacatggtctttcgtctctacaggatccgacaagaccttatcggctctgggcgtccccagccgaagttcccttaggttcctcggaggccttgtcaagacggcgtaaagggacatgaggataggtttcaacgctaggtgtcatctgggtaagggatcatcgggaaggaacactttgattgtagtctatacctgaaaaataggctttattgaggctgtaagatgtcttacaagtatggatactattgacttatacatagaatttacgtaattgatcaatgttccaggaatttgccaactcgcgaccatcgctgtctgcgattttgaatgcgcctggccgcagaacttgtgtgatcgtgtacggtccttcccatttgggtgagagcttgttgcgccctgcttggctttgaacccgtcggaggacgtagtcgccgatcgaaagtgtgcgtgctcggatgcgcttctcgtggtaacggcaaagggcttgttggtagctggctgctcaaacggcaactcgttcgcaatgttccttgaatagatttacatcgtcgtatcgctgctcctcctgatcctcatcgaagtacttctgtactcatgtactttgatgtcgtagctcggtggggagcatggcctctgagccgtacacgaggaagaagaatgtctccttgttggaagttgtcggtgtggtacgcacggcccatagtactgatggaagttcttcgacccacttcttgtcgtgtgacatgagcctgtcgtagacgcgggtcttgattccttgtagtactatgccgtttgccctctagacttgtccattgctttgagggtgagaaaccgaggcgaagcagatcttgactcccagcctgatgcagtaatcctggaaatcggcactgatgaactgggagccattgtctgttatgatacggtggggcaatccgaacctgcagaatatccctctgatgaatttgatggcgttgtcggccttgatttcccccgtgggtatcgcttcaatccacttggtgaatttgtcgatcgccacgaataggaacctgtagccgccctgtcctcgtgggaatggcccgagtatatctagcccccagcacgaaaacggccaagtgagagggatagtctggagtgcttgcgctggcaactttgtgtgtttactgtggaattgacaggcttcacaccgctgaaccatgtcgcaggcgtctttgagggcggttggacagaaaaactcttgttggaaagcttttccgactaatgtccgaccggcggcatgttacccacagatcccttcatctatgtcgaggaggaggtgtctgccgtcgtcggacgagacgcattttaggagtaccccattcgttgccttcttgtatagatcgttgccgatcatacaatagacttttgatttatgggatattttctcggcttctgcgtcatcctcgggcagctctttgctgcatatgaatttaatgagtggggtgcgccagtcgtctgtggtatcgatatcagcaacggcgccctctgcctctgtagcccccgagctgatgttgggggcgtccgggctatcttcgccggttgcctttttaactgatggccttgttaggacgtccagaaaggtgccaggttcaagtggttctcgtctggacgcacgtcgtgctagatcatccggtttattgttgtctttgcggtatacatgtcggacctcgatcccatcgaaccttttttctagcttcctgacttctgcgagatacttggataactcgggctagagcacttgtaatctttatgcacctggttcgcaactagtttggaatcccctttcacgatcagtcgccttactccgagtgcagctacaactcttatcccggcgagtagtccttcgtgttcggctgtgttattggttgccctcaagttgaggtgaattgcatgcttgaattgagtgcaataaatgcctcttcggcctcctgtgtccatacaaatttgtcttgctttttcagcagagcgaagaaaggttgtcctcgctctcccatcctagcgacgaacctgcttagtgctgccatgcatccggttagcttctgtacttctttgagtcttgtaggcgactccatgtcctcgattgctttgatcttctcgggatttgcttctattcctttgctagagacgaggaagccgagtagcttgcccgatggtactccgaacgtgcacttttttggattgaccatgaggcgatatcttcggaggttgtcaaacgtttcccgcaaatcgtcaattaatgagtccctttgcttggccttgacaacaatggcatcgacgtatgcctcaacattgtttccgagctggtcgctaagtgcaccttgaaccgtgtgcctgaaagtgtttcctgcggttattagtcccaacggcatcttaatgtaccagattaccccgaacggcgtgatgaatgttgtcttctcctcgtcctctttcgccatgctgatttggtggtaatcggagtaagcgtcgaganagctcaacaactcgcaaccggctgttgagtccaccagttggtctattcgaggaagaggaaagtgatccttgggacacgccttgttgaggtcggtgaaatcgacacacattctccatttttcgttggccttccgcaccctgactggattggctagccactctggatggagtacctctctgatgaaaccagctttgagaagcttgtcgagctcttctcgtatggcttgttttcggtctggtgtaaatctccgcagtttttgttttactggcttggcatcgggtcgcaccatgagtttgtgctcatcacctccctgggtacccccagcatgtcagactgctgccaagtgaacacgtcagcattgtcatggaggaaggtgatgagcgcgagttcctatttctctcctagtgatgccccgatcttaacggtcttgttggggttggcactgaagagtggaacgatattgattgcgccgtctggttttggcgtcttgtttgtcttgctcactttcttgggtggctctgctgtggcaggcgggctgggcgtatgctcgaccatgtcgaggctccgcttgtaacattgtactaccagcttagcgttcccttgaatagtgattgttcccttcagtcctgtcatcttgagcacttgatacgcatagtgagatgcggcaatgaacttcgcgagtgcagttctcccgatgatggcattgtatgctgtatcgaattcagcgacatcaaaggtgatttgttccgtttggaagttgtttgcttggctgaaagtcacaggcaacgtaattttacccaatggtttggacgatgactgaggagtgattccatggaagggttgatcggtgggcatcaactcgcttcgtaggatccccattgcgtccaaagtgctggcgaagagaatgttgattgagctgccgcagtcgatcaagactcatgcgatctttatattacgaatagtgggttcgaccatgatcggatatcgccctgggatgatagcagtcttggggtggttctcttctgagaattctatcttctgctcggaccacttcatcttgggcgcagccccctgccacgtcgaacagacttcacgttccgctttcttgtaatctcgctttgaggagtatgccgtggaaccttcgaagatgtgtgagacatggagatcggaatctgggtatgctgagtccgattcctgagtaggcacctcaatgtccttctcaaccacgcgtactcgcttgcatttttccgatgccatgtgttttgcaagcgactttttgaagacgaggcaatcttctagagagtgtctgtccgacttgtgtatagggcaccatgctttcttcgtgtcgctgccttgtgggtctgggcgcttaggagggtccgcgtattctgttgcgagaacttccgattgagctttccttttcccactcttgcgatttttcttcttgcttgactcaggtgcgtacttggctggtttcttctctcctccggtctttggtttgtcgttcttgcgtctcagtgcatcatccgcatgagcgcattgattgacaatttcgaataatctccgagtagtcgtgacgcgccttgttgccaactcttgagtagtatagcgatctctgacaccggatttgaaagcgcgaattacagaagcatcggtgatctcggggattgtgtttctgcactcgttaaagcgccgaacataatccctcaaggattcacctgggttctgtgtcaacgcatgtaggtcgtcttcgatcgcatggcgcttgtaagttccttggaagttggctacaaacttgtgccacaagtctgcccatgaagagatcgagtaggggagagatgcatcagccatgaacgtgcagagcctttcaatgcggttggtaagtaattcaccaacgcgttgtcgcccgctccggcagcgtagagtaccgtggagtaaacttgaaggaactcttctgaggtcagtgctcccatcgtatttctctattgctccaggtcggaatctttcaggccatcgggcatcccgaagtgaacgaccgaaagctctacacccagcgctgggggcggtggattgtcggctatcatacgtccttcgtggatgtctgtctgatgatgaagatgacgaggatgatgacgatgacgatgggtcgcttggttccggcgtacgattacgaggatgtcagccgggttctcgagaatcctgttgtcgtctcccgttgttgtctcggcgccgatctccatcatcgtcatcattatggcgacgtcctcgaccagtatcgtccagcacctgccgttctcgatcgtcgtttatcacggtcttggtcttcgcttgaacggcctcctcgatcttcgttatcgtgacgctgtgaagagacatgacgccgggaacggttctcgttgtctcgtgtgcgtcgtgcctctcggcggccgttcaggtgatcgcggagatcgccggtgccgcgaggtggaggggtggctcgatgaggcgattcccggcgttcagggttttcaccattagcaacgctagttggtggctgttctgggtgcgctgcggcagcggcctcttcgaatgcgttgctgaggttggtcattgattcccgtagtcgttctgtccaatgtgcgagatcgtcgttcagaatgggatcgtaaggggtttccctcagtattgcgttgacggctctgatgtgctgggccggagtagtcacttgattctccgcttccgcattggtgcgcgctgacgtgccgacatcgtcgatagccaatacctcacgcggcgtactcgttgttgatgatccatagtcttcgatcaggtgcaagactgatggttcgtggggatcgatgtcgattaccccaacaaatcgatctgaaatcggcgtcactccttgttccttgtccttatccctgatggggatgcgtgactgctgtaccttaggaggtggcgtcttcatggcgctgagaaagacctggcagctcgagaggtcgtgattctttgtcttgtgaataggacaatagacatcatgagttggagaggtatgttgaattccacgctctttgcaggcacgaatttcagcatggacgttgagaaagacccagcaggcttgcagggagtgtttcctggttttgtggatagggcaccaggaccttgtcacctcggaagtaatccttgtcagttcgtgattcctgttggaaagacaaggcttggccgcactaggatccttctcgggttcggatgtcgccgacgtttcgatctccgcttcggcgggaggatccttcgacacggagtcgccccgggttgtagccactgcgttttcgtttcaggccattggcggaccagttggaatcgacattattgtgtaaaccggaaagacgatttcgccgacttgagtccacaccagtgttgttgaaataggaactccttggttgaggttggtgttaacgctgttgtcgacgaagctggatgtcatagtagtagaaccttgagcaacaagtccccctacctggcgcgccactgtcgacgggggatacccgtagaccagatatagagggtattggggtacgctggtacgaggatctacgtaatatgacatcgagcaagcagaaaacaaaaattatattggttcaagccccttgataggtaatagccctaatccagttgatatgggattatatgatggaaaccacagattacaaagggaatagtggaactcgacgataccgacgagatcgtaatcgagttgattcaactagatcacccggcgattcggctctcctgtaagctccgacttcgtaggctgtagtggatgtgttggctctgagattcaatggcttcggtcctcccggggggtccgttttataccgcaggtcaactggtctccaaataagactcggagacatcggacccgacacaatacaatgacgacccagttctattcgagtaggactctttccatctgtagactccatgatggacttccttaacttatgctgaaaacgtccgtatacgcgcaaacataccatatcgatatgtgacgtatatcgaagggtggaaggtataccttacttatgctgagaacgtccgtatacgcgcaaacataccatatcgatatgtgacgtatatcgaagggtggagggtataccttacccgtaaccctgacacccccattaaggaaattcgttttattttttgttccaccaaaaatgttgcagtgaactgaaacattctttcgctatttatgaaacattgtttttatataaggtgaaacaacacccgatttaaacgagggaaacattttcaatctacttagtaaaacaattacgatatatctggtggaacatcgtacaacatttaaaaataattcaataataagctaaatatttttttcgtcggaatatatccatgtgtggtattgttttgaagatttaattacaacgaatttaatggtgcaatcgaatcatgatttggataaataatttaagagaaaaatcagtttaaattagttttgcacgtaaatcggacgctgagacgtcagcgcccgattttcccctacccatggtagggtgcccgatttgtagaggtatatacatttaaaaagaattgatgtaaacatatcatagtcgtagtgcaaacctgcaaactcactgtggcgctcagccgctcacagtcgcttgatcggtcggtcagtaaactcgctgccgcgccaaagttcgcttggatcgacagtgaactggctgccaaattaattgctaatgaaactaattaaagaaataacgaccaattgctaatagcgcaagttaattaattgtgcgagtttgctccaaagggatgcgaacctgctacatgtatctattgaagtcgcgcgctccccgcgcgaactcgcgatgacacatcatgaacacgttacaaaaccacacactcaccgtatgacctcactgtgaattcgcaccccattcgcgacagtggtatacttcaaccaatttctttcaaacctgtatattgctataaaaccggtgaaaagaaaagatagcaaatcgtgtgtggcacgatcatatgacacaagaaaaaacagcttttgcgatgcatgcactaggagagacatgatctttagtactagttctcaacccctattaattccagttgtagcaaccgagactaaagatcttgatttttagtaccggttgaaagaaccagtactaaagatatgcactaagtcaaaaaaaaaaaatatgtgggatgtagaattcaaactcaagatttatcatctcaaccctcacgcgcattatcatcctatttactacacacattttttaactaaccctgaacacatctttaacaccggttggtaacacccgtactaaagagtttttggtaacaccgggactaaagatatttttggggacttgggcttttagaaccggtactaaagagtttttagtaccggttcttaatacatccggtgtatttatggtttggggcattagataaaagatgagttttgt

SEQ ID NO: 69231 - DNA, 9553 bp, Oryza sativa
ctagatcccgtgctgaatgcggactcagatgcaactgacgaagtaggccatgctagcacatcatgtgctatgctagcgatagttggatactttgagtgattggtcttccaccaatttaggatgtcaaatttgttcccaaattgctggatatgattctatttgaggtacatatccaattcagtatcaacttgctcagttaattgtttagtgatgtgttgaacccaatcagcaataggatcattttctgagatagccatcacatgttcagcttggcgcagagagttagcattgctatccttgagtttatataagtactccttaaacaacatgttcaatctcttcgtaattttgtcaatcctttctttagcattttcaccaaaggcttgcccaagccgaaattccacaaccatgaatttgaatcttgggtcaaaaatgacaggaatgcacagatatttgtaagacttaagccaatatttgtcaaatttatccttcatctttttagccatacttcccacttcagtgtcatagttagaatgttccttttggtgccaaatttttagggtcggcccgtgaacctaatgggccgatccctatgcaggctgaatcccatgcttttagttcacaaccacaagttgatagtgcagctattcccagtactagaaaaacgattttcacaggcgaggttcatgttactatgcatggcggccgaattttcgaccccaaacggccaccagcattattgtggatcgggggtgcaatggccatcctgtaacaccccaggtaaccacgtacctagagtgccacagcaaaaaatacactcaaaatcactaactctcaaaattattagaaatttcggtagactctcccctaaaaatacggacatccatgacagacagtgtagcatcctgaaaatgtgtcattttctaatcctgcatcatgccgcttcttatgttcttaataattacctaagcctaggacaatataattagagggacctcctagaactaactcgcacaaaacctctcaagtatttaatttattttgtgtttttcatttaaaaatatagatttggttaaattgaggtatttcttgatttggtttaaaaccttcttttgactaaaatttttttatccaaatttagtttgaaaaccccttttttacttttatgaattatggtccaagaaaatcctccaaaccaaacctttcctattccaatttggaatttattgttaacccatcctttgatattaaacctatgcttaattctccttccaatattccaatattcaaattccaccttttgatctagccaccaatttaatccctgtagcttgatttcctcttcggcacaagaatagcaatattataaatattcgtatgattgctcttgtgctaagaagaatagatttttattttatcctcctcttccaaatcaatttcctttgagccacaaataattttctagaatccatgccatatattttacggctcaaattaaaatcttttgcctccacctattttcctaccacattcctacaaatatatccaaattaggagccttattattcatggtattatttctatttgagtgcttccaaaataatttccctcaaattccactctacctctaaatttactgcactcaaataaatttgaattcccttaccttcaaatttatctccacatataaattcttttcaaacttagccacccaaatcccttctaaaatttagaaaaaccaattatactcaaactgggccaaaaccctttccctcctctaccccaagtcggcccagccaccacagccgaagccgctcctttcttctcccctttgggcgccgccactgtgcacgccatgggcgtgccgccgcccatggcatggcgccatcgccgtggttctcctcctgccaccgccgccaacttgccaaccacgccaggtcgttgccatgccgtgcccttctcctccaccgcccaactctaccacggcttccacgtacgcgcgcggcaaacgtcgaccaatcatactcgaactcttccgaagactcccggactccgatttatattctattcctactccactagcttgagactactaaactaagcttgagagaatatgagagagctctttctagaggtgtgtgaagaaatggagagagtgaggggttcggctcgacggctaggattgatctccaatgacggttggtgggtattaccaacctttccaaccgtcataaacatcattaccagccaagtctgcatccatcggtgctacggctggtttggccgaaccctgggctggcccaaccagcccagttcctagcaggcggcctccactcctgttcttctccgcaaacttgtgaattttggcccaatttgttgtgtcatttctgagtttttggcctattcatgcataaatctgattctcgacatcgtccgattgattgatcgtctggtttgatgttgattctccttcacttcattgttattctctgcaaaaggttagtaaacctaacactagtggaatatttttattctaatataaatatgcattgcaagtataactagttctcctctatttttggtaatattgatggtcgaaactgatcgctaacaaccgttaacaactctctcggttcaatctctctctcgcacttctctcctgttactggtacctccctctgttgctgtgctgctactctacttccctggttctggtctcctgcgcgcataggagatcaggacgagcagggccttcggaaccttgccctcctgacgatctgcacgggtaggcgggaaatcagggttttggggagccttcttcaacgcaactactcttctctgcatcctcaccatgtcggtggacaacaccaatggcgcggatgggaagggtacggctggacaggatggtactggaggcttcgtcaacggagacaattctgcctcacaatcccgtggagggccattcattgggtataatctctctatactgttgtttactgcgttctttcttattgtgtttctgtttagcgcaatgtttttgatgcattgccgtatgatggatgtctatggttattatatattaagcatgatccgttcgttacatttgtttaacaattgcactagtttattccttgttaaagtcatgattattatcttgataatttggattaaaatatgccgaattgtgaccatatatccaacatcaaggcccatatttggtccggtcattgggttgcaagtttaggctaaaatccatacatattagggaatatccaccttgcgcaaacggttctacctgcgtatggagccctgagaacgcatagggcccccaaggggcggatcaaggctagggatctcctgtgtcatctccattgaaataaaaagcagtataggatagcataaatagttaacctgaataatagagttgacccagctaacctgggatttagaaaaagaagaaattaatgttatccctcaaaatccatgtatatattgagctttatgctttagaggtttctctgatttgaggatgctagacttatggcaggcccctgcccccttaaagttaaatatatttaatggcttccaagcacagataggattcagccagcggttgaaccgcaaaaaaagaaaaaaattggtagtgctctgacttctgtaaattttgtggagatttagaaccatcccaacatattgttttcaattgccccattgcaaagtttgtttggtgtatgcgtagagatgccccgggcgcatgaagccccctctgattttgaacatttttacaagctggtaagaggtagagctggagtaaatcagaatggagttataattacattactagcaacagtgaggtgacaactttggttaactagaaacaatatgatggttttctagatgtatggttcttcgaggtaagattatgaattttcccttaataattaattatctttcaaatggtgtttcttctcagtcgatagaagaccctgtaaagcctcaataaattgaattcatatagaggcagtgacgctgaatatattacaggtcaattctcaacttcaggcctacactagaacggataccctcatctcaatcgggcggtaagccccatgtcaatcgggcacagcgtccatcacaggctagaagtcactgatgtgaagagttatctcaattgggcaaacggctgtcacgaatgaatatatctcaattgggccctaagtaaagcccgtcatcgataactttgacccagacaaccagtcaaactatagcccgtcacagataacctatctctatcgggccacaactagcgcccgtcacagatgactactaaccttatcgggcctaaactagagcccatcacagatgatactcatctcaatcgggtctaaactatagcccgtcatagatgactgatgacctcaatcgcgcctaaaatagagcccgtcactgatgactactgacctcaattgggcctaaactagagcccgtcacagatgacaactaatctcaatcgggcctaaactagagcccgtcacagatgacctcatctcaatcgggcattttgttatggcccgtcacagatgactataatccaaaaaaaaataaattttgttttttggctagcctcaggcctttgctagccatgcccgctgcaaaaatgacagaaacaatcacagatatccaatatccccagctccccagcatcacccattcatatacatatgcattcacatacacaaacatcaacatatttcacacaaccacacattcacagccatctcatatttcacatccattcaaatatttattatatttcacctgcaaaaccgagttaattggataaaatatttatttagcaagtcttaacataaacatatgaaatatatacataaatatgaacatcacagttacatcatcacagttgcataataagtgttcatcattgcctaaacataaaagttcaacattgttcatcattttagtttaagcctaaacattcctttggggttaattatttcgcggaggatgaagctggctatctcctcgcgaacctcctcaaagctggtaggcagagacttggttattgtgccctacattgtcataattccagattagttgatcgatcatatataagtactaaaatgtagttagtctatcacaattgagaccaccgacctcaaactcagccaaagtcttcaccttttctctatacagaaggcgcatgttgtggtacatatggaattcgcactggtcacctatttgttgcttcacctggaagtcttttttgtggatgaggttgtcatgtcctgtcttcctgaggcctcctcttcgcacgtattgggcccacgcttcatctatcgctagttgaattggggtccaatcatatgcgttcttatcaattctggagttcaggtagtgatatgtactccacttaggtgttatgaccagaaggatccaatgggcactgcggcattaatatagtgaaagttaattaagtactcaaggaatgtgtcatgctgttgtgtatatttagttaacacacttactattaattataggcgcacataatgtactccttgtctcggtgggaccacaaggtgtcgtagatgtagttgaccattccttgacggtcattctggagatttgtgacagtgaccacttttggatcaaggaaggcaacttccggtgcatgcttctaacaccattgccaacttaacctacacacaggataaacgatcttgtaagcaagttaaaccgattgttattaccagattgagttgggcaacaattcttacaaggagtagcacttaaggaggcttgtgtccaccgctcggagcctgtagaggtcgaaaagatccttgaagtcgaccacgatataatttttggaccaaggaatggctttccatcgtgctctccaaggatatcggtagctttattcagcttcctggcgttagatttctccatgtagtataagtgaaggtccttgcaagtggtgcccattgcggcaagcacgccatctccaaccaatggcatgcctagttggaactcctgtggagcgacgtattttttcttgccctctttgcccttagtctcttcctgacccttgccgagatctagcttccttggagctagaagcgaggcctgcacctttcctccccttcctctcccctttgcttcgggtttatcgagagtaattctttgaggggaagagtgtgccttcctgctattcttcatcggtgggggttcatgaatcgccttgctgtcggcctctgttcggtcctccccaaaatccgtgtcgtactgcaactacacatcgtaagattgtgcatgacgatcttgagaaggaggtgctgaaggagcagaggcgggtctctttggtggacgaccgcctggtgcagtggttggcctcgctgtaaccctgatctcaatgtggtccttgggccattggatgaaggtatcacgggcatttcctagtgagaggacctcgtcgttcggtggatacttcagagggaacagctcgtattcgggcttcaccgagtcgacttgaacttttgaacagtcggccctgagttgcgctccatgcactcttgtctctggggtcgacttgtacgcaagtccctcggctgctggaaccatgaaggtcggcatcaccctaactgtgagggtgcagctcgttggttcctgcgatagattaatcaattttttttagaatattatatatcatatggattcgttatgtctttcatgtattgagtaagttcacggttaccgttatgtggtcgactgcactgtcgaccgatgttggattttccgccaactcagtcgatgcgcaactgctgcgttttttggtgggacttcctaactcttcgtgtgcaacagtagcggcggcctgggggttctgttgctcttctcggatctcttgcctaatcttggccctcatcaactcgggcttttcgtcgaattcagatgtcagctcagctcttatcgacgcctggatcttggcttcaaggcttgtatctttctccgccttgttggaagtccgcttcttgtactgccacgcgtagtctggaaatccatacttccagggcacagaagacccaacgccctgtgtgcgtccacggtgttccttgttgcccaacgctttcgtggggaggtcgtcctctcgtctttgagagcaggcctcttgcgaggcttgttgctcggcaaccaactctttctgcattacaatttagtggggttaaatagactgcacgataggaaacaatgtgaacatctagtttgactagacacttactatagcttcgtatagtccttgatcttctgcatttggcatgaagattgtgccatcatcattcttctggtacctggccctggcccagttcctagcccgagggtgtgggatatcgccaaacacgagcggtgtgcacgattcttccgcttcttcatcctcacgctgccattcctcttccttaccggcttatccggcggtgccaagctagtgcggatgttggttcctggtctagagcaagcgatatgccttgcttctagctcttgactctagggtcgacttcttcacatggaatttctctcttggatctggattcgccgggttgtagatgaactcgcctactagcttagtcttgaagttcttctaagcattgcccataaccttgaaagcagcccgcctgagacggtcctcatgctccgcaggataatcaaaactctccttgaacgttagccaagcaatgtccttctctgcggcgggcacgaacttgatgtcatcttgtagaatactgaatttctgcctccctatgaccccgcagatagacctaaatcggctcaatattttccttggagttgtcggataccctacggcgtccaccactgttatgcggaaccgttccttagggattttgttccctgtcctaggagtaggtgcccttgaggacccactagttgtcgtcgatattggttcgccttgctgagacatcgtctactttttttcaaaataacaaaaatacacaattgagtgctacaatctattacaatgaattgaatgtcacttataaagataaatgaaacatataaataaactaaattgcgcatctcacagtaataaaatgaaccacatttcacatatcatccacatccacatttcaatgacatgtcattcacagttagcagagggcggtgcgatggaggactcacctgaggatggccggtggggctcggtggaggcggcgccgggctcggtggacggcggtgccggtcggtggagatgccggtcgggcaggtcggcgccgggtggtcggcgtcgggctcggtgggggtcggcggcgtgcgtcggtgaggacgcgggcggcgacgacgaggaaggccgacactggtccggtcggtgtagaggctcggtggtggcggcggcgggcttggtgggggtcatcgttgaggaggcggcggtggtccgaatggaggaccgaggaggttcggtggcggcggccgtgggctcagcgtcggttgcgacggcggcaggcttggcgagggaggatgacggcgttggcggcgggctcggtggcggcggcgccgggcatggtggagggcgtcgccggtcggtggaggtggcgccgggcttggtggaggcggcaggctcggtggtggcggcggcgggctcggtggcggtctcggtggtggtggcggcgagggagacgacggcaaagtaggagttggcggcggcactagggttctaaggaggcgggaaactgtagcgggacattgaaaaatgttcgatccgatctgagaaaccctagttatagtagagtgatgagtcatctcaatcgggctttgccgtagggcccgtcacagatgactcatcggtgacgggttccatactaatgcccgattgagatgacattcaggcccatcacggatgacttatctgtgacgggccctaagataatgcccgatagagatagattaatctctatcgggcttgaactaaggcccgtcaccgatgactatttttctatttttccagataagtctttatatttgtgagtacaaaatatatagctgctatataataatttattttattagtcataatacattttcagatagtaaatgatttcaaatcgaaatatggtcaataacaaaattgtagtggttatcaagatctacaacttttattttggtcacttgtctatataactttgtttccaacagcttgaaattgactttgacaatatgataaatctaaacagtatttgtaaatactaaatgatttcaaatggaaatatggtcaaaaacaaagttgatcctctcatcaggatctacatcttttattttggtcatttgtctatataactttgtttccaacagcttgaaattgattttgacaatatgacaaatctatacaacatttgtaaatactacatgatttcaaatggaaatatggtcaataacaaagttgatcctctcatcaagatctacaacttttattttggtcacttcttcatccgacaaagtgatagttatactatttacaataatcacattt

SEQ ID NO: 69232 - DNA, 3664 bp, Oryza sativa
gattgagatagattaatctctattggccgtaaactaaggcccgtcaccgatgattcattttccatctttcatttgttgtgagtgcaaaatatatagctgctgtgtaataattcattttattagtcataatacattttcggatagtaaatgatttcaaatggaaatatgttcaaattttgttagtcataatacatttcaaattttgttgtagagccgttcaagatctactagttttattttggtcatttttctatataatttttttcccaacagcttgaaattgattttgacaatatgacaaatctaattaaccgcatttgtaaatactaaatgatttcaaattgaaatatgttcaacaacaaagttgatcctctcattaggatctacaacttttattttggtcatttataataaaacaaaattagccatattaatgactacacatatcaagtctttgcaataaaacaaaatacttcattcatttcaatagataagtacaaatgcatcagtcacaaggttatgccttccgtatgacctgaacgagcatatgccacaggctcttggggatcatcgtcaaggtcaatgtgaggtcttacatgaagattatggttgtattcttcttcatcgacgacgttgtcaactcctacaattcggcgctttccatccctcacgatgtacatcttcttgtttgaagggtctattatgtagaatatctgctcgacctgtttcgcaagtacaaatggttcatcggcgtatcccaccttagatagatctactaaagtgaaaccttcattgtcggctttggcaccagtgcgtagattcacccaatggcagcggaacaaaggaaccttgttcttgacgtagtttagctcccagatctcctcaatgcggccgtagtatgtgtttgaccaacttgatcctggaatgcatctatacggacgccgctgtttctgcactgtgcttttgtcatcttgtttaacggtgtaaaatgtgtatccatttatatcgtatccttgccatgtgtctacggttccatccccaacaactgtactgtctcatttgggacatccgtgtacattgtcacacgattcttgaaccattcgttaaaccgagaattatgttctctgttaatccatgcatcagatcgccccaagttctcatctcggattttcgctaagtgctcctcaaagtatgggccaacttctgccatatgttggagcacagcgtaatgagcctgcgcgtacgacgcttgatcgggcctaattcttttccttccgattgtgccaacacctgacaaccttccctcgtgacgagacgcgagaactccaataggatcggcatcggacatgtaattcacacagaactcaatagcctcctcggtcgtgtaacattcaatgatgctccccatgggtttagctctgttacgaacgtacgacttcagaactcccatgtacctttcaaacggccacatttcgcttagaaaagctgggccacatagttttgtttgcttcaccagatgaacagggagatgaaccattatatcaaagaaagacagtggaaaaaacatctccaggtgacagagggtattcacaatatcggtctgcagcccatctagatcttctggatctataaccttctgtccaattgcattgaagaaggcgcacagacgttggatcgtgtgacgcactttcggtggtagaatgcctctggtagcaactggcaagatttgtgtgattagcacatggcaatcatgagacttcattcaaacaagttctagatcgtccaatttaacatgcttacttatcgtcgctgaatagcccgatggaactttaatatccttcaagcataataacattgcgatcttctcatctttcgacagtgtgtggcaggctggagggaggtacactttacctagctgtgcatctcgtataggctggagttcactgtagataaaggcgcgcgttcaacccgtcctttgtcttcccggaaatattcaacatcaggccaaccaaactctcacacacattcttgtctacatgcatgagatcaatgcaatgacggacatcaagatctttccagtaaggtagccgctaaaatatggattttttcttccacatacccttctcctttgtcttgctacgttttcttttcttcccaaactcattgcttatgtccttgaccatattgtggacctcatctccggacaaatctttgggagcaggctgaagttctctcttaccgttaaaaaatttcttctttcttataaatgcgtgacgtagcgggagccacctccggtgacccatgtataccatctttcgtgatttcttcagccaccggcttcgtgtatgttccttgcaatcggagcatgccttctttccttttatagtttgtccggaaagattaccgagtgcagggtagtcactaatggtgcagaacaatagaactcttagcttgaagttctcctgaccatatgcatctcaagtttccacatcttctttccaaagaatctccagatcgtcgataacaggctccaggaatacatcgatatcattgccgggttgccttggaccttggattaacaagcacaacataatatatttccgtttaaagcataaccatggcgggaggttatagttcgcaataagaactggccaagtgctgtgagtactactcatgtcaccgaaaggattcatgccatccgtacacagacatatcctcatgtttctatggtcggcagcaaagtctttgtgttttcgatcgatattcctccattcagtcgaatccgctgggtgtctaagcataccgtcgttccttctctccgtggcgtgccaacgtactaacttcgcttcgttcgggttggcaaagattctcttgaaacgatcaatgataggtagataccacacaacctttgcgagaccacccctctttgacttatttcctttgtcagcacttttctttcgcttgtatcgagaagccttgcagacaggacaagcatccaagtccgcatattgcttgtggtacaatatgtagtcgttgggacaagcgtgaattctacggacctctaaccccagtagacacagaacctgctttgcttcgtatgtcgtctcgggtaatgtgttctcaacaggaagcatagccttcaaaattccgaaaatatctgtgaaactcttgtctgtccatccactacttgccttcagcttcattagggccaaggtaactgacaacttagtgtgtgttgcttttgcatccagcgtacagaggcgtctcggaaccacttaccaacctgctgaacttcattccatctctctcattctgggctgggtcctcaacatcacgtaacatgtcttgcagtagatcgtgatctacatcaactatttcaccgcccaatggagaaggtataaacatgtcatgctcatcttcatcttcctgattatacgcaccacttctatctgctgctactccacttcttgattcttgctctccatgcttcacccaacatgtatagcccttcatgaatcctcgttgtatcagatgaccgtgtacgtcctctccgctataaaacatattctcattcttgcaatctgcacatggatgtcacgaccggaaataacccaccgggcgtctcttacgtgcgtgtattattccttgtcccatgaggcaaggt

SEQ ID NO: 69233 - DNA, 10603 bp, Oryza sativa
  unsure (1)..(10603): unsure at all n locations
gatctgacccttcactatcagatactctgccgccatggcttacgaggtgctgggtcaactgtcgtgcacctcggaaggtatttcctctttgacgtctaggaatagttatccctgctggaggccattcggtgctggtaatagtcatcttatgtacttcttcttcagttcgcatcggtgcttttctcttctgattcttactcttcttgcctttggcttgcttagtacgtgaccccatgtggtacgaaaggctaggaggaaagcaattctcgggattcaatggattctctccattgggctctctactttgcacactaggctgcaagcttgacttgctgcgaggaggctggtttagcgatgtctgccctgctaaaccaaaggaaggggcttctttggcatatacccatggacaattcagggcatagtgtcctcgttctctacaatcgtgacaaaaggggacatcctcttctggcattggaagctcattgacctgggtggcaaatgctcgatcaaacacataccgattttggtcttgacttccaaccaatggtagctgtgaactaagcagcatgcttggaatggaccaagggtgtgcccttgttaactctcttgaggccagtggtggattgagttggaaacttaagttactggaggcatacccgctgacattctttcctttttctctgttaaacatctgtgatagggattgaggtgagagaggaaacaagccaggaaagaatagaccagaactagggacaggaccttaaaggaactaactcttcttgttgatgtgttgtttgtttcacttattctgcaagttgattaagcaaacaacctagcatggttacatcacacaccactgatgcaaaccacgcgctacacacacaagcaaaggagcacacgactaacgaaacactagagggtggcttaggttctgcgacgggttctccaagatcttcactcctgcttcacagctggcttcattgcttccttcgcttcgctagcggaccctgcggtcttccggaccttcggcgaacaattgacgacatcttcttcttcgtaaaactaaccatctagtactagctgaaatttgaagaaggaagaaagagtaaacattttgcaaatagcacaggggaaaggaggaaaaagggactttcgcaaatagtttcgtttataaaatatgtccttaggttttatccacttggcttatcctacagtcgagatggctctgataccagcttgtcgcgaccgggaaaattgccttttcccgaacgctagtgtattaattcccgtcccaggaaaagccggggtacaccacacaaacatgatataaaagacacatctttattatatcgataatatttacattattacaaaggcgcttcaggcctggcaatcaaaaataaacagcagcggactagcgggcctacggctccatcttcacaggcgctcaactggggtataagccaggactccacctaagacatcttctccaaagcttctcttactgaagaggggaaagattgagcaagaataagtacaaccacagtactcagcaagccacaccggagatgcataattattgcaagggagtacaaggggataataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcctagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccatgtgccacataccaccacggtatacggacggaagacatgacatagtttccaacccatcctagccataaacaagagtaccgacccaaccccacctacggccggaacccccgggacaggtaggcaggactgagcccctaacagcaggacaccggccctgtgccatgacatctcgactaccgggccgcagctcgtgtagccttcatttgccctagagatgtccatcgactccgacttcgtccatctccatccgtgtacttttgtttataaccagactgagccacaaactaagccttacccgctagacatgtggaagtacggtagtgctttgcaacagaggcccgaagaccgatccttatatggccgaggtgctactatcaaaaccatgcaccctgagccttgcctaaaaccattttgagggttttgaatagagggggaggtgtgaatccaattccacaataatccaaccattccatagtgtcaaggtgataagagtattcccaaagtctagagttgtaaaaccacctaatgttgcctaattaacgagcgaagcatctacctaaaatcataccagtggtaccatgagtagagtgtccactagttggggttttttttaatctagggtgaataaggtaataatatcaataacaataataataaggttataacaaaggttaataggcatggctaaataaaacagtgataacgcgggagtttaaataaagcgataatgcaataatttaaatcaaaataattttataaacaaggattcaatatgtacaaggacgatgtgacttgccttgctcgctttcccaaacgtcggcttcaacctccacgaagagcggatattccgaagctgcagcgtctacacgaccaacggaaaataatagggcttttactctaataaactccatataacaagtaggaacaaagcacaaaaatgggttcttgacttcttaaggaaaaattagagacttgaacggtccaattccgagttcaaatggccaagttatggccatttgaaatttatatgctctttaaatgaatatttgcgaatttcttcatttaaattttaatttaaaaagtgtttattgcgtcagccgaggggagggggcgcgcggaccgggtccacgggagtggggcctacgcggcagcctcacggtccacggtggaccgggcgcacccgggctcacaccggccggcgtcgttggccccacgcatcagccgcacccgagggcgcgggcggctgacggccgggccccacgcgggagccactcggcgcgcccgagggcagccatgccggtgcggtcggcgggaggcagcgcgtccgcgccccgatggtcgccgccggcgaccaccggcacggcggagcggcggccaagagaggggagggaagggggaaaggaggcgacggtacacacccccggggcgacgacggcgacggaggaggcggccggagcggagggaggcggtggcgcggctcgggtcgatggggacggcggcgctccggcggtcggcgaccgaaacggaggggtggacgaggtcggcgaggatgcggcgaagccgaaggaggcggcgccgaggtgggaggcggctcggggcgacggcggcggcggaccggagctcggcggcgacggcggagaaagagagcgacgtcgcgagcttgaatccggcgaggaggaagggcggcgagaggcggaaacggacggaggaggtgcggggagggtttaaatagggttggaagggggagagagcggccggaggggaaggaaatcggcgcgggaggtccagccgccatcaatggcgccggcgagatttgcgggggcaaatccgcccgtttgaacgcaagagagagatggaaaaatggggggaaagggagagggaatcacggggaatgattccccccactttattgcacgcggggacggcgggaggcggcgggatccgcggcggcggcggtgctagggcacgggggaaggaggcgggagcggcgggaggaaggggatgacgggtgggccccacccgtcagcgagggtggcgggcgggcccgcccgtcancggcgcgcgcgcgaggagaggccgagagggccgcggggagaggagagagggagaggggggagaggagagatgggccgggccggccgaagggagggaagggggacttttagggtttttctttttataaaactttttcaactttgtttatttcttaataattattatttgtgctctgaaaattccactaaaacttatttacacattttaggcttttaggaaatatacaaaaatcctctaagccttgtttgacttttactttgcacattttaatttttggaggctttcacccggattttaattattctagccataatttaaaagaatatattttagggtcgttttgggacgtgacagtggacaacacatgtaatcattgtttcttcttatccgatcctcctccgcggcgttcatataatttattacgccctttctgtacttcgtagaatgacgtttcaaatttttcgcatacatccaacttcgatcaattgctacaaaataaaaaaacaaattagaggcacatattataagatcagtattgcaaaagtaagacgtgatgaaattgttcaattaatgattaatattactcacttgattgatccattttgatcacttttgggaatttaatttctgttttcattggaaaaaggacaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagtaatctctatcgggccttaataaaaggccgtcaaaaaaaagtgtcatctatgacgggcactaaacttatctcaatcgggcctctagttagagcccgtcacagatgaccctcatctgtgacgggcttcttttagggcccgattcagatatggaaccctcatctcaatcgggcctcaactatagcccgtcacagataagtgtcatccgtgacgggctttagttttatgccgatataccatggctgtgcgaccatatctcaatcgggtgaaacttcagcccgattgagattactttcttgtgtcggcccgcaaattccagtcttgttatgggccgtcacagatggaaagatctgtactagtgctataagatctggaattggatagtcccggcgctagttttcctttcctgcttgtcgagttcttgtttaaggtttggctcagcttcatggtgtttgtctggcctctatgattgctataagcggtttgttgcttcacagacctgcttcggtgagtttcttaggttaccttatgttttgatgctctgtatggctagatggagtcctcaacatgactttttttataccctctcgatattacatggcatccttcctcaatgtcctacgtgaatggcagtatttttctatgctttgctgaaacaaaattatcatcacttttcaacaatcatcatcgaccatagagcattttatttgccctagaaagaatctagattctggtctccaatgccctctgtggcccgatttgcttataccacttttggatgagcatatctcagttgctttaatttcggtttgcttgttataagccatgtgagtgttcttccaagaggagttgaaaattgaatcgaaacaactatgaattcttatcgacttatcctattatactttatagaagataatattgtttagtagaagaaatcactacatatataatggtatatcatggaggggtgagctcacaacaactttagcctgaggccaccccaatttgccgacaagaaacatatataggctttggaactattgggaagtttcaaagcttttagcactgttctatttagtagacggtagtatatttccacgtagaaaattgtgtgtggccaaaggctattctgcaagcaaacctttgtaaaaacgaatgctaagcatgctgctctgttatctcttgaaggtgaaaactgcaccccatgcttcttggtctcttggatgccttctctaacttgccatgcatagacagattacctgcaaccagttgtacaacattattgcatggataccataatctcagggcatcagtcacacacgcacatatcaacattggaaagaaagctgcaaaaacatttgaactgagttgtctcatagttgtgagttgtgactacccaaaacattagagacatgagacatcataatttaaatagatcgtggtcaaaatattgacaaccatcaagagaaatggggaggaaaagaaggtcaagtgtcaagtgtgcggatgaccggcgagtaacctatcactactggagaagtgatctttgcttggtcagccaaaaatcacattagtcctggttcgagtaggaacagagagtaaaaaatatctttagaaccggttttaaagcctaggggtacgggactaaatatcatttttagtcctggttcaatagctattaggtccccaacaaactttagttccggttggtatcaccaactgggactagagatcagatctttaatcccggttggtgattccgaccggggctaaatatctctctcccacatccgctctctctcttccttatcttctcctctacttatcatctcctcctcttctctctctatctaccttatcttctcctccactccttcccttcccctctcccctctccagcgggcaccctcctccactcctccctcttccagtgggcggcgtctatgttaacggtcattatcgatcagtttcgaccgtcaatattaccaaaatagagaactagtgatgcttgcaatgcatatatatgttagaataataatattccactagtattaagattactaaccttttacagagaatgacaataaagtggaggagaatcgacttcaacacaaacgataaatcaatcggacgatgtctagaatcagacttatgcatgaatgggccaagaactcagaattggtacgatgaattgggccaaaattcacaagtctatgtatgagagcaaaagaggaggctgcctgccgaaattgggccaggtcggcccagcccatggtttggccgaaccattgggttcggccgaaccccccgcagcgccgtttgatccaggtttctcctggacggctgagatgactccccaatgatggttggtgggtatttgttgacgtaacacgaggcctgggagatctgcttaactccagtgcaggtccaagactcgccttcgggtatgcaagcgtgccagttgatttgatcctgcaatcaacaagaaataaagacgaagaaactgcggttaaacctataaacgatagccgatcggctaggtgccgatgacatatcatttatctttgagccgatgtcatatgtaaattgatcggcagttataaatagataacaaagaactaaatctactcgatcggctgtaggtatcaacaatatatagttcttatatcgatatatacttaaatcaagtgattgggatagatcggtcaccatgccgagacagtataaatcacttaggtcgaagtatatattaataacgggactatatgtgtttataacatagccgatcagatagatctagcatgtatcggctaatactccgatacaactctatgttaagatattaaaacaagcagaatataccaaacgaaagcttaatatgcttagatgcgataatatctttacataaagggcagatttaacatgtcaacgaagtatatagagcaaatatagttaaatcagataaaatcggctgaaactccgacactaccctaattggcaaccaagaagcaggctagagattaatattctaagtacgacttaatagatcaaactcaactgatgcagcattaagtatgaaaagaagaacaatatctagacaatcaagccactggaagtttcatagagtggtagatatcctatataaactaaacaacgtcattgtctaacctaatcggctgccctcttccaacagatgttagccgattgtaggttagatagcgatattgccaaagattatgtaagatatatgataactcgacggattacataaacaagattagagtatcataaagatggaagcactaatcccgataacacaagccgtcataacaagttttacctcttgttgaagatcgaaactgatgcagctcaacccgaaaacaagaactcgtcgaaataaatctaaagcaaaagggtggcgatgcgccgaaattgtattgaacgtgtgtgttaattgattacatggggttcggggtctatttatacccgaaaattacaaactatgtccataccggacacgactcttatctctaaaaaactctaagataccataagtctttgcggcaaacttttgcccaaacatatctctaaggaaattacataaaatatcctaattaatagatacagttgccttctcagtactctatccatgtacagtaatcatcttgaagtacctcaattcaacccgatgtcaaacaccaagtcgtattgttggaatcgtattgtccgactcagacccagccgatcctaatcgtagccgatctagagtccagcagactcttgctctgttcacgaatcgatctccgccttcgaatccacttcaatctaatcttcttttccgatgccgaaattaccaaatttggttgttaacacatgccccccaagtccgaaatatttggtaatgtttcggatttgctatatatcaactccgagcaattctcgcactttgccgttttccgaccgttattcccgtgctttaaatactaaccgccaccctcgagaaatcttcaccccgttacttccgttttcaccgccgaagccaaccttctcctttctctctccggcgattccttcgacgctcaaggcgatccccaagcgatttcgtctccggttagatctccgcccgcagcgatgtcgtcttccgccagcccatctaccgcgccatcagcggagtacgctgaggtaagttctcatcggctagatcccttttcctcgcatgaaatcgatttcccccttcttcatcttgtttttttcttctcgattcctttggatttgcagcacctttcccatctagttgtggttcccagcctgtcacatgaaaaccactatttccttggtccaatcggcaatcttgaccccactaattttatcattggtgaaaccaacagaatcctttttagattagccaaccctaatctgggtcattggaagaatactttcaagttgtggccatctcttgagaaaaccacccctgagaagagttggaccacatcgtaccagtgcgtatcggctactaagaaagttcactgggatgagatttggatcagccaagtgcttgccctcaccatagctaattccaccaaggacaaacctctgatggctgctgccacctatttctggtcccacaccatcaatgccttcttgctcaaccaagggccgatgactccaaatttgatcgacattaccatgatcaccggtttagatgtaacctcatcggctaatcccatgagcatgaacaccaaaaatcagtttgattttagaaccaaaagcataggtggttggtctggctatgtagcagcatatatgggccaaggatccgttactcctcgagaacatgtagctttcttaccaagtggctagaaaaattcctcttctatggatccagctgtggccctacaaccaattggcaatttgtagccgaagctctagaatcagagaaacaatttcccttgggcaaaatcctccttggctatctataccaaacattgaacaatgcatcggccaagatagccgtcggctcagtagttggtgcaggtggaccatggtgtctgctgcaaacctggttgaacctgatggtcatgaaagttgtcaatcggccatctgtgacagaagctgagttcccattcccagagccgattgtaggagttgatggaaaagaacgcactcatcgcagatgcacatcatacggagaatatgcatcctcaccaaccgatcctggagcaaagctatcggctgagctactcaaggattggttctgcagcttctatgaaggctttcagaaagacgcccgggtttggttcccttatgaggactcagcagatcttgaacttccatcagactttagatttgaagatatcaatcacgaaaagtatcaaaaatccagggaagttcttacagctgcaatcagcccatgcatccttcctgtcggcattcatcagggaagaaatatccaagtttcttatgagttctaccacccaatgagctcagctagacaatttggactaggccaactcccaatcggcttattctttgccgacaagatctagtgccgaggagaaatcacatcaactctaatggtggatcgactacttaacctcccaggagcccctctgggcagcattgacaatattgagttggtaggatttaacagcagaaacttcaactgatggtggggtgaatggaagctgcacttgtttcatcaatcggcttcgatgtttatgacagatctattccctgatgtcataccccaggtaaatctcatcattattaacttgaatgttggtt

SEQ ID NO: 69234 - DNA, 1102 bp, Oryza sativa
tttcacaagagtaagcatctctcttcggcttcttttgtaattacctcactcttcggctaattactcatagactttgtgtttacagaagaagaaaactgctgtgaagaagaaaccagcagcaataattgtcaagtcggccccaccagtaagatatctttaattcttttactagtcaatctcaaccaacactatataacacttgcatattttatagccacctcctccttctcctcctgtacagcaatcgtcgagtgaccgggctctatcgactgtagggagtcatcatattgaggaggaagaacaaccagctgctcctactatcccagtaagtttccttttgataaaagaaattagatcggctatattgacctagctctcaaacttcctgaaattgttcctgcaggttctagtcgatctcttctcttttgacatcggagattatcttgatgaggcagaagaggatatttcaagcaaagctctagcccccttatctgacgatgtgaagaaaacagttgaagatatctcccgttggctagaggcctcttctttagatagcttggtggtcgactgtggatcgattaggacacgactacatgaagttcaagctctgattcccgaagaactagccgatgtcctaactccagccgcttatcttgaacaacatcaattcaagctgaaaaaagccaagctaagactagccgaacgccgtgagcgcaaggagattgaagccacaatccaggtcaatcggcagcttatgcatgaagaaaaagtcaaactcgatcagttatccgagggtccgattaactccaatattaatcggctcgaagctcgcaagattgatctcttggcacagctcgaagaatgcaatgctgaactagacatggaccacaaaaagctagccgatctcccaaaatctgtcgaagagcagaaagcaagactcaaatcggctatcaagaatgttgctgacatgaccaagtccctaaaggtcatttttggaactgatgctcaagatgcccaagccattgaagaagtagaacaaattaggcaaagggctattttggctatccagcaatacctgtctcaatgacttttgtgtaatagg

SEQ ID NO: 69235 - DNA, 5168 bp, Oryza sativa
ggggggcctgatatgacctgacagcattcgaaccgggactaaagatgaggttggtaacacaaaccgggactaaagatcaaatatgcccgttacccttttgaaccgggactaaagatcatctttagccccagtttttattgcatccgggactattgtggaaatcggccgaccgacgaaagaaggtttctccaccagtgtgtattaagttttgcgtttatgtccagtcttggtattaacttgtgattcttcgttttgcagtaattttgttcaagtttaatccatccaaaatttttataatacttcatccatcggatttggaaggattcgtgtattttttttttcttgatacattataatttggcttaagtttgacatttagttcacatttattgaaattctgagatagctggcttttgagggtgttttccttaaaccatttattagtttgcaaaccctttggtggagttgtttctgggttagtgtttgacaaaaatttatattaaaatttatcgaataaatatttcaaataacaaacatcaatgtgtattaataaaaaaaatattttggcacatgcagcgagattgtatgatatatgggcccaaaattatcaaataataaacgtgtccgaatatacccaataattggactcgttcttttcgaatagaaaatgttggtgaaaacagattttaaatttgatgcgtagtttaaacagttttcaggcgttcaaataagagagtttgactagtattagttgctcggttggaaccgatcacgtgtattacgctgattatctccagcgagaagaaattaaaaaaatcaaatgcagggcccactgtcattagcagtaatacgtgactttctttagcaatcgggtggatatgctcctccttgcgtgttatgcagataatcaacggatttcgctggcttgtgctagaatctcggaagggattaggccagggcgccatcgcctcgcctctgcctgtttaaaaggtgcagtagacggagagacggagacttgagaaaatacacagcgacgagaaaaacagagagactcgctcctgagaaatcacagccaatccatgcgcgcgcgcagtggagatcaatgttcaaacatcccttgtcatcaagctgatgtcgcaggcggagatgatcatgtgctagagtaaattccctatatgcaccttaaaactgactcaatcccttccatgtcctccaattttgtgtgcccttgagatttcgctgtgatccctcccatgtctctaccgttatttctcacagcattgactggttaatttacctggagatgtccattatacccttaagagtcacaatatgactaagcattttaaccaaggttgtcattacgctaattttctcatgatataggggaaaggtacacactaagtacatgtcaccacgggaggaacgacagcgacagccacgaaagaagagcggcggcgctgtgcgccgcccgcgtcgaggggagacgagagattggagattatttggggatttcccgctgttgctggcttgctggttgctacctagggtttcgctaggcattttggtctttttaaaaattactgacaatgtaatggatgtatacactgatagatctaacagatacctaatggtagggacatgggagagaacacaataaaatctcgagggtacacaggggattggttaaactggagggcatggaagggattgagtcagttttgatgtgcatacagggaatttatcaacgtgtgaggtggtgaataaattccttcaaagattttggtaaatttgtcattttactggatgatcaaagtacctcttttcttcatcaacttgagcgatctagaaatcagatcattccttccttcttgaattgcaaacttaggtatgtctaatcggcggatcggactatcctcgtgtttttatggtgcacatgtcgggagcgagtccactggcagatatgtgtatatatcgggattaaaaagaaaacgaaaaaacctggtcccaaatcatcacacgtaactgcaatttggagactgaagagactgacacgcgccattgcatgttcaacttgactactcgtttttcacctcccccgcaactcctcttttttcgccgcgccctgctgcccgctgcccgcaacaggagagcgaagcaagtccacgaggcacctcgactccgcgagcgccgcccgcgcctgccttcgcccacgcccaccgctggtcgccgccgccgcctgagataagacgatgagttcgttgtccgccatgcgcccgcgtcgcgtgcccacttctctgactctccctccgtctcagcgtcctcggcggccggcgagccggcgaccgcgcccattactcctctcgtcgatcgtcatcatcaacaaatgagtcatgctgtcacgagcgtcgagcgatagcgtctcagcctcaacggccgagcgacgaccgccatcgacactcgaccgtcgagtcgtcgaccctgcttctgaccatcgaatcaacgatcggtgactcggcgcgttggatggcatggcattgtgtatcggaatcggaggccgctggacgacttctgttttagttcttctacttgtgtagccttttcaattttcagttttaaattttaattcttatgcgttgtgagattaaattgtactactatattgtagattgctaactgtggagacatgaagaaagatggagatattgcatccattttaaaaaaatacacaacaaagaagaatacttttaaattgtcttcttcctcgattgtggtaaaggaaacacactgaagagcaagacgtcaaggtatatgtttgatctattatattatctatacttgtatggtatttattaacattgttacatttacgatgtttagaaaagatttttaagtaggaccacatatcctaaattctagaggagcgagtcccaaattcctgaagagaaacatcctccgtacaaaataagcaagatgcaaggagaagtggagattaaaaatacataattgactctatgtccgagaccgatgagaccagacgatgcattggctaaagctgacaaagctatggccaccacatttttctattatcgacaaaattatgaccgagcgctagcaatgctaggttgctatattatttatacgtccaaacaaacaggaacagatgcaccgttgctaggcaccaacgaggcaaaagtcatcccctcattccgacacctgtttcatacaccgatgtaataataacgtatcgatcatgaccgggtttggcaaaacaaagccacttgttctgccatacaccattaaatccgcaccaacctcaaccttcggcgagcaaataatttggaagaccatgatcacaagtgcaacttaatcagaggtgttccgtaggcactgggacttagcggactgaacgtaatatccagtcagtgtacctttctattaagtatcctcgtgaaggcaacatgagaactcgtgcaggagccctcctatttttttatacattcatattaatcaatcgtgattaataaaatatacagggtttctctatttccgtgtgttcgttattttgttttaatcaaacaatttgtattgtatattttgtcaaattttgggatcgatccaacgattggtatcgaaaaaacacatatttttaaagaagtattgacttgtttttagaccgatggtcagaccatccaggtctcagtcaaaccgaccctagaaggttggataggctgctcgacgtgtgttctattggcttttgagattgggtgtgttttaatctatcaaagtttgattattatacttatgctcacataatctaccatgcatctcgttttgtaggcttagttaattgtattcgaacctacacaaatactatgtttaaccatttcaattcatggatttcccgtggaagtgatgaaatgaaagtaattcccattctgatcgcatggagaggctaagaaattgtattgtcgatgcatgtataaatccgtgaagtattaaatgtttgtagtaagtgtaattgttggatccaatacttgttggcactaggatatgatgcacggtaaatggagtcatgtactcacgacttcactagcacaaattttgtgctagccccctatacaattctactgttcatactatatactccccccatcctaaaatataaacatttttagcatagtaacaagtcaaatatttttaactttgattattaatagaaaaaaaatcaatcatataaaattgatgttactagatttattattaaacaaattatcatcatatgtaactctttttttaaaacatttttcttttatagatattattggttaaagtagcatatcggaaaccatgtcagagtctaaaaacgattatattttgaaacggagggagtatttatcagtgtatagcatgtgtacacataaccattggataaatgaaatggagctgtggtgcatgcacacctggcgagatacatcgaatggactctagccaatcgacaaaacacactaatgttcaatcgcgtaggaaaactagaacagtagaattccatatgaaaattcattattgtttcatatcaagacagatatagtggaattatatcttctatgcaaatcaaatacagatcttatcaggaaaggaattggaatcataataattgggtgaaaatagagtgtacgttgtgttagaaaagtagaaagttccacacctttgtaaccaacaacataaccaggggcatcggccattgaattctccatcccgaagaatggtaacctccttgaacagtctatattgcccctgtcttttcgtccttaattttaatgctagaggaacctagaaacgaagaaacaagtcaattacacataaattaaattagttaacaagtcattagatattattttctctatcccataatataatatttgtgcgcaatttaagatttaatttttaaaaaacatttaactaacaattaatataacatgaattgaattttatttgctgaaaataatatcattcgattaacatttgaatttaggttatatttctgttggtataatacaatatgagaaaatataagctaaaaattaattttagagaccgtaccgagtttgatcatacctcatattatataagctaaaatatagataaatgacacactagtaaagatt

SEQ ID NO: 69236 - DNA, 934 bp, Oryza sativa
agatggatgaagtctgggggcatctatccaccattaaccgaatactagagagccacgatctccaccttccacacatcaagaagcatggctctggtagcggcacaggagaggagtcttttgttccaaaccaagatcagagcaccagtggcagtggtgttctgcggaacaacgagttagagttcctggacttcgatatgtgagcagttcctccacgggtgcaaggtcatggaggaggacatgctatggctgggttcttaccatacgattggcaatgctcaatgttagaacatacacttcgacaaagaggagggcgaaccatgctggccacacttctcagaaggggtgcgccacattttcacttcggactaacagccacagatcttcatcattggtcttggtgatcccctaagttatgagtattgacatccatcttcaaaaactagacaatctgggggagacaaccaccaactgcacacgtcatgactaagggcacgttagcgacttcatcagcatcatgatcgttgaccaaactaacgttgtcggctgtcagtgcaatagcggtggacagccaagctgtgaccggggaatcagcagcatggtggcagcgaccactgtcgtgactgacattacgactgcacaagcgggttcgtctattttggtatattttcaccatttgtaaccccctcccacctccctccgaactaaatccacatttttagctatagttcgtctattttcaccatatgtacactctcctccttcaaaacccaggcacctacataagcctaaactcagtccaaagcagagtaaagaagcaagtggtgaccccccccccaaccaaattttggtgtagcttcgcatgggaaaagcatgttgctcgagattcgaatgccacactacaatccttggtggattttggttaggcgcattgctt

SEQ ID NO: 69237 - DNA, 5070 bp, Oryza sativa
  unsure (1)..(5070): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccataaccgagggcttggctattcgaatagattatactctgatcatccatgtctttttatttctgaccatattaagctatgagttaagccttacccactagacatgtggttgtaaggaatatgctttgtaacataggtccgaagaacgatccttatatatgatggccaaggtgcgactaacagaaccaagcacattgagcccaacctaaaacaagtttgagaattatgaaaagaagtccaacatgtgcaggctaacaacaagcctctaatccaccattaatcaagattatatggttattcccaaagtctagatcattaggaaacaactatatgtttctcttagagcattgctaagcataatcctaaaatctctaataagcaccgcacatagagtagtcactagatagttatggttttctagggttgtcaaaggtaattactcaatatttaataaataaggcaataacaaaaaatataggaaaggctaagtaaaacagttataacacaataaacttaataaagttgacggagcttagggctcctcaccgggagaccgcgcaggcccccctttgtcggttcggccgggggcgctgagtgaggttcttcgccctcgatctgaggaacgtcagcgagaagaatcgcacaagacacgggcgacgtagacaggttcgggccgctgagaagcgtaataccctactcctgtgttctggtggatctgtgtgtgaaggattacagtgagctcgagagcgagcgagagtgcaggctcctcccaaaatccctctccctcctccttaggcctgggcctccttttttatctggttaggggtcaccacatgggcctctagctgcctaagaaaggaaacattctttttataatgagggctagtctacagccggaagtgacctttgacaagcagagcgcacgtctcttgccccgctcgtccgcttttccgggggacgcccatttcaaccttcatttaatggccagcgatttccttgccatgcttgtgctgaagcctagaatggatctgaccgggactgacataccaactccaggagtcagcacgccagctccggctagagacgagagccaggaagctctcatcattctgacgggacagggcgaggcgcgcgacaggccgcctgttgccacccatcccgcgatctgaccgatctgtgaccggtcacataccgcgactggtcacggaccgggtaagcatgcgctgcgccgcattgaatgcggcgtagcgcgctcgcctaacctgctataaatgcggttaggtgagcgctgctgctcacctaacctacacacgtggcgccaacaccgcagggggtcggggcgccccagccctcggggccgaaacgggagcagcccgacccctcggggagacagagagaggggggggtggccacgtcaccctcgggcccgaccccccgagggggtcaggccacgtaggcgaccgcggctacccaagcctctagtcacgatacccccggccccatgtcaccgacaaaagtgaatgcaaaaatttaaattaaaatactttccgtaaattgggatttgataaggagagtgtgacttcccttgctcaacgaaacaaacttctgagacttcagcaacgaacatgaactgcatgactggaacctccgaaatgacaacaaccataggagcaacaaaacaaggccacaactctaagaaataatgataacaagacataaaagcaacatacatgggttatttaagttataacaaaagttaaactggtcaagttggagctcatatggccaagatacggccatccaaaatttaactgtagtttaaattaagatttccgaattgtttaattattattgttcccataaattatgtgtaacacaacatcgctcgaggagagaaagaattgagtgactgacaaccaggacccacgggtcagacggctagttcatcgtggatcaggttcaccgagacgatccacgggaaaagtgcacctacgtgtaagcctcagagaaaagactgaagactggatcccacatgacaccaaacaagcagtcacgtgcgtgaaaacgcagctacatgtggatggagacgataaccagcgactgcggcacatgaccggtagtcacctaaggcaaggaaaataggagggaaagagcggaaaccagattctcgccacaaacatgtcgacaaccgaaatagcgaggagggaattgttggcgaggaagacaatggcgagcttgagcagccacgacagcaactggtcaacgacgaggggacaacggagggattggcgctgcggacttgagggagatggtggtgagggtgacgacgggaagcacttggacgaggaggggacagtggctagaggaagatagtggtgatgtcattcgggtcgatggcgcgggtgcgttccgatggtcttcacttgacaagaacgcacggttgaggaagaggatgacaagggaatcgaaggctgacatcgaagggagacaagttaatgcagcggggcggtgctctggcaaggcgggagggactgccaaaggaggaagaagacggcgttcttctctgatcactagcaaggaggaacttccggcgatctccaggcaaaatggtggggttgctgggttataggaggttaatccgcggccaggggtggcagcgctgtggtcttccgtacgtggcttgggtcggtctactggaaagggcgccggagctcgccggcgcagtcgagatgccaggagagcaagagagctcgaggtggctgcgaaaatggatggaagggaggaagacgacgccattttataggctgggagaggaaggaggggaatggtcgtgggaggagccataggccattaacggcggctatgaattgggaggtttcaaatccgcgatataaagccaaattaatagtggggaaaatatggcagaattggacagatgcaagtagggaaatgatttttgaaatcaatttggaggagagacgtctggcaaggcagatcaacctcggtggtggtgctagtgctagctaggagagggaaactgaactagcagattggaggcggaagacgatgatgcaacgacttcctgggctagctgggccgtgcccacctaggccgagcaagggaggcccaggagaaggaggggactttgctcatgagccgagggaggaggacaggaagcagatggatagaattggcccaaagagaggacatgcttgtttttaggttttttattttcataaactctgaaatttttttgttgcattaaaatagtttaggatgctctgaaaaaatcaaggaaaaactgaggtgacattttagagcatggaggatttaagaaaggtactctaagccacattcaaacttttcttgaacatgttttagtgtatgatatttcttttaagcttttaattatttctattattcattttagaatgtgactctttaatttgggatgaatttatcaacacatcacaaaaatgaaacatgaaacaattatatgatgctaaaatagttcagagtccaaccatggattatatcccatacatattgcgggccacatcttgtgctacatagatatatgtgctagtcatataatgggtacccattaacaaacattcgctaaattgaatatatatgcacttcgtgtcatatttttttcttaattgtactgacagagtaacttaggctcatcgccattggcagtataatgtagagaattgtttaattagttacaagagagataataaataatctatatacattaaatagacgatgatatctccaaaagtaactgtacggtttagagtttcaccttcagctgtcaaattttagttcttgtttcatacgtgaagagtcccattttggtccaagtaactagatgcaccacataaccaattgataatctccatgaaaatgtgtagaggacaagagttctgacttctgcaattctcaatcaactgacagttagttatttcagtcatgcatgctactctgtttggtatacatgcttttgcttaatattttatagtgcaagtctagagatatatgttcatcacacttagacttgtttggagcagggtagnnagtattgctttggattccaagatgctggaaaacagggacacaaggataagatccttttgggaggtttgcatatatcactgtccaaaagaaaattcctttttcatatttttttttgtgctagagccattgttctgttttttttcagacatgatcatctcaaataaggtggtcgtctatgacatggaaaagcaagccattagctggacagagcacaactgtaagtttcaactcgttcaaattttatcaataaagtgtggtagcgagggcctcagcccactaggaaggatgcatggaggcttgtagatggaggcaacgaataaagacattggcaaggagtaaggagtatgcattggatgctgaactagctatacccctgcatcttggttgtgctagccatggcaatgatagtgttacggctacaatttaggaggtgaacgaggttgtgaaggttgtacaattgccaaactagtggccaaggccctaccaccctaggaagctgaggcaccaggccagagtgagaagggaatggaaagagaaaaacctttgtttatccctnngagatcctccacaatccattcctttttaggggtggagttactcttaatagtaaaaaaataccaattagggacaccaaattaaaatgaacttaagcttgatcctggatgtgacggctatgccgttggtggctggtgcatcttggatcgcagcttgcaatggtggcaagtaattctaacaatggaagcacttcagcacactgcgatgtcagctaacagataaaggtggtaggccaccttgttgatgaaatgcccgagacttcataagggctgaagtaacatggacgttgttaatggactatacccgcctacgatat

SEQ ID NO: 69238 - DNA, 1968 bp, Oryza sativa
ttcctcttcatgcatagccagggggggaggttgttgatacacatcgtaacgggccaagtgctatggccgttgctcatctctccaaaggattcatgccatccgtactcaaaccaaaccgtatgtttcgtgcgtcctttccaaattctttaaattttctgtcgatgtttcgccactgcgaaacatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcatagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaagttatgggcctccttttcactttcgcagtcctccctggcgtcctgcaacatttgaccaagatcattcgcaacgtcgttaccattagcagctatttcctcctcgcccgtttgatttccttcaaatccaacatactgagcaaagtccggaatattgtcgtcttccacttcatcttcttccatttcaacacattgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagtgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgcagcttgctcgggcagctggaggaggaagaagacatatatataggggtgggactttagtcctggttggtagcaccaaccggggctaaagatcccggtgatctttagccccggttggtgctaccaaccaggactaaagtcccacccctatatatatgtcttcttcctcctccagctgcccgagcaagctgcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacacttttt

SEQ ID NO: 69239 - DNA, 5881 bp, Oryza sativa
aaagattgtttgtccaccagtgctactatcgcaactgatacgctcgcgtcagcaactggaacgcgtgcgtcagttagacttagacttagacctgaaggcaacgagtagcttccctttcatgccgcggtgaatccggaagccgatcaaccggtcaccccggccgacccaactctatcacgcccaccctcgcctgggtacgtcggctagaggaaagctacactacaagcctagccgttgcccatgctggcttgtggtaagtacgataagttcttccagggcatcccgcgaaccggtccttaatcgccatgggcacaactagcaaaaccatgcacccacaacccaccatgtagtgtattttaattaactaacaccattgcggtggcactaatccaaagctatgccaataatcaaagtctagacattaatgtgatccccctttgtgtactagttaaactaagcatggctaagcattccctaaaccaacatctaagcatttcaatacccaagttaccaatggcgtaagataaacaatatatggctgagtagtaggacccatcccccatgatattgtaaaccaatgcaacatttaatagaaatgcgggacatttgtaaattgggtacaatatgatcaattgtaatgcatgacttgccttgctctcgcactgatggaaccacagcaacgtcttcgaggaaccatggatcgacgaaacggccgaaatctacgcgacaaacaaagcacacgagcaaaacatgctataagtctactaaaataggaaacaaaactatttttaatggattctatacatttttatgaatttactaagacttgaatggacttaaacggagctcggatgaattagatatgatttttagaagataaactgtgtttattactataacaaaaagtacttaaatcatttattgcgcaatatgtcccagggctgacgtcagcgaggggggctccgacatgcgggccccactggtcagcggcactaagagagggagagggggcggctggcaggcggggcctaccgggcggcggctgaaaaaaagggagggcctgccgggctaagccgggcagccggttaggcgatgcggcagcggcgagcggccatcgacagcggcgatcggcggtgcgagagacggcggtggccggcgaggagacggtggcacacggctgaagcggcggcgcggacaggaggcggcgacgcgcccaaaggcggcggcgcacacggggaagggggagtaaaagagggggagggagtccttaccagggattcagtcggcgtggctgaagacaacggcggacggcgacgacaagcggcggacggcggggcgcgcgggatggacgagacgggcctcgatctcgcgaggccaatggcggcaaaggagcggcgcggcgacggcactagcgatggctagcggcggttggaggcggcgttaggcggcggcgcgtggggaaaacggtgcggtggcggcgcgcggcaagcgagcggtggccgggatagctcccgcgacggcgaagctagcggaggtgacggcttggcgcggcggcggcggctctagcagtggcggtgcgcggccgaggttcaacggtgaccggcggagctcggttcggagtggggagagcggcggaggacactagagagcgcggcgagcacggaaaaagagagagggaggctcggggtggcgttttataggcacgagagaggcagatgagggcgggaaggtggccgatttggccggcgacgtgagagatggagagagagagtggggagaggattcgaaattcgaatccaccccttttgggcgcgcgcgcatgggcgggagtggggtggcagagggcggcaacgtgggcacgggcgcgaagtggggcgcgaggtggagcggagaaggggggcggcgtggggaggtggggcgccagcgagctccaaccggctggaggtaagggaagggctgacaggtgggtcccaccagtcagcacccgagagggagagggaggccgggtgaacttcgggagtgggagggaggagcgggccgacgcgggaaggaatgggccgacggcccaataaaaggaaaaaggaggaaaaaaagaaaaaagaaaagggaaaaaggattttcccagggatttaatattgcactttgcttattttaattggttaaaattatttccaagctcagaaaattccactaaaaatcctgttagcatattttgacatgtagaatccaagaaaaattccacatgccgatttcgattattatttgcatttattaattagggattcatctctaggttaaattaaataatttctttggacgatttattttatggattttaaagcagggaggggaacttcagggcgtgacagtgaagcacgtcttttgatgtacgcaattgtctatcgacaacagctggcgtcgaccgtggggatgaagcatctaggcccccggtgttaattttggtaattaatgacaagtgctaattgtggactaaccgttgtctttgagataatattttaagttaggtccacatcatgtgtgcacatggatgacgatcggtggattaaaattgacggcgcaaggcaaagagaaagaagacggtaaaactagtgctttaatttagaattgatcgaggtgtagggcgatcaaatttgctagtttatttctagtttcgccgtactattaagaggggtaatgacctagcaaagagatgattttaattgccacattaggtcattgcattatcacttgtgctcactttttcatcacacacacacattcactggattcggcctgaccaggggcggtcagaccggccacatagtggcggtctgaccggaatgtcctggccggtctgaccggccccaagttggcggtccgaccgtcccataaagtcggtctgaccggcggcacatgcccggtcagaccggctccctggagaccgaaatggtgctcctcgggatggccgatacagagccgacggagccgtagtcggtcagaccgagccgatggcggtctgaccgagcctactccggtctgaccgcctaatcaactccggtctgaccgtctaggccgatgaggccctctgacaacgctacaacggctagttttctagccgttgcagagtagcacggtctgaccggccacatacctccggtcagaccggcagagcacaaagttggggggatttcgcccctaacggctagttttggtgggtgggagtataaatactcccccaccagcagcaaggggactctcttggcacccaattcaattgcatacaccccttgcacctctctcacactcatttgagatttgtgttcatccatatagtgttagagggttgattagccaagagtcaagtgcatttgcttccattgtagagctagtgtggcacttgatcatctccacgtcgggtcattgcttgttactcttggaggttgtcgcctcctaaacggcttgtggagaagttgcccggtgacctctccgagaagattgtggaggaggcccggtgccggtttgtgagtggtttggagttcaccaccttcggagtgaaggaagaactaccctagtgatcgaggcttgggtagtcctctccgtgggccggctcccgccttgcccaccccttgacgaagggggcgtgcggaagcttcgtggttgagcggtggagttgggctcgcctcaacggggagtaggaaaccggcgagtttccgaacctcggtgaaaaatctcttgtctccttgtctcatttgattgtcgcatttacttttgtgcaatttacttttctagagacaaacttgagatcatatcaccctaggattgctaaacattgacataggagtgtgatttacttttctagagatatatttgagccactatcaccctaggtttgcaaaacataacttagttgcttagttagagttgaccctcaccaagcctagcaacttaggttagttttgattaggtgtcatttagttttaaatcgcccattcaccccctctctagtcgacatctcgatcttacaagtggtatcagagcttggtctctcttgattgggcttcaccgcctagagagaagatgtcgaacgaggtgaaccacgtagggaaggctcccatgtttaatggcacaaactattccacttggaaaattaaaatgtctactcacctcaaagctatgagcttccatatttggagtattgtggatgtaggctttgcaatcaccggcacgcccttgacggagattgatcaccgcaacctccaactcaatgcccaagccatgaatgctttgttcaactctttgagccaagaagagtttgatagagtgagcaaccttgagaccgcatatgagatttggaacaagttggcgaagatccatgagggcacaagtgagtacaaggatgccaagcttcacttcctcaagatccaatatgagacattctccatgttgcctcatgagagtgtgaatgacatgtatgggaggctcaatgtcattgtgaatgatctcaaggggcttggggcaaactacaccgatcttgaggttgccaaaaagatgcttagggctctaccggagaagtatgagacccttgtcaccatgctcatcaactctgacatgtcaaggatgacaccggcaagcctcttggggaagatcaacaccaatgacatgtataagttgaagaagaaggaaatggaggaagcctcaccttccaagaagtgcattgctctccaagctgaagttgaagacaagggcaaggtgaatgacgtcaataagaacttggaagaagagattgcacttcttgctagaaggttcaatgatttcttgggaaggagaaaggagagaggaaagggctccaactcaaataggagaagaaataaaagacccaataagactctctccaacttgaggtgctttgagtgtggtgagaagggacactttgcttccaagtgcccttccaaggatgatgatggagacaagtcatcaaaaaaaaagagtggaggctacaagcttatgaagaagctcaagaaggaaggcaagaagattgaggccttcatcggggaatgggactcaaatgaggagagctccgcctcttccgggtccaaggaagaagatggtgatgatgcaagctccaagaagaagaagatggccgttgttgccatcaaggaggccccatcactcttcgctccactttgtctcatggcaaagggctcctctaaggtaacatctcttagtgatagtgagagtgatgatgattgtgatgatatttcctatgatgagcttgtgagtatgtttgaggagctccatgcttatagtgagaaggagattgtcaagttcaaggccctaaagaaggatcatgcttctttggaggttttgtatgaggagctaaagacttctcatgagagactcaccatttctcatgagaagcttaaggaagctcatgacaacctcctttccactactcaacatggagctctcattgatgttggcatatcttgtgatttgcttgatgatagtgctacttgacatattgctcatgttgcatcatctagcatttctacctcttgtgatgatcttgtggatatatctagctctagctctagctcttgtgtatctatttgtgatgcctcacttgttgttgagaacaatgagcttaagtagcaagtggctaagctcaacaagagcttggagaggtgcttcaagggtaagaacactcttgacaagattttgagggagcaacggtgcatccttaacaatgagggacttggattcattccaaagaagggtaagaaaccttctcaccgtgccactcgttttgtcaagagcaatggtaagtattgctccaagtgtcgtgaggttgggcatttggtgaatgattgccccggtggta

SEQ ID NO: 69240 - DNA, 2517 bp, Oryza sativa
  unsure (1)..(2517): unsure at all n locations
aattgggttaggtaaaattgctatctccaatgatttgtcaattgataatgtctcttttgttaaatctctaaatttcaatttgctttcggttgctcaaatttgtgatcttggcttgtcatgtgctttcttcccgcaagaagttattgtttctagccttcttgacaagtcttgtgtgttcaaaggttttagatatggaaatctttactttgttgatttcaattctagtgaagcaaatttgaaaacttgtttagttgcaaaaacttctttgggttggctttggcatagaaggctagcccatgttggcatgaatcaattgagcaaactttcaaaacgtgatctagttgtgggcttgaaagatgtgaagtttgagaaagataagctttgtagtgcttgtcaagccggcaagcaagttgcatgttctcatcctactaagagtatcatgtccacatctagaccattagagctcttgcatatggatttgtttggcccaacaacctataagagcattggtggtaatagtcattgtcttgtgattgttgatgattattctcgctatacttgggtgttctttttgcatgataagtctattgttgccgagcttttcaaaaaaattgcaaaaagggcccaaaatgaatttagttgcactcttgtgaaaattagaagtgacaatggttccgagtttaagaataccaatatcgaggactattgtgatgatcttggtattaaacatgaactttccgctacctactcacctcaacaaaatggtgtagtggagaggaaaaatcgtacattgattgagatggcaaggactatgcttgatgaatatggtgtttccgattccttttgggcggaagccataaacaccgcttgccatgcaaccaataggttttatttgcatcgtctcttgaaaaatacttcctatgagctaattgttgggaggaagcctaatgttgcctattttcgagtttttggttgcaagtgttatatttaccgaaagggtgttagactaaccaaatttgaaagtcggtgtgatgaagggtttcttcttggttatgcctcaaatagcaaggcataccgggtctacaacaagaacaaaggtactgtggaagaaaccgccgatgttcaatttgatgagactaatggctcccaagaggggcacgagaatttggatgatgtaggtgatgaaggcttgataagagctatgaagaacatgtcatttggagatgtcaagcctattgaagtggaagacaagccatccacctccactcaagatgagccatctactttcgctacgccaagtcaagctcaagttgaagtggaggaggagaaggcacaagatccacctataccaccaaggatacacaccactctttccaaggatcacccaattgaccaagtgttgggtgacattagtaagggtgttcaaactctatctcgtgtcgcttcgatttgtgaacattactcgtttgtttcttgtcttgagccaaaacatgtgatgaagctctttgtgatccggattggatgaatgctatgcatgaagagctcaacaactttgcaagaaacaaggtgtggactttggttgaaagacctagagaccacaatgtcatagggacaaagtgggtctttagaaacaaacaagatgagaacgggttggtggtgagaaacaaggcaagttggtggcacaaggtttcacacaagttgaaggtttggattttggtgaaacttttgcccccgtggcaagacttgaggctatttgcatccttcttgcatttgcatcatggtttgatataaaactatttcaaatggatgtgaaaagtgcttttctaaatggtgaaattgccgaacttgtctttgttgaacaacctcccggttttgaagatcctaaatatcctaaccatgtttacaaactttcaaaagctctttatggtttaaaacaagctcctagggcttagtatgaaaggttgagagattttcttttatcaaaggatttcaaaattggaaaagttgacaccactcttttcacaaaaatcattggtgatgatttctttgtatgccaaatttatgttgatgacatcatattcggttctactaatgaggtattttgcaaggaatttggtgatatgatgtctagggaatttgagatgtccatgattggagagttgagctttttccttggacttcaaatcaagcaactcaaggatgggacgttcgtgagtcaaaccaagtacatcaaagatctactcaagaggtttggcttggaggatgcgaagcccatcaagacacctatggcaaccaacgggcatctcgaccttgatgagggaggtaaaccggtagatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69241 - DNA, 5562 bp, Oryza sativa
ttcatgtacacctataattttatatatttcataaatttttttgaataagacgaatggtcaaacatgtgctaaaaagtcaacagtgtcaaacattttgaaacggagggagtacatcacgtaattcgctttcttaaaggtgtgttagtgttccgtatatggcaatacacaatttgttcctgttgctcataagtacaccctccgtttcacaatgtaagtcattctagcattttccatattcatattgatattaatgaacctagatagatatatgtctagatttattaacatcaatataaatgtgggaaatgctagaatgacttatattgtgaaacggaggaagtaaggtataaactacccagacaagtgatgctagagctttgccttttgctttgttcaaaagtgatacgcattagaagctttgttaaaaggagcgaaactcaaactagggacaatatattcataccagttgcatcgatcactggtgctaagctccatctatcttctgcctgatatcctcagacacgcactttgcttattgcctcaatttcactatcatttcttaattggtctctctccctttctctcccagctccaaatgagaagtgattcttctgtcccttctctctaactagtaaaatttcaatctttttttctgtttggagaaccgatctaaatttttcgaagaaaccaacactgaatgcatgtctttttgtagggtgtgatgctgattggtgagatctgggttccacttgccctgatttgctggtcttgagggcaattcattatgctccgagaggtatttattggcaaaaatattgttttcaatatgatttatgcacaagatgatttatcgattcatgtatgacggggctcacctggacgcgatgccacctgacgcagcacgtcctgctgttctctcttctatgtgtgttgctatttttgtccaacactgataagtttttaagtagtattaccttcattttttaatatataatacaaataactttttttaatatgtttgactattcgtctttataatcattatttattttttatgatgttttatgattaaggttattcaagcatgacttatatttttaaaatgttggcacaaagtttttggataagataaatatctaaaagttaacgacatcatatattaaaaaacgaaaggagtacgtggctaaggttctcatcgtttgagctttggctctaccgtaaagcacacaaaactcaacatttaagcatatactaaatatatgtacaatttattttaagatttatttcctcaaaacttacaaattttccacgcgcaagttggtaatcgaactcaagacttgctgcttgcaagtcaacggcactagccacttgggatgctgtgttttttgaaaaaggaaatgatcaagttacatataatttttttttaaactaaaccggcagggaactgcaaattatatttcaattaagcagaagtaaaaaactagacgggttacagaaaaagaaaaaataacctctcggcaagtagactcgccaagcccctcaaccacgaccggtacaaacaacacaacacactgagcaccacacaactctaaccaaactacgacggcagaatccaaaggcgaacatcgatgtcgaaaagctgaagaagcggcatacaactttgacatcacaaggcacgtgtcatcgttgccaacctttgccgcccagcgacccagagctccgactccacggcgatcataacatcattggaggcaccgccaaaacgagcaaaacaacagcaagctcatactttagacatcagccaaagcccctgaggcgccaaaacctgcactggcaacaccaacatccctagagagaaactgcaaatgttatcgttgccaagcaacgtcgcaccccaacgacgttacagcttcgactccacctgacagagacaaatgaagaagctggatgccaccaatacaagaatggagccaggaaggagaaggcctcgccaaaacctaggcatctagtgcttcgagctgacacaggagttcgctaacagtaatcgaagcaagggtaaggttctccaagacgatgccccaatgaaggatacgacatgaaacgccgccaccgtccgtccggaaaccggaacatagttttcacctggagattgatagcgatgaagaaaaatgccataactacgcctccaagaaaggaaacggcgccaaagggcgtcgccgtcgtcatgccagccaagtgctaagcaaggctttcgccagcgatttccatccattgccaccaccacctcacacaacaaccgtcgctgaaccaccacatcatcttctcagccaccagctagcccagtccaccaccccacagctcctccccgcgcacaccaccaggccggccggagagaggcacgagcatgctgccaagcgggcgacagtcctcccctcgccggcacgcggccctcgtgccgctgccgccgccgctggcggccttcagccgtagctttccgtgcccatgatagagccgtcgccctgcgccgtgcagctagatccggccgcgggagcaccggatctagccaccgcggtgccggatccccggcctccctcgccatcgagcgcgccgccctccgctcggctcaccgcgctccgcgcttcgccccgcctccctcgtgccagtgacgacgcgtcgccgcggtatggccccgcccgccatcctggctccccgcatggttgttcggcggtgaactccggtggcggcgaggcagagagaagggaggagggtgggtggcggcggcggctagggtttgcccccgagccgctggcgcgtgggcgactcgtgggctcgaggtcccgccttcgatcaaaactttcttacatataaattactctatccttttcacaatgtaagtcattctagcatttcccacattcatattgatgttaatgaatctagacatatatatctatctagattcattaacatcaatataaatgtggagaatgctacaatgacttacattgtgaaacggagtaagtacatcttagttacgtgagatttgcgctattcaaacaaaaagtacctcgaggtactggtatctcacggtatcaaatcgtttccgatcgttggatctcactggacaggatgggcattgttggatccaacgatcggaaacgatttgatacagtgaggtactgatacctcaagatactttttgttagatcagagtaaacctctagttacatactagttagattgtaattacatttaagtttttctcctagaaaaatgtcaaatgttctataggtactcccaaaataaatatgcacatgccaaatcatctttttcacgatatttcaatccaaatcattttattatttctacgctatctaatatatatcccgtaacaaagcgcggggcgttaaatttaccagcacaaaattaaaattggcatttggataattgataaatagaatagtagcaaatacttaaatttccatgaaccatcgccttcctccctcttcattttctttcttgctatttctcccatccccatggctgatgggcagtatggccgttggccgcccatcctcgtctcccatttgctgatcaactcttcctctcccgcctccatcggcttcctgaccttgccgccagcccgccacagttgccatccagttgctgatggccccaagtagcagccattcgcatgcgcttgacaccaaactagatctgggcgatgatgcttaggatggggaggcggcgccagccatggacgaggtgggggacggtggctgcggcaacaagtctccacatcaccagcctcgcctacatcagcatacctagtttggtgacagctcaaagtggagtatagcaaataaggatttccccccctctaaatatatagtttcatttttttttctctgaatatagtgttcatttgatttttcttcttctagacagtcgtgttactttgtacgcaacccagctgagctgagctaacctcagttaattactgttaaccactgcaggtaattaccgcagagaatgttgctgaggctgttgatagtataattgacaaactaaagaaatcagatgtatcaaatgtggtctactttgatggttgggaaggattgggtgcatctgctgtcctcagagctgttgccaaacggcttacaacggtccagatcgcagacccagaattgaagtttgaaaagataatccacattgattgctcgaggtggaaaagcagaagggaaatgcagaggaaaattgcagagaaactagagatgacccaagcaaaagatcttattgatgagcaggatgaggctgatgatatcaatggaaaagatgaaagctccagagacgtgatcaatgatgttggaatagctgttaatgatgtcctaatgagtagaagatttcttgtggtttttcataatgggagtgataatgaaataaaagatgtaactaattttggtctgcctctatatcaaccgtataagggaaacaaaatattgtggaccttcaggggcaggtttcggctgagtaccagaattcaggacaaggtgcaagtggcagatgtttttcttgctgccgaattccataacaaaatatatgggatggagttccaggatcaaagccattggtgggatatattgtgtgaggaggcggcagaaattgcttccaacacatgttccggagtagccaagctgcacccaacaacaattgccaaatgttggttgtatatatcgaaacttaattttgttggcagagacatcattgactatgactgggcagttcatgcttcaaactattgggtgtgtgatgggatcattcaggaatgggagattgctgatgctctacaacaagagatgtggcaagaatgggacgaccctggactttaccacatgatgcggaacactgacaactggatttcaacaaatcacctgatttcaagtaattatgggttcctggctgcctcagcagtggctcaaacagtgtcatcatttttcttggcagcacaccaaattgacacagaatcaaaagacacggtggaactagtagaatatttttttaagtcaaagctcaaccttgcacatcttttacaaaattataatgacatgtttcaacatgcagagaaccttagagtgctaaaacttagcctctgtacttttagatttgcttcacctcctttcctctgttgccgcggattgagattccttgggcttgataactgccttgatctgaacattgatgctggagaggaggttcagtcttggaactgttttcatggtttgtgggtgctagacctacagtacacacagtgggttttctccccacagatgattgaggaaatgaacaatgtcagggagctcaatgttgagggagtgaaaccgcacaacttgagacatatttggaaacggcagcataacaagatacagaagcttcgtgtaatcaagatgattgatcaagactatacggcaaccaaagatgaaaaggatccattcacattcatattctcaggtatggaaaagatggagattctagacttgtcaggtaactctaccatgcaagctt

SEQ ID NO: 69242 - DNA, 815 bp, Oryza sativa
actatgttggcgagtggcctcacaagtccatgtaggaggcatgctgtcatggaggagaggggaggtggaagcagtggctcgcagtagtgtcagggtacactcactgaggcacattcctttggagaataaaacgatgctaaacaccacagaggaaacggcacggggagagctcagtgggggcaagcatctccaggtgtttatctcattgttggatcagtaccacagccaccctgctgctcacgttgacaccatatctgcaccattgttgggccagttgttggatctgcattgatataaggcttatcggccgatctctttgccagatctgtgccacagccgtcaagcgtgacacaccactgccaagcttatcgcctgatctgtgccatcaacatcgtccttcagccgagcagccctcggcaccacagagctcatcagcccgatgcacaaactccatggagtgctgctcacgatccgtcatccatgttaccacaagaccttcaatcatgggaggggacggttagtgtggggaggtggtggtgattggtgaagagtgatgactcaaagctttgaagtaaacgaggatggcagcattcacagtgaatcgaagtagttggaggcaatggcagtggtgatttgggagtagaggaggacaacgacggtcctgacgtgagagtagatgggtatgcagggttatgggtaggctatgatagtttaaaagaaaatttcttaccatataaaccaggaaccacgagatgccgagcagcggaacaagatttggagcacagcaaaccggttcaacaaactgtcggacaaca

SEQ ID NO: 69243 - DNA, 20186 bp, Oryza sativa
atatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccttgggatcaaggatttcttcgttgatgaatcccatgagttgttcttgaaccactgcgataaattccttgtgtgtggtcaggttatccctcatgcgaataaactatatgaatgtatgaaattgattagtaattaaacaagaaatcgttacgtaataaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacctccgcctaagtctttctctccagttgccgcggaccaaatgacgtaaccgataccaagccctacatggagtttaaagatatgattcgtagtataaataattaacataacaagaatttcttaattaacagagaaacttatgccagtacctgtctataagttcgaaaaccttgtcaaacgtagactcttttttatccattgagtcatatacattgacggtgcaggccgacaggtcgaagaataaaagcacccagtggaatctgcaatgtgcgtgggatgcattacatatgaaacacttagcaagttcgtacgggaatgaaatttggtatgtaggaagacagtaaaattaaactaactctgtgttgtacggtaacagtatgaacgtcttgtaatgctgcgccttcaggagatggacgagattgtcctctgtttcctgtttcctgcggatattggtcgagcattgcaacgtttactctccgagggtcgatgaatccagtatcgaaaaccctccgccatcgggccctttgaatctccattctacaacgataaaagggagtattttattttatatagtctacttatatacaaggacctaattaattaaaggagacgtagtaattaagaattataattgaacaatatacttacaaagtccagcaactcataatagagacgtcgagggcgtccagctggtatacttcgtagattcccttgaaattgatccagagaatatcatctccttgcaagaagtccaagtccctgatcctcgctccgatcatctctctaccggtggcgctcatctccacgtacagctgatggaacctgtacatttgtgtgggtagggactgcaccagcttgggcttgacaagcgatttaccgagttcgtacatgtatttcaattccgccttttctattggttcaactcctagcaattgatccgtagttagaccggtgtcaataataaattcttctatcgtcatgtctttcccggtcaccaacggctcgatctcctggtttggttgctctccaagctgagggactggtttagactttccagaagatgctttcttcagcgttcgctcatagtccgatagcttgatggcctccttgacaggtgcagacatacccctgaagaagttcatgacactggggtctataggaatcttcttttctggacttcgaggcttgaattgtctcttgacttctgatgcaacgtgtcacaccctgaaaattcaaaatatataaattgttgtttaaatggaatttttagaatttattttaaaagtcttgaagagaagatctaattttaattaataaattccaatataaaatgggcccagataaaatttcattaaatactttgcttaattctataattcctagatttttctgggatttatttgagctaaggaagtatttttaacaaatggaattgcatttaagaaataatttaaattgaaaaaggttttaaaaagtctcttttggctttgggcccaaaacctttctctctctcctcggcccagtccggcccagtccgccgccgcgcgcgcgcgtccgcccgctgacaggtggggcccacctgtcggacctatcgtccaccttcggccaccgccgcccgaaactctagcgccgcgccgccgccgtctccttccaaatccggccgctcctttccgtttccggccgaattgatagaggggaaatgatcttctcgatctcctctacctcttctcctttggaaacatcggctaaatcggtttggaaatcgatggattcgagttggattcggattcgtttttcccgaagtttccttctcgtcgccggccgccgtgggccttcgccgtcgcctccgagtccctttaaaaggaccccccggtgtctcctctactcgtcgccaccctcgccttcgcctctcgtcgccggaaacgccctagcgccgtgagacctcgagccgccgtcgccgccgtcgctccagccgtgcgccgccgtcgttcccgtcgtcgtcatcgctcgggaaggccaccgtcttggtcgccgtagcgtcgccgtcttcgtccgccccttcgccgccgccggagaccgccggagcaccgtcgccgtcgtcaagccgaagagcgccgccgcttcttcttcgtcgccgtcgccgtccgttgatcttccgccgtcgctttggtcgccagtgagtccgccgtgccgtccgctactcgttggtgccctccgttcgtgccgaagcgccgccgttcgccggcgggcttgtgcgtccgagccgccgaaccgccaccgccggtggtgacgtcatcgctgacgtcatcggggccgttcgctgtgagccggtcgtggaccgatcgatctcggccgtccgttttggatcgattgatctcggccgtccgttcgtgtgaaccgccgccgtgcgcccggtccaccgaaaccctagcccgctgacgtaataatcctccttttccttttcaaaaataattcattattgcgtcataattcaattaaaatcaatttaagtgttttaatccgatttaatcttcaaaaattcataactaattcatcttagctccgttttagttggttcaagtctctaaatttttctaaaattgagatctacatgttaaaaatatccacatgtactgttcaagcttgtttatgtgctgttttggtgattttgcttctttttgtttagattccgtcgtttccggagagtccgttttcgcaggagaagagtttgaagagttccaaggccagcaaggcaagtcacacagatcccaaacaaccctttgagcatgttgatcctatttaaagctattgtttctattcaaatattgcatttgttttcgaatgtcattgggtggaattaacctattgtttgttatagcccttttgttcttgattaccttattccttgataccttgggttattataatttgactagttgagctttatttatattggttcaactagatattagatataattgcttagccctgcttagaaacattagctcacttctgggataaattatgactcactattgcttaatgatggcttaatgatagttcacgatggtcaatcgtgattggttaattaattaatgtgccaactaaaacctggtaatggtgggttgtgagcacatggttttgatggtcgtgctcatgacaattaaggaccagttcacgagtttcggttgtgaaacattaaccgtgccaaccacaagccagcatgggcaacggctttatcttttgtatagcatgtttcattgcggggcaccagactgagaagtggcggagataagcccaccggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgaggggttgtgtcttgtgggtacagtggtacacctctgatcagagtaaaactattcgaatagccgtgcccgcggttatgggcggtcaaacaatgtctttcgtgattagtctcacacttctcaccataatagaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattacttaactgttttattaaattctcaaatgtttgctaaatgttgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttatttttccgctgcttagatctttattgattgagatgaactatctacctctgtaatgacattttattcgtttattaattagagtaataattgtactctattatcaatttgttattgtgtacctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatctattactatattaatggctcattttccagcaaaagttttacaatgttgttttatttaatcttgctgcaacaaaataaatttagcaagttgattttataattttcttttatttcttttgaaacctgatgttcaaaagtacaaaatttgtaaccttgtttccaactgtttcaacttatcttgcaaagcttggtttactttatttacttacctttttactttgattttctaaactttattcaaatcaatccaaaaacttgtgctattaattggataaatgtcttaactccctcctttcacttgtctttagatgccgcgctacaagcctgagtacttgtttgatgttgagggttttgtccaggagtcgcgtacgatgtcctttgtcattggatttgggactgcccctttttatgcccagattcctcatgatcgtcatgaagagaagtgccaagtcaaagtcaccttgaacagtaatagtgaagatatcccctcagtgatgttcgaagctagaggaagaaactacatccatgcatgtcaggaggtggcaaggatcgccataggagagctccgtgatcgctacagtgatcagttggccgacactgagtatcgttaccatcctcgccaaccccagggaagtgaccgtggcagctaccttgagactgaaggaattgagaatgatgctactacaagacatttggttgagatgctgtgggctatggatgaaagtcgtgcggagactgtgttagcagctcaagatcgtgaagaccggaatcgtggtaagatttgcaagctagaagacaaggtggatcgtttggagaaggaactagccgcgttgaagggagaagcaccgccgcagaaggccaggattcgtctcaccgcaaggaagagagctctatttgtccctcgctatcaattggcgccaaaggtccgtgtggtggagaaagaagttgccccaaccctagcagattccccggtcaccatcataagtgatgatgaagaagaaggatccaagcgcaaccattccaagattgagtgggtagctacccaagatgatgaagacgagccgaacgagccttcaatcgacctccgatgctcggaagaactagagtgacttgttaagtcgttgtcttcgatcgttgtgttagcttgcttgttttaagtttggttgtgtgtgtctcgcatgtgatttacatcagtggtgggatgtaagtgcatgtgtttgttttcttttgagtgttaggaaggggggcagccgcctccgccggatctgggtggggcacggtcatccgccgctgagagcccgctgttccctgttgcccgccaccgcgagcccgcctctcctagtccactgccgctacgcgcctgtgccgtcgagcccgccgctcttggtcgcccgccgctgcatgcacgctgccgagccgcgtggtgccgccggctacgcccgcaccgtccacgcccgggagtgagaggtaagagagttagagaggatagagagatgagagagtgagagagagcgtagaaaggataaggatgaggatgggtggatgagatgaaattttgaagtgttgaggagggaaaagaggaggaaggatagacttgtaggcaggtttttaagaggcccgcatgtgaaaatcgattttcgcgtgcgggcattttaagaggcccataggcgaaaataggcttatttttttgtgcgcacccttacgaggccccttgcgaaaatcaattttctcgtgcgggcctcttaagggtccgcacacgaaaatgggaggccaatttttgcgtgcggacgtgaaaacggcctgtctgtaaactaagtagctcctcgtccaggaaaatcgtttctctaatactccctcaattccaaattgatctacatatagtttttaatgatctacatatttgtgttaatttattaggtctattcgttatttgtgcattggagtaaatgaacattgatgcatgcatccatgcacacaagtatttatagcacacatgtaatatcttgatttgctattggctaggaaatagtggggatggtgcatgtatcgagtttgttgctagagtaaatatagtattagagagttattagtttttcttgattttggtgtacctatgaaatatgttgatcaatttggaatggaggaagtagtgggcagtactgccgcagccaaactttgtttttggtgactggattatattcggtaaactattttcataccttaagtaacatccccttgtttttcatatcactaaaatagctatcaaataatttgaaaaaattaatatgatagatcaatatgaaatacaaatttaataaacaaaaataagtataactgagttctaaatgatattttggtcattttgtaaaaactacagacataatttcacgtttacctgatgtgatggcaaaaaagaaagagtattattgcacgtaagatggcatgttgttgaactattgtctatcaacggtattttacaatcgtacacttcagttctaattcaaaaaatttcacatacaaaaatttcttcaatggacacaactcacccgaatgtgaggctggtgttagttgattgagtcagcccattcccagagagttgattatagtgcacaagatcagtgacaaaggcgcctattgttgatccaccatcagcataggtcgcgatgaatggacaaagtaagcttgtgttgcattctggctgcacatccctatcgggcgaagtgcagaacatatcatcacatttcaccactttttaacttactgagctcctagggtcatataatgtcagctttttctgcacacaagaagatgtacgacaaaccatattatcattcagaatttcacatctataatgtacaaaaccctaaatggcaaaaagaatttttgcaaggtactgaaaaataaactctaaacctaccaatatatcgctcttgcgagggcattgcttgcaggggatgcagttaacccaaaatgcactgctgccagtgtccacctgcacatagtattccattgcgggtgtcccaatccctatctccgtgtagtatagtctgtgtcaaactctatcagatcgtaataagccaacctaccaagaagaaatggatagaaccaaaggaacattgaagcatataccctgtgctggatgtgctgatgccaccaaggccaccaagtgagaagtccgcagccacaaggcgactaagatggcggttcctatcgtgggtttgtaatgcacctatgtcactccccttacacccaccgcccatgatagagaatttgcggcgcacctggaataacccaatggccacggtaccacgagtagaggatgctaccaatagggccgaaaggattgctgatagaaacaaaggagccatctcttcagcaaagtatgtaccattcttttcctttatgtttttatgaagctttaaacagtaattcttggttcgtcatctggtcctcatccatcgcagtggactgttctatgagttttaatatgaaatggggtacgaacatggagccaaaaaatgcggggagccatgaacaggaaacatctagtggaagaagtcagcaattgttcgctgggagagtcagggaaaataggaaactacgtggtttttgcggttgagagtggaattgtgcatggggctacgggcattatgcaggccatccattatgtctgcaatttttgcacctattttgagaaaggctcccaggtctaagcttcttatctttaattatggttatgaaaatgccatgcatggctctctttctttttgggaaagaaactgctaatctatgataactaaagagtagtgattggctgcctaaactaaaatctaaacgtattactgcgtagtctatgaagttagaaaactaatcccaaaaaaactatgatcctggcaatctgactacctcaactgctagttggagagtggcttggctacctggactgctcaattctgttcagaccatcagcctagttaccatagacttgatgagaaaaaataattttctatgtcacaccatgccccaaaaattcacaaaccagaattccaagcagaacgtgcattaaaccactatccaggaacagctagggtagttgaactaagcatggctaagcaattcctaatccaacatctagtcatgttacatcccaagtttacaaaggaataaggtacaaaaataatagggctgagaacagtaggtacaacatcccatttagtaacattataaaacaatgcataacttaaaggaaaacatagagcatttgcaatatgggatcaatatattcaagtgacaaggatgacttgccttgctctgcggctagagggaccttggcgactatcttgaaatacaccggagcgttgggagagccgaaatctatgtgacatacaaggcaaacaatacaaataggttataagactactaaaacagataacaaaaccatttttaatggattcttcgctttttttttgatttactgagacttgaatgggcttaaatggagcacgaatgaattgtcaatgaattttagaaggttatctgtgtttttactataaacaaaaaaagccttaatcgatttattgcgcaataaaggtcctggatgatgtcatcggagaggggtggcgctgacaggtgggccccacatgtcaggctcataggtcataggctcatggtgaaccaagtccacggaaccggggatgggagcaccacgtggcgtcgacgtggcggccacgtggatggcctcgtgggcggcagccgaatggccccgatctaccgagtggtagatcggatggctgggaacgcatggcgatgcacgggcatggcttgagccagcccggtgggcatggcgcacgacggcgctagtgcggagcgggcagcggcaaccagcggcaagggatggcgcgcgacggcaccgcggctagcggtggcaccatggcgacatggcaccgcgatgcgacggcaacgcgcaagcggctagcggcggagcgacaaagagagaggagaggaaggggagggcctcaccgatcacaaacaaggatggtgagtgacggagggaggtcggcgaacagcggacgacgtcaggagagacctagtgtaacgccctgaaaatcgctctaaatttaaatcatgttttaatgaatttctagaaattttaaaagcctaaaagagcctccaacaattaaaattcaccaagatttatatcaaattggcttgtgggtattattaataaattccccatatctcaaaatgtttaaccaatttttacttgaattttcagagcatcctaaataattttaaggcaacaaaacaattaaagaattttataaaatggaaaagctaaaagaaatcctcttcctcctgttgggttgtttccagcccatctctccctctcttggcccagcccagccgccccctctccttccctctctcccctccccctcccaatccttgggccggcccagctgctctctctccctcggactcagagacaggggtgttccactcgatgacaggtgggtcccacccgtcatccctaacctccagccctctctctcctctccggccgaatctaccacatgtccacctccgattcgcctcctccactcgccgtttcatcaaattaattgaggggaattaattcccgccttatcctctccaatacccccataattttccactcaatccccgtttattcgtggtggattttgatgatgttctttaatggtgagctccaccatggcctgcgtcgggctcccatcggttgcccatttggcccaaaatagcttatttggcttattagaaaattaaaattaatttataagtaaaacttttgtagatttgttcgtagcaacttaaaagccaacattaaccaaaattacgttaaaagaatttcaaaatcaacttcaaagtcaagtttaaaaattcaaattttggcttattcttttactgtttaggccaaacgatggggctgtcgatcgccctacccggcgtctctctccctcccctccagcctataaaaggtacccccgactccctcctctctcccctcacaccgccgccctctccctctcctctctccgcgccgctctcttcttgtgccgccgccgtcgcaactccggccgcccctcgccggtggtcggaacctcattggagcccagcgtcgccaccatctgcttcgccgcttccttctcttccccgtcctcccctccgtcgagcacgaggaccgcgggaacgatgacgacaacgacgacccgaagcttctcgccgtttcttcctcaccgccagcaacaccgccgacctctcgccgccgcgtctgctcggtgagaaccgtcacctcctcccttttccgtttttcctcttcccgtgctccgttgcaccatcgccacgccgttggccgttgccggcgtgccgcctggctcgggtgcttctccttcctggccgtgcttgtgcgccgtgagccgccctcatggtgtaccgagcggctgccaaatgggacccgcccgtggaccccctctctctcttctctgtgcaataaatcaatttcctttagaaaaataattcacaaaattgcaaatttccatttaaacagcacctaaacttcaaatggccatatcttaaccgtttgaactccgaattaacctgttcaaatctctaatttctcctaaaaatgagtagatcccattgatgtgccttattgcttctgttcatatggtttttattagccttttttatttcttcgcgttggtcgtgtagatcctgccgttccagaagatcagctcttcatcgccgttgacgccgaagactttgtgagcgatcaaggcaagtcatatctatcttgaacatgttgaatcccatattgtgaaaattatgttgttttacttatattgcattgctttataaattataatgttcattattaatattgttttattggttattcctatgctctttgttatggccatgttattgatttcatatccatgattgttgtgaaccctagtaaaattataacttgactagtctagtgccctacatgatggactgactagttgctttaggtaaatgcttagtcctgcttagttccaacttagaacttttggataaactagactatggtggttaacaactaaaactggattagtattggactattgactggtttgtcaatagatgggtgataaaattctttgtgcaactaaaacatctttttgggctgggctcggggtgcaagctgattactttggtagtcgcaccccggctaatataagaaccggtctttgggcctctgttgcaaggcatcttcgtgcaaccacaagtctagtgggtaagacctgactggaagtttagatcttctcaaaacaaagaccattggttggaagggtgtggggccaagattaaggccgttttttcaccgggcgcaagggggggcctgtctcatcccgggggatccggcaacctttaccttgtcggggaccggcgggcggcgaaacctcagcaggttctcctgttttgggtagacctagatggatagtcttgtcacgacctctatccgagtaccgtggtggtacccggcgcgtggcaacgcgtgttgaggttgtgtcttgtgggtaaagttgtacacctctgatcagagttaaaaactattcgaatagccgcacccaaagttacttttgttttacaaaaccttgggagggtgaaatcatgatgatgtagtcatgtggtgattagcctgggttaaggcaggttcgttggctcatgagaccttgatgatattaaaatattggcttagaacaggatcgtgttttaaaatgagctttaacctgattaaaatgtttaaactatggctttctgcaaaataaaccctattaggccatttttcttgttttccctatgcattattattgcatttccggtgtgacttgttgagtacggtggtggtactcactcttgctcacaaaaataatccagaggatggacctgagaaagatgaaggcttggatctctagttcgctccgccgtcgagtgcctgtggctgctgctgttccgtagtcttccgctattttatttgtttatctttgagcgtgaggacctagagtcgcccatgaaataaagtacttcctttacgtttccgcaaataatcaacaatgctatgtgtacctcgcctcctgggacgaggattaatgcactgagcgtttggaaatggtgtatatttccgggcgtgacacctagggaacacaatgagaggggctagagggagattagaggtccgtggtaagctagggtgtgccgaccaaaggcggcggccatggagagctcaccgacgtgaggggagtgggctccggcgacgaaatttgacggcggaggggtggactatgtggccctcgggcttgcgaatccgacggcatcgacggcacggcccgacgcgacggctagcagcggctagcggcaaccggagtgtaggaaaagtggcagtaagtgggtgcgacggcgctagagcggaggaaggcacgagagcgatcagcggaaaaaggaaaaagggagaggaggaggaggggtccatttatataggggcgggaggtcaggaacggccgggagtggcgcggattcaccggcaaagtgggggaggtacgggaggagagagagaggtgggattcaaaaattgaatcctggccgtttccagcgcaggcgtgggccggagagggggtagtggggtgcggggagtgggtggcgtgcgcggggcgaggccattgtggtgcggtggaggctggacgtggccctagaacagcgggagcggcagttgtgggaggcggtggcggcctccggaggttgggggaggacccgacaggtgggccccacctgtcagcaaccccaggagacagaggaggggcgcgcgggctgttgggcctcggcctgaggccagcccagcgaatgggcgctggagggaaatgggccgaaggcccaagaagaagtaaaaaaggaggaaaatgaaaaagaaaaagggaaaaaggaatttccagggattctttaatgcttgtgctcgatttaaattgactagtcgccaacccgtgcgttgcacgggctcatattattgatagaataaatgataaaatttttaatcacacgctaaatagttggttacttacaaaattacagttgcttgatcattactaatttgatgttataaaatgaaattattaaaaatactaaatgagagtttgcgatttgtccaacttagtatttattaattttgaattttaaaattataacaatttatacaaactaaaaactaaacaatccatggtattttcagtttcatgttttatttaacacaaattcatgatacacatatggatgatcattacattccttaggtcatatacatacatatgcgttttaacttgcagttatattttgttgtgtcaagagcaaaactttcacaattcgaaattctctatatttataaattccaaaaagggattagaatgaactttatttcacaattttaaatactttatttagtatttcattacttaaattactttgtcaaagaagttcaatagcaaactattggtccaacagttaaagttttagacatattttttgcaagcatattaaaataatgttagaaaatactatattatttatacttaatatatatcttttaatccttatttagatgcattaattagctgctgttgtggaagtcggccttaattcaatgttttatttttgtgttgaaggataaaaaactaatgcaaacaataattattctagttgcatgtagaaaattcaagtatgttgaatccgtaaaagaaaaatatgaaaagattattgctatattccgatcgccctaaattagaggagagcagcagcagcagcatgggcaaaaatgcgagtatgttgttagtgtgaaaggaagagtagaagatatgatgagtatacttcagctgcatgaatattggcgtggcctaggccattcaaagtgcttgaaatttatgtacattttggagtgactgaaaaataggcagactcatatataaactattataaccgagtcaaaatcaaataaacacttggtgcactatcataagattcagtattgctaacttaatctccatgttttgaggtggctttgtatggctcgatctatctatgtgatcgatgttagcatttgccaataatcttttttaaacaaagtatgaagttaaaaaaaaaattgcacggactaaccttgttggattaagccttcaacatcttgatcctatacatgcaccatgtgtctgtcttagtccgtccatatgattcagccaggcaattagcttggctgatggatacggactgaaaaaaaaaaaagatagacatatatataacatcagggttaatcgataatcaatggccttaactgaaagcatgttgttaacaaattaagggtacatctctggcagggatagtcagccttgcgctgagcctctcatggtcaaatccatgattgtttttctatgcgctgaatcaatggggatacggagaaattactcacaatgaatcatgcatacatgcatttgcctgcaacaacagcctgcaaggacatggccgtgtggtcagcgtacatcgtcaccggcatatgaagcagcggcgccctaggctcgcaccgagatgccacagctttggcaggcgcggacattgcagcggcagaagccgaggcgactcggcgacatcgacgtcgagtggcgacttgatgtgagcatcggcgtaagctgcatcgatgctttccatagacgtgagcggcttgcctgaagaattaatcgtcttgccgcgctggctttgattccttttccatgtctctctattgacgcccaaggtgttgcatgcttcgttgattttcttctcttattgtgttgtgaattatagatagatctaatcatgtacttaacgctcaacagcaacagaaatattattgcctctcgcatatcctctcttatctgttccttcgtgaggtggtgttagattggtttaatttacacgtggcccacaaagttaaacacacatggaatttacaatctacagggatgataatatcatttatttaatcaatggccagatctttctgattaacgtgagagttcgtagaaagtgatttaatcaatggccagatctttctgattaacgtgagagttcgtagaaagtgcccaattagtataggtatagatggccagatctttctgattaacgtgagagttcgtagaaagtgatttaatcaatggccagatctttctgattaacgtgagagttcgtagaaagtgcccaattagtataggtatagatagatagatagatagatagattgtatccaatgcatacatagattaattaaatttaattgaacttactcaattcgaagcataatgtcacggatcttgcttatccaacaacttgtttgtgtttcttcgatttgtcctatgtaagatgctaagccaacaacatctgcaaaatgaaacggtgaaggttatgtatgtgttaattaatttggatgctagtaaataatgtaactaaacaacatattaccagataaatatgttttgctgtatactcttttggaaagactctcaatggttgaaaatctaaaggtttgttctagttttggtttgttttctagggttttgatctcctgaactttggcagtgttttgagaagttgagaattttgtcattgtgaactggacgatattctgctactgaagaaaccttgaaattagatatcatggacactgatccttcttgaatgccctgaacctattgacctgaaatttctttacagtagcatgcatcatggtgtcattcaataaataatataagtgagaaggcaaatgtaaatatcaacattatttgtgagaagaacagttatgctaacctcttcatcaatcagtatcatgtcaaggctaataagctcgttgctgttaggatttatggcaacccaaagtctaattacccattgttaacagctttccatgtttccttttcattgttaacagcttgaagcatatcacatgccattgtagttatccttcagttttgataaaaggaaaaataattttgaatcaggcaaccaatttatatgtcaatgggaccatgtagtaagtgagtctataatcagcaaaagttgatatgacgacaacggtttaagcaaatgaatataaaaaaatgaatattttcggttttgatgaaaaaaaaactctcaattaggctactatataatatctgtctatgggaccatctattaattaaactacttattaggaaaaaggtgatataaggatcataatccaaatatattttatctgcttcttctaccattaaacacaacctcaaaagtcagaagtgcgctttctttattaggcttttaacctagtagtttgttaatatagctcaacagcaatagtgatagtgtctttggtctattattgcgctattcagaaaattaccagtaaattttaacttctagtacaattagataactcgattcattgtcaaaatcacaatcggtaacatagcagtagaatatgttcgtcagaatagcaaacagtccattcaacaggcaaaagatcagcaaataattctttattaaaatcaaaatcacaaatcgagtcccagtttcgatgaaatacctttgtgtattacagatgcggcggagacggatgcaagtatgctcctttttgccaacgcaacgacaaatatgcgatagttgggaaaacggatgaactgtggaacaaacatactgatccctgaaatttataggattattaacgatggcgaaactgagtcttgtacggatcgtatcgttgcacatcagaaatcaaatttgattaacgaaaagaagcaccctatctggagttcaaatcggagtctagatcggtattgttaaatatgagaaactgatttagattagggaagagaagcaccagagttccagtcggagacggttcgctcgttgataaaagtcatcgccgcgagaaccgatgatctccaactcgcgctcgccgactatcccgcgaacggagagacggagagctggatgcggcgcgttgaagataaggtcgaccaatgcttctcctgcttcgttgaagataaggtctcagtcttatctgcctaaaatctagtaaatgtgcttgtatagttacgtagattttgatagaacccggcccacaaaacagtttttagacgcagctattaatccaagcccacatataactaaaactaataaaggcagatcacgtgaaaaatctacggtttagataaatcacttatttaaccaacggtcaaaattctctgattaacgtgggagctcgtagaaagtgtccaattagtataggtatagattagaattatctccaaggttttgaaaattccattaaaaatcatgttagcctattttgacatgtagaactcaagaaatattccacatgccattttttattattatttgcatttattactttagagtttcactcttgccattaaacaattgattttcttgcaacaatttattaaattattttaggcttaggagaacaacttcagggtgtgacaacatcctaaccttattgcaatcagttatcattattcctaaaataaactaatatatgcaataacagtttaaataataatcgttagcgtctaaatttattaactacaatcttgatagatctaacctaactcagacaatatacactggtagagaagtagtttgtagtcccagtttgcaaccccaattagtcctgggttgcataccaggactacgaatccgggactaaacatcactatcttaagtcccagtagaaataatcgggaccaaaaaagcatcaacaccaactgggacaaagatagtagtgccatgtgaatggaaacgccaccgcactccccgcgcgacggccgcgccggcctccgtcgcctgccaccgccaggcgccgacctccgtgacgtagaggaaaagcagaaggggatgagggaatcggaggaggaggagaaggagatctcaagaaggagtggaggaggagaggggataaggaggagcggcgtgtgcacgggtggcgctcgtgtagataaaggaagagggagagagagcaagagatgcccaagatgtgggagagagatatttagtcccggttggtatcacccaaccgggagtaaagttcgttgaccgtgtgacatggtctgacggttattgaaccaatactaaaaatgatctttcatcccggttcccgattgttgttaccaaccaggataaaagatcaaaaagtacccctgggcttttgaatcgggagtaaagatattttttagtcctggttcctattctaactagggctaatgtggttttttgagtaaccaagcaaaaatggtttctccatgcagcaacagggccatgcaaaaaaaaaggtcagctcgatctttagtcccggttggtaacaccaaccgggaattctacatatgtattgaaacatatatatgcatacatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttctacgtagtagtagtcgctgctagctcagaagctaaggaccggtgaattgtttttccgtcgtagtagaattcacccttgggatcaaggatttcttcgttgatgaatcccatgagttgttcttgaaccgccacgataaattccttgtgtatggtcaggttatccctcatgcgaataaactatatgaatgtatgaaattgattagtaattaaacaagaaatcgctacgtaatgaaattttgaatttatttgtacgtacatcgagctctcttgtggtgatgatttgttctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaa

SEQ ID NO: 69244 - DNA, 1130 bp, Oryza sativa
ctagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagacaaaaataatttttcgaagtaattgtcattaatctttgtacttgaaataatgttaatgcattaacttctattttataaacacatatgtaagcgaaaatcatatgcagtgctataatctttagtcccggttgttaaccccaaccgggtttaaaaagaatttcgaaatagcgggaaaagatatttactcccggttgttcagaacaaccgggactaaagatatcttttctttactcccggttgttctcaacaaccgggagtaaagatttagtcccggttgttctcaacaaccgggagtaaagatccgggggtatatatattcccggtgcgccctcgtcttcttcaccaacacttagacgttttcggccgatcgatctctctcggcctctctccttcgccgccactgcctagggcaaatccccgcgccgaccccgccgtatctcgccatcgtctcgagcttgtcgtcctcgccgccgcctccgcctccgcctcctccgctgccgccgcatctctggggtgagagccgccgccgccagatctccccttcatgcatctcgatcgatctctccgatctcgatctctctccgtcgcaccgtccgccacgagacgccgcgccac

SEQ ID NO: 69245 - DNA, 9966 bp, Oryza sativa
atatatatatatatatatatatatgttacttcgcatttatcctaatacatctttttgtatcttgcagaaaagacgtgttgtcggagtcgtccgtcaagcctgagtggaagagctagccctagaaggaattggagtaggcaagtgacataataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttaagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatacaagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtatggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaactagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtagggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagcacggtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggatgaacacgggggaaaggggtgattccttggaagattggtttcaaggaggacatccacacgtacaggagtcggatgaggagcaagagagataccgaggcgaagattgcagagctagagttccgggtatcgagctatgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggatgaatcgacctgtcccgttgatgacatcactcagcggacaccatgtgagctgcatattcctttgaagaacttatcaataaaggtaagatttagccattccgctagttgctgcttatatatgttgattactaaaaaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggagaagacggtgagacgcatctacgagacacatgccatgccattattctatggcgcaggcggtacatcatcctccctgggcgacaagcggtgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcctgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccgtacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccacaagagagctcaatgtacgtataaataaattcaaaatttcattacgtagcgatttcttgtttaattactaatcaatttcatacattcatatagtttattcgtatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatatatatgcatttgcataacatatatatgtataaatacatatatattatgcatgtatatacatataatataatataatatatatatatgcatatatatatgtatgcatatatatgtattgatacatatatatgcatatatatatatatatatatatatatatatatatatatatatataaaccatgcagcaacagggccatgtaaaaaaaaaaatgggtcagctcgatctttagtcccggttggtaacaccaaccgggactaaagatcgatctttacccccggttatttcacccgggactaaagatagcgatctttagtcccggattggtagtcccggtttggaaaccgggactaaagggggttacaaagtttctccaccggttacaaagtttctccaccggtgtagctgacgctcgcgttcctgtcttgtaactgacgtttgatttcttgttgctccagttgctgacgcgagggtaactgacgttcgatttcttgttgctccagttgctgacgctcgcgttccagttgctgcatctcttgtaactgacgttcgatttcttgatgctccactcgcaggtcgcgtcgtatcaggcgttttctctgatccggcggcatatcaagcttcaatcgtatgttccgaagactttctcgcccctcctcgagctccttctgtaggcgcccacgttccacttcttccttctttttctcttcttctatttgacgcaggtccatgcgcagaggcgacgcccggtaaacgcggacgccctgcctgcgcatgctatcatagaacctctcgggattccagacggcgacgtagacgccgatggcgtccacgaagtcgtcactccggccgcagaagccgacgatggaccccgagtgctccatggagacctcgaaccgcgtccatccagcctggtcttctagaagattgccgtatggtccgaacgtcctgttccggttgctcctgaactgcaaccaccggatgaggtggttgtcatggtagccgcacatgtgcgtcaacacctccccatggaagtcgagctcctcctgtgtgcgtccatgcatcaggttatttgtcagtcagtgattaattagtacaaagcatctctctgcaagctgtttgttttaattttctcccaaattaaaccgttcaatcgacgactgagtatttgtctgtgtttttacataactaaaacagtggaaaaattaatacaactccacgattaaagaagagtccctactgattctataatacaactagttgatgagttctattagatcatgattaaatgaactagtcaccggttcaccgctcatgaaaacctttatgagattgtcagaagcaagaagcagaggccttgggctttaataaattggtcatgatctgtgcccatcgtcgttaccaggagttgttttacgatacacggtacaagtgacaaggggcactggtgtgagtaaaatccaaccattcatttgcgtgggcatttctttaaatggtatattaattgtaaaatttacccacctttccactgaaggtaattaagttaatagtttctttctctacagctacagtactgaacccttagcgcatcattactgcaaaaccctcataggtgtccgttcatttaaaaccggcacatatgaacctttccctacctccacaggatgaaaaaagttacagaaacgtcacctttgggtaactatatatgctggttgtagaggaaaatcaacacaaatactatatgtgtcggttttttttagaaaaacttgtacctataatttataggtaccggttaactaaaagccacccagagagggcgacgaataggatgacgtcagatgttggtggcgcctaatcaattttcaacaaaaatatttagattttgggtagacatggcagtaataaatataagtttctaataagatagagtagatcctataaggagtggagaaattgttttcacttggaaaatcacttcctaaatcctaagatcacaaatctatcaagtattgcttgctacatacctcgggtattccattgtctctctctccatgcagggtacctttcacacgtttgccattgtcgtcgtattcaaacaacatcgagctgacacaccaggaagaccctatactcattcggcgtactccggtgtaactgccagcactggcaccatggcctccttcatcccaagcatggcctccagttccaccccacggccctatcttcacacgctgaagtgtcaagaccattaatacgcctatgaatgtccccaaatatgtgtgcctgcatatgtactgcttgatggtttggtccatatatatatatcctttcgtgggaaagatatccatacttcttgagctttttttatttctttattcaaacatgtggtaaaggaaacaacggcatctgctattttgaaatatcggaaattcctagctatcatcttcaactttggagcattattggagatgctctgagagaggctgagaatatagctatcctcaccccattaccctatcaaaactgcgcagattgagtgtgtatacatatctgctggttcttaaaaaccatggtgacagccattatttaacccttttcctcatcatcacgattgaccccaatttttggctctagcaacggattgtagtttacttcaactaacatgtgatcagacaccactattttgacatagttttggggaagtgcttgagccaagtgataaacatccaaaaaagccaagtgatctccatcattttttttcgataaaagatcatatattaccccggcttttggaagaaagcccaaaccaaacagagtattccagggtataaatataaggaacgtgcatatacttttacgaacagaattctatcaaaggacaacatgatgagtgataggctagagaggattcctatggacgtatttagctaacttaaattaaaggcaaaactttatcgaatgcatcaggaaccagccctcccttagtctgccaggttgagtccagccttgagctttataatgtacccgaatatgaagggatacaaaggacgggcagggttatcaccacctgtcgtctaccctactttccgtgtagcacacaacaaacgaaggtaacctctaacctagacaccacacctacgttatcgattactactctagcctcgccaagaactatcttgtttatccagagtcttagtactagagcattaagtataaatactaagcgacgatcccgcaccgatgagaatatatctcacttaaataaactaattaaataccataaggaaacttgaatacttactttttaaaagaagcatccaccgaggtacaagcgagagaagaaagccagcaactcatgcgcttctccggcactctgatggaagaattctcggagaaaactccgatatttgggacacaccttccggagctttctctcactctcttcctaatcccacatactaagtagctaccatgatatgaaagtgagttgtactcgactttgttgtgcaatttgagagtgcgaagaccttttccttttgtagctcataattacaatgctttacatcggtgataactgccgatgaaaccttcataaccgccattggggagtcatcaagagcatacacgtggaagcagatggtgagaggagccaaggtccgttcgggcgaccttatagttcggccaaccttttggcccacctctcggcctctccttcggctgggaggttgcctggtgccccccccccctacatgttataccttggttaggctcaattgtaggtagttttgattgacatgtgaggcttccaatccatgtaatcatgtctgattgtccggaggttccttctatcacttggtgggtgtgttttctaccgaaaatcacctgcatacatatatttaccaaagctagtggaaatggttagttataaaccccttccactaagttttgaaattatattttatttcttttatgcaggagttgatggtaaaagtttgcacttaatgaccgtcaacactatgactcggtgaataatcatacacattgagtgattcaagagaatcaattgaggattaaagttatgtttttatgagaaaaaggaaaaaacccatggcactcatcaggagaagtggaggtaacttgaatcatggtcgttccattcgtcaatcacccaagatgacacggtagacaatttaagattcacaagtataggtatgacttgaaataattattataccagtatcattacaaagggattcattgctctgatgtaatcaataatctttactcagggacaagtaaatgctcaatgtgatggtgttgttgacggtccttaagtaccaattccaaccatcaattcatgcacaaatgcaaatgaaagaatacaaagtagaatactaaacttagaggtagtgcttattactaaccatttccacaagtcttggtgaatatttgtacgtgggtgcattatggacgaaaataacccgccatgcgacaaaatacatatctagacaatcagacgtgagtacacggattggaggccctacatgtcaatcataatcgcctacaattgagcccatacaaggtacaacttgtagggggcccaccaggcagcctcccagctgaaggattggctgggaggtgggccaatggggttggccgaacccaaggtatgctgaaccacctttgcctccccttgccatctgccgacgcgtggagcaagatcctgaagccccaaaggtggttatgcttgattaccggcagttaccgaccttccaaccgacttaaggaggctataaaagaaggagctcactacactctaaaattacacaacaagtggagtgcaactcacttacacatttaggctgagttcgggagtgagcgttgggaaccctcactcccaacatgcaaaacagagcggtgattagtgcataatttattaagtattatctaaaataaacttgaaaaatggattaatatgatttttaaaacaactttcctatagatttttttttcaaaatgcacaccgtttagtagtttgggaaacgtgcacgcagaaaacgagagaggtgagttgggaaaaatgggggaagaacacagtcaaagggtgtgttcgggaggaggggttgggaatccctcctccctagcacgg

SEQ ID NO: 69246 - DNA, 6482 bp, Oryza sativa
atcttgtacctcgttggatgcttcttttacataagtatttgtgatctcctttggaattaacttttcttatttaagtaattaagatatattctcatcattccaggttcatcgctgtacttagagtaccttaatcttatgtaagtgtgacatcgagattggggtaataatcaatagcgtagacatggtgttaaggctggagtttacgtttgtttgttgtgtgctccacgggttgtagaagttgatggcaggtggtaacagccatatctgtcctttgtaattctccacgttcggtacatcatagagctgtaggccggagtctccttggaagatcaggagtaagccagtgttcgaaacaatttatagagttttaacttaacttaattaacccataggaatccgctctttcctaagcatcccaattagttgttgtccttggttgaatcttgttcttagattatacacacatgttccctgtgatttgatacccttggaatactctaaagtgaagtgctacttcagtatccatgttcttgcggatttatttaagactataataaataccaacagcgggccactattatgttgtcactagtcatgcattgtgcacacattattaaaagatgaggggtctcgacaagccattgcgtgcaataggtgatgacatgccctcccaagcaattagagcaagtttaacagtagagccaaatattagctataagatcatattagagttagtatgtatagtagatgggctctaactttgtatttattttcttctcctctctctttctcatgcatatacatttagtgcatttattttaatgtatgtgaagagttagctcttagataagagctaccatcagctcgcaattgttgaagcccttaccactgcctaggatcggggacttggggtgtgaggcccagagagaggttaggagatgggaatcgatcgaatggttgaaacagaccagaccgggtggtcttcacgggtggcagggtaatcttgtcttttcgaaacatttctcttcttgtataggctaaaaataataaaataattgacagaccgtccttcagcagattaccatatttttaggatgtactcagaccgttctatatttttgtgatgtctacatgcaaaaaccacaaattttcaatgtgtggtaccaaattttgccaaacaaaaaccctggaatgataattaacaagtatgaagtttgttacaatcgtctcaaacttatttgttataaagttattgtcaaagtatgaccaataataccatggaaaatgattaaaaaaggacaattattgttatactggagggaatataaatttgtttgtgcagttcattgatacaaatatgaaaaacaaaaattataatgcccagtggatagacctcatgaatgattttgctatatggtttatatatggaaagtggcgaatcgcatattattaaggggcgcgggctggggcgatgttggtgcgggccacgtcgcccctttttcctcccgccgtccgatcaggcgtgggcggctgggattgaggcgcgcggtggaaattttgcgaaaaatccctccgatttatatataattcaatatgggtccttagcaaacagttcctatgagccgatgttttacgtgaaggcccttgtagtagccggatattccgtgcgtgggagagaaaaaacgcgaatcgggaccgcgctgtacaatcttaaagtcgaggggattttttgcataatgatccccactagcccacccacccccaaaccctagccgccgccttccgtctcgcctcctcccactcgtccccatcctctcgctctcctgcctccgcctccgcctccccctcgcgccgccgcctccgtcccgcgcgaccacctccgcctccgcctccgcctacgcctctgccttcccctcgcgccgccgcgtccacctcatcgccgccgccgtcgcttcgtcgtctcccagcgcctcagcctccccattgcgtcgtcgccgccgctgtcgccccgtcgtctcccagcgcctcagcctccccatcgcatcgtcgccgtcggcgagcgcacccatctccgcctccactagcgtcgtcgcctcgcgccgccacttccaccttcgcctccctccgtccctgccgaccgccgtctctggccaccagcgtccggatctggcccccatgtggtcgggggacggggatctgacatcccccgtgcgccgggcagcatctccgcctccgtcaccaccgtcgtcgtcgccgagcgccgccacttccgccaccgcctcgccccgttgctgacgagcccgccgcccctgctgcgtgcttcgccgccgtcgccgacggtcggtgctccaccctccgttgcggctgccatcgaagaaacggcggtggtgacggagccggcgccaaggaaggcagtggttgcgtcgagaagaggaggaccgtacgtcgccaggcggctccggctttctctagaggagtagagttgcagagtgacgtggaagccggtggcacacaggagctagccgacgagcttgacaccgagcagcttgggctggagagcaagattatggccatcaggaacttcttggaaggaccccgaccatgtcctccgtgatcccatttttactttctcgcagaatatgctccaaatatgcaactttcttgacatgaactgtgcatgttttttgtgttttgtctcagcccaaccgccccaacgacgtgctggtgaaatagtgagcttactgcaaaaccggctaaacatgaacatcaccttcaaggagctgcaggtaaagcttttttgtccttctgttaattttattcctaagcacgtttgcttttctcatcgggggtaggacggtcctgctgcggctcaacctccactggggccacatgctttgactggccatcatcagcagggtcatccagcctcctccgccggcgagggcgaccagcctgtactgcaggcttggaccgccgtaggggactgcgggcgccatggaggggccgtgctgtccctgtgaccaatggacgatgacagttgcggctgccgcgagtccacgccgactgcgaggcggttaatgtcgatgacatgttcagcctgcgtagggatagccagatcggcaaggatcagtttcatggtaattttttcttgcagctcctccctgtcagcatcttcttcctctaatctattctagattttcagtgtatcaacatgattgatttcgcagccaaatataatccattccttccgtcccactcctattaaaaagcttgacctttttaccaaccgatgtcatgttgttagccacatcctgttcttagtttttctaattgtccattctctcattgggttatgttaaatatttttgaacgggttacgaattttgcaatatagtactaataaaacacataacgtctctccttttgtggagttgtctgattattatctaggatcattcactgttaggcctcaacacatttttttaattcctccataatgtgagagatactaatgactgttctcaagcagtaaaggaaaaccacatatttagattagttagccttccttttctactcttctcccgccatgtattgtttagtttatagaggagatcagatggacatatgctaccaagtctgtcatttcaagttctaaaaaaaaagtcggatcatttcagtggtagttgggcaaaaatatctgttggcatgcgagaacttttgcctacttattttaagaatgtttttgaaacctaattaggctataactcatctatcttggaatgtcctatttgttatatttagcgttgttttcattactcactgatgaaaaatttaggcaggggtgcatggattcacatgtttggaatgagatcatgaaaggatagatggcatcccaaggaactgaagaaaaacaaaaaactgtaggatcagcaatagcagttagagaggctttctggttttttgaaagggtattttagaagtttactcaagctgaggttttggatacagttaagcatttcataaacctttctgatgtgctaatacactccacatgtaaatatagaaagttactataatggacttttccaattgtagctatagctgagtgctaataccataaatttgcaggtactaatgaatacataatgaattgatctacccctccactcaaagcctcaaatcatgtcgctccatacaagtcgaatggccttgacaaggcatcagagatatcggtttgttcggattctgctgatcaaagttttagagtcgaggtctaatatggttgatcacagggccaatcttgtgcaggtatcacagaacatgtttcaggcattatcttatcacatattccatatgcttatattatcatcctttttttggcataaatgcttgtaccatattaccagtagacatctgctagcccactagaatctcttgatggagacgttaaaaccgccatggatgatcatttagttgtctgtttctgcttctgccgacataaagaaaatcacaagttcactaaacatctcccacctgtggtgactgagaaataggagctcaactgcacctgcttcaggtggtcggctttcctccatgggacatggacagagctatcatccacaatgtagaaaaaaaattaatattagctgggttagatgaaggacaaggccaactaaatttcattaatattttaggagagtggttacaaagattattacaccaacaatagggtgtcaaaaccgggtagaaaaaacaagggatcaaaacagccggaatcggtactgtctctacggaaatggccctcggtcagttggtaacaggccatatttatcaattaaactattgtttatatgtagctaaaaaggacaacggtcaaaaaggtaccaatgatatgaaacgacactcagtcggcagggaatttccgtggccattttcatccctagaaaaaaaccgacctacaagtgtcaaagccctcaaggaaatttaaaggtcatatcatgtaatatgcaacaatgcaacataactaaaatgggagggagggagggagggagggggttgttaaaaccaacttttttactacaaaaaggtttcaaatttggatctgcatatgaaatttagttgacacgaatttttttgacaggttttgtttgctcgttgtgtgatcattgttgcagcagtacatgccatccatctgataaattaccttgaatgtctcaatgttgaccacttaacattagcaatttgcttctttagattcttattgcactccgaaaatttcactatatgctcaattctattgttcctatatctaaaagcagtatcatctctaaatgattatccacttaaagcagtaccatctctaatgctattgttgctatctctaaaatgttgtgagtggaacactctgaattgcttgtgaggagcaggtaaatggttgttgtagttaacctaaactgcaaccgttttttagtgtttttatcaatgaatgattctcctattttagtgccactaaggctaaagctatttggtagagagcttggtaaaaagactacttcctccaatcaacagtatttgatattgggagtaataagttaatactcctgatgtcaaatattattgctaggagtgaattcaaaaagttagtactccctacaatcaatagtgttattgtcaaatattattctcgtgtaatgcattagagatcacaattctttgcttagtagtcatttaccatgattttttttcattttctggcaaagttgaaaaattaagcgaccatgctcttatttgcagcagtttcatggatgcagagctattggaatttgcaaactaaaacatggaccccaatgaacgtcacgactttaaaagtatgtcttgtgcacatgattttgccctactcactttctttttttgcagatataattggcatcggttttctcgtatcacatttgatagatgaattgtttgtagtgttggtgcataatttgttatatacatatagcttccatgcatattggtaggatagaaggcattaatatggactttgcctgttgtacatgagcacacttgaggcctaagtagattttcagtcagccgggaggtccttatgcactatgaggaataaactagcacacttggaggtattgaggtgttcttctacctgtccatttttggttaacatggatagctactcatgtggtgttcaaactgccttgtaggaattctcatagctagattaaaattcacagatattttctatgttgtcaacttctttttctaatggcaaatcgcaagtgttctacttcctggtgataagtataaccttgcttcttcttgttattaacaatcctgaaattgttcagtacaatggtcgttaatgtatatgatataactttgtgagagtgttttggcgattttttattatgtatgttttggtctgagattgagaatacatcttataaactgaaatcaaggcccacctt

SEQ ID NO: 69247 - DNA, 2687 bp, Oryza sativa
acaagtggaaaaccctttggtcatctagagaaccaacagtgatgtggctttgaatgaatgtggattatcttcagtactctttcatatgggttaattattattaggagttttgttgtaattatgcccaaagacaaatgattgtgctataactatcactactagcaaatgtggtagtttgtgtctgatgacttttgctacagataatattaatgaacatgattttcactaatcatagacaaacgccaattatgcatctgtttgagctgtccacaggcggcgcgccactggcgcgccccagcctctagtaaatatcatggctagtgtagtgggcaccttatccaaacaatgcataaaaagatagcttgaacttgcagctaaattgttcctttattccacttcttttttttattctcccaacagtggactacgcatatctgggccacgttgattttttttttccgaaaacggccacgttgattcggtggtccaatttaatgcacttgcgagcaactaattccgttccataaaaataaaccgatataaaaataaatctattataggatatgactatcatttaaattaagttgtgctaatatgatcctaatgtttccgctgtcattttaatttatttcatgcttacaagtcaatcaaactacagtatatatgttcaagtcaaacaacaaaagaaagctagatcaatctgtgcactcatgcacagcacagcagtagcaaagcttcaaactaactgtaatatctattacatgctaaaagtccattgaacatcctacaaacaattctaggctgtcacgtggtattccaataaatactcttaaatcgtcatatggcactataataaaccaatggaaccattacattcaactactaaatttatctctttaggaaaaaaaacttaacgaaatgatttaacgggagcctcaaggcccacctcgcttgctcccccgaacatagggtctgtttagttcgcgaaaagaaattttttgggtatcacatcagacgtttgaccggatgtcggaaggagtttccggacacgaatgaaaaaaactaatttcatagctcgcctggaaaccgcgagacgaatttattaagcctaattaatctgtcatcagcacatgtggattactgtagaactttatggctaatcatggactaattaggctcaaaagattcgtctcgcgatttccatgcaaactgtgtaattagttttttaatctatatttaatacttcatgcatgtgtccaaagattagatttaatatttttgagcagaattttttggaaggccgtagtaatgcacgtagggctgaaagaaaagctcgggctcgtgagctcagcctgggcttggctcgagctcgaatgccaaaggagccaagcccacgcctccttttcagctcgttgctgaaatgagccaagcccgagctagctcgtgagccactggtttggctcatgagcctaggctatcatgtatttatatggatcattttattttatagtgaagttattatttgtaattatgcaatttatcatttataatttgaagaattgaatatataaacttattttagttatacatgtcgacgatttattcttgatcatctacaaattatatatgaagagatgcttcaatgggaaggctcgcaagccagctcgatctggcttgagccaggaaacgagccgagccgagctcatgttttagctcgtttctctaaccaagccgagccaagccaagcctagtttgttgcgagccagtgcaagccaagcctagtttgttgcgagccagtgcaagccaagcctcgtgtccacccctgcacgcccggcgcctcaggtctccaagctcaacctcttccgatctctttctgttcctattcttttatgttaccaaattaaaagcaagaaaagctataattttagtattaagctgagcataattttaaatgtacatatctaatttctgttctatctaaattgctcctgtatttataattaaattgacaattttagatccaatgttttgctatacataagtaatatgtcattgtgatcttctttacgtccgcttttctcagaggcattcggatgggcgatttccggtgatcttcaatggtgactccggcaccactgggagggtggaatttctctcccggcgatgcaatctgtgatgaaacttggcatcgtttccgaccgccggttcatttctcctctaagttcagctcggttcctttccggttagtggtggatctacctcgctcaaatttttgtttaacaacttcttcggtggccttagccctcagggctgtgattggtggttcgcctgctgatctctctgtttcccttctcaaagatcgttctttctcttttttttgtttgctccaaacaagcgggtttatggatttatcgtttgagatcttacatttgcaatgattttgttctgtgcttctttctttggagaaatggtggaccaaattggcagtgggaatttgatgtttggagtcgtgaacaagagaaagaatggatttttgtggctcgtaagaaacgtgtttctgattctttgaggcaaccttgtcgttcttatgctcaagctactcagcagcgggttattcctaggaagagtgtttttgatagattaaaggagtccttgaaggtgactggcggtgatactctggcgatcac

SEQ ID NO: 69248 - DNA, 2177 bp, Oryza sativa
agatggtccccttttctttttcttttttcctttattttctcccgaatcaagtaggcaaatcccaaatcaatccccaaatcaaagtaacatcccaaattcacatcatcatatccacatcccaaatcataaagttacttatacaaacaaatcaaatacatcataatatcctaaaaaattactcaaatacaacacagatctaaacaatgaatcacaaatatgtacatctcagtgaatcacaaatttgaaaaaaaaaagaaaaaacaatgtcgctgccgccgctcgccacgactgccgggcgcccccctccccccagcgcctgccgggaaggaggggggaggaggaaggggaggaaggggaggagttgaaggagagcggatgtggaagagagttagagaggatagatctgaggagagggggagatattcgtctgcccaagttgtaactgtggaggagaggataagtgatagggattatatactacgtgttcaattttagtcccggttggtattaccaaccggtataccaaccgggactgaagatcctcggcctcctgaaatacatctgacaagggatgaaccgggactaaagatcaaaatttttataaccgggactaaaaactatctttagtctcggttctttttggaaccgggactattgtggattttgccagaccgatcaaagatggtttctccaccagtgtaatttaatttgtgggcgttgcttagagaagggtcattctttgtctgtttgtgttgggccctttcggtgccgaatttgtaagagttcgggtcatgcggcctgtttctgtagctcaaagaaatctccctctgagggtaaattgccaaagtctgtttctaccccccccctcgcattaatgcagatgctacggtcctaaactcccggggtaattgcaatcttgtttggagacctaaaaagctagcgctggttatctcgtagccttctcgccttctccaatctactgttgagaatattgttcaagcctccccagcccaaagttccttgccaatggcggacctcaaccctaaccctcatcgtttcctcaatcaaggtcacattgtgcatttgggaggaaatttgcgtgtccctagagttgatctcaccatccctcaaaggcatgttcgtcattatgaagagttttgtgttgctttggtggagccgccggtgtcggagcaagattgggatcaccaccgcatgctgattcttcatcacattcttgatgagcatctttttgaggtcagaaacagctaccgtcatgcttctgcggtgggtatgtatcaactccgttctgctatgcatagagatgccctggtccatagtgagccatttgtttatgatggagtgctttcggtaacttttgtgaagcatgatcaaggcccaaattggagagcatctcagtgccatagagagggttggttccttttcttggttttcccccttgactttgttgattggtaccatctaaaccttgctacggctacatttggccaactttctttttggcttgaaagggatcagatcaaggggagagttctgataagggctaagtttaaggataatgattttgtgcctcgaaaaattgttttgcatgatccggtgggtatgggcggaggaggagaatcatggacagtttccgtgtttttgttggaaggggatttcattaacatggctcctgatgaagatctgccccctgcgggccctcaaccaaatcctaatggtccagatgatgatgatgatcctaatgtgggcaacatttggcagatggggcagcctcctgctggtccaggtgacttggatgatttggtccaacagcagcaagctgcaaaggctgaggtagaggatgcttggggccaagactatccaatgggccaagtaatggaggtaaatcctaatggtctgcttgctttggtacctattgtttcagaggatgctagcgcttctgttcctgctattgctgtacgtaatagggggaaaaaggatcaggacccagtccaagacccgaagtccagaaattcttagcttacttggataaactggctagaagtgaatatcctagacaccattatttttatccaatgtctggcctgaatgagaagattgacctcttgtgtaaagaaaagggaaccatgcaccaatttcttgcttctagttttgttctt

SEQ ID NO: 69249 - DNA, 706 bp, Oryza sativa
ctgagatatacataatcaatacagtgtcacaagtgctggatcaaaatgggtagattgtgcagttgcatgcgcaaaaggcatctctttttcttcacagttttagaatagaatgggagttacagctgatcctcaaatggcctttgaattgagtactcacttctcctgaagcatacatttggaatgtttggtggacatgttttccacataagaaattgacagtcttatatccattatcccagcagataaagcgcttggaccaaatgggttcaatggtttctttatgaaaaaatgttgacatataatagctcaggactactacagattggcagctcattttcatgctggatgcacaatttggaaatcttgtagttcttatataactttggttccaaagaagaattcaccagagactgtcaatgattacggacctatatctcttatgggtctgagtttaaagttcctaaccaagctaatggcagacagacttcaaggggtaattctcaagctagtaagtgaaaattaatatagttttatcaagggaaagacaatacgggattgccttgcttggtcctttgagtacatccatcactgtcaacaatcgaagagcgaaattgttcttttgaaattggactttgaaaaagcttctgatactattgaacactctgctattctttttgtcttgcaacatatggattttcctgaaaaa

SEQ ID NO: 69250 - DNA, 1614 bp, Oryza sativa
atgatgattttaagtgcacaagctaccctaatctgttcagtgtgactttgtataagaatgattcagttaggaccatgtgcctacggcaatggaggactcttttgttcttcccctctcagatgatgcatgtggagaatttttgcaactgcgagatcgagcaattgaatcatttgcagcttcaggcaagaagtgatgtttggagttttatttggggaacaggtatatacacagccaagagattttacaatctcaattactcttctttgcaacttcctaggcccatgatttggctgtggaaaaccaaatgtgtcatgaagataaaggtgtttgcatggcttctgttctgtgatagacttaacacaagggatatgcttgacagaaggcattgtgcaaaagaagatgatgatctcacatgtgctttatgcaatacacaccaccagacttcatgtcttcttcacatgtcctttcagtgtggcttgttggcagcagctagtcattcattgggattgtaatttggaattctttcagatgattgttttggcaagaatcaggtttgcacaaaggggtttccttgaggttttctttctggcggtatggcatatttggaagcaaagaaatgggctaatttttcagaatattcggccttcattccaatcatggaagtctttgtttatgaaagaagttcttctgcatatgtgcagaatgaaagatcctctcaagcaatctctttttgattggttacaaactttataggattgttgtttttgcagtttttatttatccctttgtaactttgtacatattttttgatctataaaatttaaaactgctgggcaaagccctggcagtacttccagtcaaaaaaaaaatgtcattgtggttatagacccatgcactttgcaagtttgcatgtcatctaaatataaatcaaatacttaaaaattttgacaacgtgttgtgttattataggtcaatcttcaaacgtgtcaccgttggttccaatgacaggggcacataggtttcatgtgtttgcttacaccgtggtcccgggctcactatctggaaaataaagaactaactcaaatattaatagcacaaaccacaacataaaaaaacatctagtgtctttacgggcggtttcaagtttgaagcacacgtaagatagcagcctcgcgcgtcgtccctcccccacgaaagacccgggaggcgacgccctcaccggtacccgtctcccattacctcctcctctgcctcgccgccgcccgagcggccgtgcggccagaaggacagcggcggcggggcttcgtcctcgcgctcggccgggggggggggggggcggcggtttgggggctgctcggggcaggggaaccgcccgggcagatctagcggtgggtcagccggcggcggggctgagcggtggggcggcgacgacgtctggtggtggtggcggcggcgtttcgaggtactggtggcggcggaggaaaccgctagatccgagcctggatctggcaggatggcgacggcggcggggttggcgaggggatggcgacggtgaggcgaacccggccgcgccggcggcggagttatggaccccccggtggtcgtggcggtggt

SEQ ID NO: 69251 - DNA, 2720 bp, Oryza sativa
gagggtgagggggagggttagggttagggtttcatcaattttaatctgatctgagctgtccatcaaaacgaacggctgagatcgatcgagggttagggccgcacgtgggccggcggtccactaagtgagaggaggagtatgggggtataaagtagctctgttctcttgcgggctgaagaagaaaatgggctgaaaaaggcccatagagaaaaaaggatttttgtttagatttttatttcaataaatgcagaaatgatatttgtattatcaaaattagcaattaagctatgtaaattccaagataatttcaatgagtgtaattaatatagaaaatttaataaaagttaaatccaaccataacattttatttcttacacttactttacttataaattaatttaattatatacctacctacttaaaaaatacctaaatatttcagaaaatttgtatttcaatttaatatgttttaattcaattttatctatttttttcttttcattgcaacgcaataccacttttgctataatttaaaagagtgtaattaatattgcagaaaattttatatttcattaaattacaattcatttttttcatataaatagttcaaatcaaatttcagtcaccatatcattacccggtgcaacgcacgggcattttgctagatcaaagtacattgagtataaaaatttcactggtattttattagacttgcctacataaaaataaatatttttcttcatgatacaaattttcatccatcgtcttttttagcagattagttgtctaaaccaaataacaaacaatttcttttgaacagattaattgtctaaaccaaataacactttttgtcactgtacacacttcgtaatcacccggtgcaacgcacgggcacttttgctagtaaaacaaaacataggaaatgccaataagagtaaagcggaccaattagggaaaatcttataaggtcttagaaaaaattggttcttccttttcaccaaaattggaacacccgttaccatattccattgcgtcattttttagtgcttagatgctaatacccttcaggtggcattattagtttcactacatcatgcacacaaaagacataacccactaaggtagaaatatataattggtttaaaagttatattaaacttgatattcactttgtttttttcttaaaaaaatactatgggtctaacacatcgtagggaagcagggtctagataagtattcgaattatgtcaatatgaatcagtaagagggattgttaacttcatggaacaactaaaacataattatttgcaataatagttttaaaaattttgttaaaaaagagggagcccataaacattccatttgaataaaaactacttgcttttaatttacacttacctgtttccaaaaacaaagtatacttttcttttgaatgataagtcagatcatagttaatttcttaccgaatgaatattgtatagtatgtagtataaagccaacgaatagcttagaaaaagttaccccagcaataccgattaagaaggtttttcagactagacataattttgaaatatagtatgaataatccagttgatggtatataagtctctaaagctgacaatatgatacacgcccgcacatttgcgcgggctaccttcctagtttaagaaactgttgggaacaaactcgatacaaattggtagaacacctggagaatataataaataaacaaactcgacaaagacagggttttggtgctgtcaagcagcagcattttctggtttatactcaatttaaaatagcaaatcaacatacatatcatgggagggcaatcccacacgccaagcatgccacgcaactagacgcactccggcttgaaccagcaagccacaagcaaatacagacgcaacaagataaggaaaaaaaatagaaaaaaaaagaaccaacaagaaatgttccatcagaaacaaacttcaaaaccattagttcattacaaacaatctagatcagtcatatgctgaacccagataagagataaacttgatatatccaccaatgaccaatcactgtagggactttagagttgttcttccaagtatatgaatcttgtatggatcgatcatcgatgtcggtgaccgttgtagtcaattgaatctacctgcagttggaattatagaagaaatatatcagatttgcagaaaagaagctgtgccctttcaatatgctccatatatgataagttcacaatgcactataaaaacaggttctagtttttgacctcctggtataaaagtttgaatatttggtacaaacatataatgtctgacatatgtacatgtctatataaatagaaggctactgcagaacactataccattccaacagaatagattatgtataacgacattagcacggtatcttagttagatctgatatttttgatactagataggtactagatctggtaccgtggtaccagacacaatacccataggtatcatatttggtgccaatgataccagacatgatactgcatggtactagatcctgctacctaggtaccatgctgacatcatgatgatgtcaactattccgttagaacagtatatcgttctgtagtattctgatataaatagcatgcaattaaaatatcagaagaacaaataattttgaaataaacattttcatgtttaaatatatctaaacttggtgaaaggatt

SEQ ID NO: 69252 - DNA, 1324 bp, Oryza sativa
tttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattagaacactacacaatcttatatgataagtctaattacaggtctaataatcttaattaattgcattacaaatataacaatcatttatattattacgtcacttgcctgctccaattccttctaggactagctcttccactcaggcttgacggacgactccgacaacacgtcttttctgcaagatacaaaaagatgtattaggataaatgcgaagtaacatatatatatatatatatatatatatatatatatatatatatatatatatatatatatatatatatatatatatatatatattgcatttcacgttaacgttcgtcctcgttcgttcgctcgttcacgttccctagctcgttcacgttcgttcgctcgttctcgttcacgttcgttcgcttgttctcattcacgttcgttccctcgttcttgcttgtcttcgttcgatcgttctcgttctcgctctcgttcgttcgatcgttctcgttcacgttctcgcggcaacgtacgttgacgtgttcgttctcgctctcgttcgttcgatcgttctcgttctcgttcacgttctcgctctcgttcgttcgatcgttctcgttctcgttcgttaacggcggtgtggcggcatcggggcggcggttggcgcggcagcgtggcggcggcggcggcggcgtggcgacggcggcggcggcgtggcgttgcgaggccgtggcggcggcggcgtggcgtggcggcggcggcatgcgcgcgcggcggcgaaggcggcggcggcgtggcgacggcgcgcggcaacggcgtggcgttggcaggcggcggcgg

SEQ ID NO: 69253 - DNA, 2592 bp, Oryza sativa
atatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttgatacttttaaaaattctctagtcaattataattagcatatgaatgatagtaaattaaatgttaaaaactataattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacactataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgtctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgcgctctcgtgtagaatgtgtacccattgatctcatatccctggaatgtcgtgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaacgagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaagatgacaaagcagatacgtcattatattgaaaaatgaaggtggaaatatcaactcaaaactgacgagacattgcaccacttcattctgaagggcttctaatctatccagatcgatgactttctgcgaaattgcgttcatgaatgcacatagctttgttattgttgctcggacattgtctggaaggataccccttattacaactggtagtagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctagctggactcaagtaatggcttcctttctcctttggttccgggtgaaggtcgccgtgttgttccatatgcttcagatcattacgtgcttccagtgtatctttcgactttccgtatacacctaggaagctaagaaggtttacgcaaaggttcttagtgaggtgcatcacgtcgattgcgtggcgtacgtccaagaattcccaatatggtaactcccaaaatatagagttctttttccacatcgccgcatgaccatcttcgctctctataggctggcttccaggcccctttccgaatactactttaagatctttaacaatagcaaacactgttttcccgttgcgatgtttaggcttcgtacggtggtcggccttatgttcgaagtgcttgcctttcttccgtaccgggtggtttgctgcaaggaatcgacgatgaccc

SEQ ID NO: 69254 - DNA, 4883 bp, Oryza sativa
  unsure (1)..(4883): unsure at all n locations
acctgagctcccattcgtactgtcgtcgtcgccggcacagtccaatgtcatcgtcgctgccccagaagccgttgccgcctctctcagcactcctttaccaccctctatagatccacccatcgcagggcggggcggtggatcctgcacctccactgccatcccttgcctttccttcaccagcatcgctcctgagactgggacgagtggatcctctccccttgaagcctttactattgtcgtagtcaccgtagccacgcagttgttgttgtcgcccatcgtgttgtcggcagaggcggatcccgtagcggggctgcccggtgatgatggatccgcctctcccggggccaagggcggtgccacctaatccgctgccttgaggccgccacctccatcactatcgccctagtcatcgtcaccccttcctgccgctcctaaggacggtgccaccacccgttggtgcttgcttgcacgctcccatcatcagtagagctgagaggagccaaacgtggtagggagaggaaggggggagtacggagaggagatgcgggaggagaggtgatggacgggggagtaaatcataaaggaagtatgaaccggctgggtgtgaaaacttgcaggcgggcctcttaattggaccatcagcgaaaatagacctattttttaaggagtgtctcttaataggtctgtttgtgaaaatggatttttgcatagggatttatactggctgcttttgatgtagaattacgctgcgacaccttgagcacgttatatgcaacctgcagcaacaccctgagatgtgcctacgtagagattgggtagatgccgctgaacaaacacttgggagggaccctgtcagggtgcatgtgcaccgttttgtcctaggctcagcaggctagccaggacgtcctataacaccatagagacaagagacgatgaataattgggggtttaggagaatagactttggtataggtagcaaggagggagatgaagaatatatatggtttgggtaataaattgattttgacgattgattggttgttgtttcaatcggctttagcccaaatgaagaatatatagggtttgggtaataaattgattttgacgattgattggttgttgtttcaatcggctttagcccatatatttataggaggattggacttgctccacagggtccttttcacgtcaaattagatatataatatcaagcccaagtaagaaaacccgtgaaccactaaatcagactcggaatcagggtcggtctaactggcactgtggcagcagtcagacgggcctgtttttatgtcctctttaaaaaaagttatgttcagaaaaatcggtttttatagtgtctctcccagaggccactcctctgttgtaaatgtgctaagaggatatccaatataaaatagaggcaattcattttgttaactctattttatatcaatcgtgtaaagagttaacaacaagaattgctaccaggttttggatcctgtgagtttcaattataacttttaaaacacttaccgaatagaaagaagccagttttcgctagaaatatatcatcaataaaaggactaactcccgtaaaaaaaaaggactaacttctttttagaatacaaatcataattctctgtgaataaataccatatttcaaaacagtactttatatggaaaaatgaatttgattaactatttagcaaccaatagccattcctatttcaaatttatgcatctagcagcaggaggtttacgaaaatgctcgcacctggacgaccgacgggtggagaaaaatcggacgccgtctgccactgcagcatgcaaagaatcttttctttgcttatttcttcaaaagattttttatcgtaaactatttatctaatctacaatctgattacaccactaaattcattacaattaaatctttacaacaaaaccacacatgattatatttcgacaaaaaagtattttattttttttattgatttttttaatgttgcatgtggtctcttttgatgtttcaactagtagttttacaatgtttcagctagtgtactcatgatgtttcactgtgtacggatcaaatgttgcagtggaacgtgccgttgcaataaatcacccacatagtttggaaaccctttattatgggaatttggtttattttttgtttcacaaaaaatgttcacctagtgcactcacaatgttccattatggatagatctaatgttgcagtgaactgaaatatttcattgcaacaaaaaaacccacatattttggaaacctccaattaaagaaattcgtttcattttttgtttcaccgaaaaatgttccacctagtgtacttataatgtttcactatgtatagatctaatattgtagtgaactgaaacattattccgctatttgctgaaacattgtttttacataaggtgaaacaacaccagatttaaacgagggaaacatttttgatctacttagtgaaacaattccgatatacctgatggaacatcgtgcaacatttaaaaataattcaataataagctaaatttttttttcatcggaatatatccatatgtggtcttgttttgaagatttaattgcaacgaatttaatggtgtaatcggatcatgatttggataagtaatttaagagaaaaatcagtttaaaagtagttttgcacataaatcagtttaaaagtagcgtccgatttttccctagagcatcggacgtccaacgcatagccctctccccggaggtttacccattgattcgtgatcgaactggagaaccgaaagaaatctcaaaatttgttcttcgtcttgtccttctctgctcgatatttcctttcatcctactccttgcctagccttcctatgtccttggctgatagtagcaaaaacaacaacagaagcacacaacagtgggcagcgcaacgggtttggtgttgccggcgttgaaataaggcatgggcgacatgacttcagctcaagctagcttgtcgtccccacgaccagccatctcgcgagtcgcgatccctccctccaaagaaaatcgccggcctcatcttccaaaaaaaaccggcggtcagccctcctccaaaaaaagcggtcggtcctccctccctccaaagaaaatcgccggcctcatcttccaaaaaataccggcggtcagccctcctccagaaaaagtggtcggtcctccctcttctagtggaaaaataaaaaaactggcggtcagccctcctccaganaaagcggtcggtcctccctctcctagtggagaggtcggtcctccctcctctagtggaaaaataaaaaaactggcggtcagccctcctccagaaaaagcggtcggtcctccctctcctagtggaaaaataaaatagaaacagagaagttatggttcgaactcaggacctcctatttcatagtatgcaactctaaccacttgatccagtagagatttctattaaaaagttaacgcttatttgttttcaagcttcattaaaattaactattaaatcctgctgctgatatcacctatcgtttatattattcaagacaaaaatatgatagattaattctagcacctggtagtaacatcactatagaattgtagtaacacgcttagttactggaaaacacataagccgttactactctctagcactagtgttactacacaattttaactaggtgagcgttgtgtccgcataggggtttgaccaagaataacctatggtagattcattctagcaccatcaaagatgcaaatcaatcatgttacattttcgtagtaaagtcatcacgaaataattacagtaacatgcttggttactgcaaaacacatatgttgttacgtcatgtaagaactattgttactacacaattttcacaagattaatgttacatctgcttaacgattccatagagatttacttgatggtttacctctctcccctcaccctcccgacgcaccctctattcaaattttcatttactgtgaaagtatatgttactaccaaacatataggacgttactgtagttttggtaataacatcatggtgaaattgtagtaaacaaggaatcgaaacaaaaatgtatgggttaaaagtatacatgctaaccatatacttgttactgcacaaaagtgtaagtgttactacatggcaggtacacgttaccacaaagtttgtgtagtaacactattcaagaattgcagtaataagttttgttactgcaaaacttatagtatttaccacactttcacagtaacatcatgatgggattataataacgtacaacaggaagtagtaacacttatgatatagtattattacttgtggagagttaaatttcaaaagaccaatatttgaaggttcgctctacccttgccccacgagtaaagcgagccaattcccctctctacattactgcactttttttcttactatatatatccttcagaanngttatcaagtaattacagtaacacactatgttattgtgcaacttatactcgttactacatcttgtagtaacgatatgatgtggttgcagtaacacatagtagacaatagtaataattatgttatagtattactgcttgtggagagttaaattttaaaaaaccaatctttgaagggtaatatctctcacatcatgcactatttttaaaacccgtttgcaccatgatgttagaaaaaaaaatgtttatcaaaagtagatccgtcatgactatattatgatgatatttcagtatcgttacttcaagtaagacatggtgttactgcacgatgaacatcacgttactacgttgttctgagacgagagctgagaagagtggaggtggcggggagagcaccaggctggtctgaccg

SEQ ID NO: 69255 - DNA, 1036 bp, Oryza sativa
gaaagcaactaactttctccctttctctctttgtataaatcccgtaggaatgtattttattgggtttagtcccacatcagtaattgatgatggggagcacgacttataaggtgggggcggtcctcacccatcagacttgtcttttgggttgtgtgggcctaggacctaaagttgtgactccggttgggtctgtggtggagcaggcccagtgtgacctgggtggcccacggttggtggtttgggttgcgcactctaacaagtggtatcagagcccatatttggaatccggcacaatttccattggtcacatggtggagaggccaggtatcaagttttcggagtcacatgggttgatgtgacgagggagattgttgggcctgaggccaggtagcaagtctttgaggtcgcatgggttgatgtgacgggggagattgtcgggcccgatgtgtgacgggggagattgttgggtttaatcccacatcggtaattaatgatgggggagcacgacttataaggtggggacggtcctcacccatcagactagtcttttgggtggtttagccctagaacttaaagttgtggctccggttgggcctgtggtggagtaggcccaatgtgacctgggtggctcacggttggttggccgggctacgcactataacatatttaaaggggcatatagtaaaatctaataaaccgatcgattgataacaaccaccaccactttatccaaagatcgacagaatgcaatacatatatataatatactgtttcatggagatcaattaactcaatgcatgtacagtacggtgcatgatcatccatccgaattatgctttgaaaggttaatttctgtgcgacatatatcaaattcttttccaaaattgctaaaaagaagtgtgattttagattaaaggatggtcgactacacacagcctgttacatttttgtttcgtacataaggttcgcagaatgcaataagactaggaaaagaaaagctactacatctccaagagtcctataaacatgttcccaa

SEQ ID NO: 69256 - DNA, 2057 bp, Oryza sativa
  unsure (1)..(2057): unsure at all n locations
ttgcaatcattcatcagaggaagagttctacattgaggctgatggtgtggaggattaggtgtagccttggtcaagctgcctgtggagtggagccgtctgcgccgtttatttaattccgctgctagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcctttaatggttctcattcaaaatttattccagtgttattagtactgtacatctattactgtactaatggctcatttactagcaaaagttttacaatactgttttatttaatcttgctgcaataaaataaatttagtatgttgattttataactttcttttgaaaccagttattcaaaattacaaaatttgtgacctcgtttccaaatgttttaatttatttcgcaaagcttggtttactttatttacttacctttttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtaagatgtcctttgtcattggatttgggactgcccctttttatgcccagattcgtcatgatcgtcatgaagagaggtgccgtgtcaaagtcaccttaaacagcaatagtgaagatattccatcagtgatgttcgaagctggaggaagaaattatatccatgcatgtcaggaagtggcaaggatcgccataggagagctccgtgatcgctacagtgatcagttggccgacactgagtatcgctaccatcctcgtcaaccacagggaagtgaccgtggcagttaccttgagactgaaggaattgagaatgatgctactacaaggcatttggttgagatgctgtgggctatggatgaaagtcgtgcggagactgtgttagcagctcaagatcgtgaagatcggaatcgtggtaagatttgcaagctagaagacaaggtggatcgcttggagaaggaattagccgcattgaagggagaagcaccgccgcagaaggccaggattcgtctcaccgcaaggaagagagctttgtttgtccctcgttatcaattggcgccaaagatccgcgtggtggagaaagaagttgccccagcaaatcctcccgtcatcatcataagtagtgatgaagaagaagaacccaagcgcaacaattccaagtttgagtgggtagctatcaaagatgaggaagatgagccgaacgagccttcaatcgacctcctatgctcggaagaactagagtgacttgttaagtcgttgtcttagatcgttgtgttagtttgcttgttttaagttgnnntgtgtgtgtgggtcttgcatgttatttacatcagtggtgggatgtaagtgcatgcgtttgtttgcttctgagtgttaggaagttggtgagtttagtggtgtgagagtcttcagtttgtaataatgaaactcagttaagatcaataaaagttaaagtaattctctgtcctaagtagtttcccccgttttctcttcttatcctgtccatgccagatggtgaacactcgcagcaacgggaatggtcctaacctcaacaaccccaataacaacaacaatggagagaatccaacccttgctcaagttttgctcaacagactcagttaatgcacatgatgatgcagcaatttcagaatcagcaaaaccaagggcataatcatgcacctccacagaacaagttagcagaatttctt

SEQ ID NO: 69257 - DNA, 11938 bp, Oryza sativa
tgcggtctcccggtgaggagccacgagctccgtcaatataggaacatatataatttacaaataactaaaatttaatattaaaaataattaataactaacacatatataaaatataatatgaaaattcagaaataaaaataaataatattggaagaagagtatagagtctatatagaaatacaatttacagaaaattcggaattaagaaaaaaaatattaaaagacgagtctagagtccatatagaaatatatataatttacaaataactaaaatttgatattaaaaataattaataactaacacacatataaaatataatatgaatattacacattagtagtttgtaaggttattgcaaaatttaaaattatgttgtcattttaatatatttgaataatataatgagaaaacatatatgctattatatgagagaaaatataatgatgcctaccatgctagttagtagtaaatacggacacccgtaacaagtttagaacttataccaagtagattaattcttctacaaggaatctaggagagaataattagcagtaaatatggacacctgtaacaagtttagaacttacacccaagtagattaattctactacaaggaatctaggagagaataattagtagtaaatacggacacccgtaacaagtttagaacttatacccaagtagattaattctactacaagaaatctaactagttgaactatcttcactttggcaaagattatcaagtttgcaaatggctttgtagtgttagtgctaacttgcgtccttgcgattttgtatcgcgagtcatggctgactaacaagaggatgactctttgttatgttcatcagtctattcagaagttcatagctgagcctcaatagaatggaatttgctgcctatacctgacaaaatctatttagctgatagactcctgaccatctaatagaacagataatgcatccgtagagtacatgaccataaaaacagtcaatcaataccagtaaaagtcgcatccttgaatgatttgctctacagaatttttattacagaaccgattggtccccaaggcccaactgccattacacgctcttaaaaagatcaccgtgtattcccatttcggagtccaatatcgttgccacaattctacaaacaagaagcaacaatcaaggttggcttgaccaagatacatctagcagactagcacatagtacttacaacaagtaatgtacaatgggtttaaaaaaccgagctgaagacatgatacgctgagattatggagctaaaaccaagagcaacgaaagctaagaatgccatggaggctgaagcattgataagtttggcaaattgatccactccaaaccgagacacccaaacatcattgcgagaaagtgctgctgaagatgctgacaacaggaggtaagccaatatctgcaatgaacatatataaatagtcatgcaacgaaatcctatcccatgcatacagttctcagccaagatgccaatatgtgcagaacctcagagataaatgttaggacaatgccaaacaggaagttagagaacaagtgcagcataactccagctgatgagatatagcttatatcaaaggaaggacagaagaatgaagtgtacaacttgatctacaaactctatgcgcctggcacgatagaaccagcaacatctgatctacaaactctacgcgcctggcacgatagaaccagcaacatctgaactaaggataaagtgcacaacataatctacaaattttacgcgcctgcaccagaagcatctgaattccacatttttttaggcaaattatatgattgacttgacaggtacatgaaaattttcttacattgcaaacagcactgtgataatgaactgtaaaattgagtcctcgattcaagattgaatatgtcgtagagaaaaatgatcaactataacataaagttcatgaacaaccaaagtccatcccctgcatgcagcttacagcttactttaccccaattcatacaacttaagaattaagataatctaatcctgcaaaaagttgaccactgtctcggaatccaagcttacaacaatttgtaaccatagaccaatcagcaacagattaaagctcacacataatatgaaaccgaaaggacagaaaatacattcagagctgaagttcttgcctgatccattgcgagattgaagtacttccctgatgggtctcgaattatacgtctccccgtgacaaagtagtgcacttccacgaccaactggaaccccgagtaagtaaaagccaacacactcgcagaaagtgtatacctgcattgcagaagcacacaacttccatcaataacagaagctggccgccagagggggatttggcaagcatcatggtacggcgttgagagcgcaacctgtactcgttgtagcggcggaaggagtcaccggaccagcccggcgtggtatcggcggccatgacggagagcgagaccaagcagaagacggcggccaaaaccctgaaccctagctcggccctcctgagctccgaccgccgcaccttctctgggacgccgccaagaagccatctcttagaccccacgcctcctcctccaccaccgccgccgccgccgactgatgcgacggcggcggtggtggtggttgctgctggtgcggccttctcgggcaccggcttcgtctccgtccccgcgtggtcctcgccggagaggagcttggcaatggtcagggcagactccttctgcggcgatccggttggggactccgccgcttccgcggccttcggcggcgtcggcggcatcgccttctccgtctccgtctccgccagcgcaagggcaagcgtcatgttctccggttctccatccgcttccgacgcctcccgctccagcatggattccggggaccccggtgctgggggagaaggcggcagtgatggtggtggagaaggcggtgctggttgatcgggagcgggagcgggagggggcgccgcccgcggctgtggagttcggttgtcgtgggggaggggaggagacggatcggcggtgggaggagggggcggtgccggggcctgcgaaggaatggggcgagagggatcgccggagtgatttggtgacggagtagtaggggcggcggcggaggcaggaaggggaggaggaggaggggttggattttggggtgagatgggagggggatcggttgccgggtgcggggtgggagggggagggtgggattgggcatcatcgccatcggtggccggctccggcggcggcgagtggattggggaggccattgctagtttgctcgatggttgttgaggtcgctgcttcggttggtgttcagttcagtgtagtagcccacactggtcggcagtagtgagaagaatcggggaaagggaagtggggaggtggtcaggtggactaggtttctcaagggaaatggacgtacgagtacgagagcagatttaaggccccctttgatctgtagaaaaagtgtaggaaatttgaagtatttcaatcctatggaaaaaatttctatgaaagcctttgaaacaaaggattgaatcatatactatcctttaaaattcctatggaatggctaatcctatagagattttggaggaaagttagcaagaggtccaacctcttggaaaaattcctttgagtctatctctctcatccgattcctgcgttttttctgtggtctaatcaaacggtcattcctgtgtttttcctgtattttccaatcctttgttttacacctgcattcctgtcagaatcctacgtttttcctattcctccgtttttccattcctgcgattcaaaggggccctaatagtatagccaattcatgtgacgcgcttacggatccggaccgatccggggctagggaaatcccacgtcatacgtccgatttacgtgtaaaactaatctaaactgattttttttcttaaattactaattcaaatcatgatccgattacaccattaaattcgttgtaattaaatcttcaaaacaagatcacacatggatatataccgacgaaaaaaatagcttattattgaattatttttaaatattacacgatgttccaccaggtatatcggaattgtttcactaagtagagcgaaaatgtttcactcatttaaatcaggtgttgtttcatcttatataaaaaataatgttttagcaaatagcgaaataatgtttcagttcactgcaacattagatctatacatagtgaaacatcgtgagtacactaggtgaaacatttttctgcggaaaaaaaaataaaccaaattcccttaataggggggttccaaaatatatgggtttttttgttgcaatgaaatgttcgttcactacaacattagacctatacatagtgaaacattgtgagtacactaggtgaaacatttttttttggaaaaaaatgaaccaaattcccttaataatgagtttccaaaatatgtgggttttttgttgaaaaaaatattttaattcactgcaacattgaatctataaatagtgaaatattgtaagtatactaggtgaaacatttttgtagaaaaaaggggagtgggtgggtccaacagtatggacgtgggggagggacgcgcgggggagcgtccgatccggctcccccgcgtcgggcgctcggtaacgagcattatcgcaactactagctccaatttatctatagctcattcatacaatagttacatactatactattataatatatggtcccacctgtcatacacacactgcgtcttgaaatccgtgctatagctagctataaatctgtagcccgctgctcttctctctccttatttatcttcttaaaatatgtttacagctggcttatagcttgtacctgctctgaacaactccttgatgtaaattgtattggacgtatccttgagcgtgatttactagtaataaaggatcagtaaattgaatcgtgaactagagatgagaaaagtgcaagttagtatttgcagccagagtatttcggtagaaacttgacgggtgtttggaaagcgcatgtaaggtttgtcgtctcaaaatcccaatcattacattagccttgcatgaagcattgtccaggtttactaaataagaactaatattcatgttacattggattgcgtattttatagctctattttttaatcacgcactctagtcaagtttttatagtactactatcagattgttcagagtgcaagctcttgacactaaagtgtgctcacctggttggctggttgttgtaccttagcggaatatactctttttctttttcttctaagagggattctaactcaccagagtcaccaagtgtgcaggattaccacaatgtacaccttttcccattggtctgtaagatgaactgtacaaattttagaagggtttatgcaacatgtgaactgcaacagtgaaatattccattataaaagctagagatgtctatgacactctggctcatgttaaggatgggttagtcaaaggtgttgaagtcttgaagaagcatgggcatgcaacgtatacttcctttcaactatgcactgatatagggatatattcatattcttcatgtacagcagatatgaaacctgtatggttgtatgacaagtagtaaattatttgcaacttggtggatttgtacacttgaaaacagtagaggcaggttgtttgtattcaggtatgctggctggatcaacaggtcgaacctcaccgggctgaaagaataggctgctatgcctgcagaaatgataaatgatagagatataaggatatgtttccccccaatcactaatagtgcagagtatacatgagcagcagtgagaaaagtttccactaacaaactccctaacattgttgcactgtgtttaccagaagtcctgcagataaaaacttgcaaaatggagtggaataaaatgaattgctggtttttacctccggaggtctagccctatcaacccagcttgtagaattgacaggttgtcagaatctggtgaaacaatgacaacggtatcccccgagtactgagtctctagtattgacatgagctgcgttacccgaacaaatacatctgcaacactctcatttggtgtaccatcactaataggaggtggcttgatgtctggcgaaatactgtctgatgcatacacctaaatccatagcaagaaagggaaattcaatgagaacaggatggaatttaccaagcaaaaaaatggctgatccataaaccgaagaagcttcagaaaaagaaacatagctcagtcaatatagtgcaaaatctgcaatatcagtactggcgtggaagtgtatattagttcattccctgatttctaaccaagaaagtatatatctatacttatcaaaggtaccaatctcactgcctatttcccagtaacctaaaaccaaacagaataaacttgtatgtttgattcatgaatcatgataaagtgagtacacgaggatatccattcctcaaattagttctaagaatgaacggaacttatatcctatatattacattgttcattgtttgttgagatatttaactagcaggtcgagaatactcctgtctgcgaaaacacttaaacactagtcaaattaacatattctattaatctaatactagtagcagtgctatcaggagccaaagatttttaagcccttcatggcagttggcaaccagtatttcactaattgcatcaattctcaatctagcacccaatgtcacctaaaaccaacatcttcacacaacagtcttgtatcactctgctgtgcgattatattgttaaaatgaccaacggttcttttactagttccggttattgcaacttcgcgttccacgagaaagtggcaaagatgcatcattcgggtgaagaatacctcaggcaatgtttctaggctcttcccttcaaacgcgcccaggccacgcgcatctaagaagctgtactcgggtacaatgtggctacaaatcaagcaaccaacacattaatacatgatcacgaattcacaattcaccggccatactatactactactatactagtgtactcgtgtgaagccgtgggctaagagagtgcgattgaagaaacagagataggcggaggcaggcacctgcggttgatctcgttggcggcggcgatgatctcggcggcctggtaggcgcgctgggtgatggagggccatatccagcagtcgtcctcgcaggcgccgaggcgctgcagctcgagcgcggcgcgggcggcctgccgcaggccggcgggggagaggccgctgtccacggaggtcttggagaccgggttggtgcggacgacgccctgcccctcgtacaccgactcccccgcgcgcaccaggaagtagcggttcgccagccgcggcggcggcatgcggaacagcccgcgcgccgaggccgccgccggggcgagcaacgggagcgggagcgggagcgacgcggatagaagcaggagctcgcgtctgcggggacagggcgagagggcggcgcgcggcggtggcggtggcgatggcgccaccggcgaggacgccgcggtagcgggagaggcggcttgcacttgcatttcccttctcctgtacggatccggaggaggaggagctcttgcggtcttgccacctggacggtagtctgaaaatatccacctagtcgggccgggccagctgttgttgcagcccggcccaatagcttctgcttgagttctccactgcgtaacttttgacctttgactttcgaaggattgcctttggactcaccaccaggttcaaccaaacaaattactccctcggtccctccgtttttaatttatttaccacttttaaccatgcatataaacctatataatcaactttttttaagtaaaatgaccaaaataccaacagttttgtgcgacatctagaatttagaagttccatccaaaacccatcaagaacaaaatagcaatcaccaccctgatcagcgcgtcgggataagaatttataaactttattaaaactggtcgaaactcgaaaataatgaaaatgaaaaacggaagtagtgtaatttgaaattttaaattaaaccaaattttaatttactccggtagagtaacatcagatgtaactacggatttgtctatgctcatccttgtccattgttaggtttgcgaatcaaatttgctaccaccatacaagtatacatcacccgatacatcttgagacgaatttcaaacaattagcgtattatttttttaataaatatagtatataacttttggcctttgcaccaactaaaagtgcacagaactcatatttagagacaccgatacatgttttgtgaaaattaacattgactcgtatggttataatatggaaacataactaataaactctgtattaattcaaatatgcttatcaaatccagttattattgaagggagaagtgtgagaggggccatgatagatgaagattaagattatgtaaagcacataaaacaagaaagacattagcatatagctaattaagttttaattattataaacttattttagagcaactttcaaatagaatttttttttcacaaacgtaccatttagcagtttgaaaaacatgctaatggaagccgagatagaatctactccatctgtcccagtatactcgacgttctagcatagttgagccaaatcaagcctaggtgaaaattaccatatagccctaagggtatgctcaggccctgtttagttccaaagtttttttttcaaacttccaactttccatcacatcaaatatttcatacacacacaacttttctatcatatcgtaccaatttcaaccaaactttcaaacttcagtatgaactaaacacaacctcaatgtataatgtctacttgggtaataaggtaggacccaatattagtatatggtaagagaatgcattagcctggattccactgtcccactcgaatatatggcatgtgagagagaagaggagagagaagataaagtattattactttatttttatgggtagacattatgcatatggctagctcatcttaaagactaatatatggactactatcacaatgtataaagggccactttagaggcttaagacccccttctattgctacattatggctgccctaactggagtactagttactttaaatagccatgatgagtagtcattttagataaaaatacaccggccgttcctgccacggtggaatcatggacgagctgatgttcctgattacccggttagtaaaatttgaatcgtactctgctgcgcctgtctcatgtttatgctccttactaaaacgtcaagcattgtgggtcaatggaccacaagaagtaaaacgtcaaatatattgggaaggaggaagtacatcttattgagtagggtgtaagtgtaactgcgtcctctctaagtccaaaaggacaatttctaaggatgaatgcactcatctaaatttgaagtggtttttaactttgtatagtacggatggtgcaagtggataaatataaacaggtgctaattaaaattaagaattttgaaagcaattagagtaatactagtactacctgccaaaaggcgccccaacattgtggctttgcaatcaggcgtgacacggcacgtgccaatggtcaaacaggacgtgaacacatcattttgttgagcccagggcccagcaagccaagagcgtactgtacgttagataagatgggtcaaactctcgtctgacaacgtgattcgctcgctctgttctctgatctcccgcaagctacagtgccaacccaaaaagcaaaactaccccctaccgaagtctaccaaaaagtagtacggttctctgatatctttcattatttttgaaatttgaattactactcctcctacagctaaatttttttttctcacattggagtagtagtacagtactagtatttggtttaggttctttttgtttcgtaaatttctctatacattggaaaatatttggatgggcgccctccggtttgaattgcgaaggaatttgcgagcttcatgtccaggcgtccagctgtccaagcctttatgtacgggggccacctgcccgttgcgcctcatcctcctcaatcaccgttcgactcgctgcttcccctcttcttctcccccaaaccaaaaccctcttgacccttgtcgtctccgcaccgcagccgccgcaggcgaggcgatccacatggcggcggccgacaccgacacgtacgtcaccgaggtggccttcggcgacgccgtgatcaccaccaccgtgacgtcctccggcgccgccgtggaggggtggctccgggaggtccgcgccgcgtacggccccgggctcatcgtggggctcgacgtcgagtggcgccccagctacggccctgcgcagaaccccgtcgcgctgctgcagctctgcgtcgaccgcaggtgcctcatcttccagctcctctacgccgactacgtcccaggctccctccgccgcttcctcgccggcgccgcggactgcttcgtcggtgtcggcgtggacaaggacgccgagcggctgagcgacgaccacggcctcaccgtggcgaacaccgccgaccttcgccccctcgcggcgcagaggctgggccgcccggagctcagccaggccggcctgcaggccgtggtgcgcgccgtcatgggcgccgacctcgtcaagccgcagagggtgaccatgagccgctgggacgcctcctgcctctccaacgagcaaatccggtacgcctgcatcgacgcctacgtctccttcgaggtcggcaggaggctgctccgcgcctgatactgatagatcgtcgatcgaggcggtcgccgtggcacgtaccgcaatcgctcgcatcctctctgcctaattctacctagattagattccagttgctgctgcatttcgctcctgctctctcgtaatgtgttaggctacctagattcagttgttgctgcatttttctcttgctctctcgtgatgttaggcaagggtttatcagatttgaggtgttatgggttttatgtttagtactgaaggaattgaagaatcggatgaaaaaacgttgtgccgatcttctgatctagactatggttaatgaaaatttccagtgccgatcctttatgcgtttttagtgctgtttttttatatctgtgctagatgatactgcttgcagatcgtgtcatcaactggaaatggctcctttgctcaaattgttctacaatggtgtgctagattatccattcattgaattgcctagcaatttggaacatcggttaaaattaggcataatatctttgttttgcttgggttgggtctcttactgtgatagccacttgcatcacattgtgtgcaatgcagttgatgaacatagggtgtgtttagttcacgccaaaattggaagattgattgaaattggaacgatgtgacggaaaagttggaagtttgtgtgtatgtaagttttgatgtgatggaaaagttgaaagtttgaagaaaaagttaggaactaaaccaggccatactacctgcatcctagctagtggtttgttcttctatcagcattttttccttatgaataaaatggtatgccaagccactgaccattaagcattgcatatgaagccccaggcatacttgtagcgcaaatatccagttatccactatataaggcaaatgatgatttataccaaagcattatgcagggctgctaagctgcaagctactcctatttcagacagatctggcaaatgaggtttctgtttgtcggtgacatgggaccgggggtatcatgactagaggcttgaggcagacacaatcgcccacgtggcctggcaccctcgggggacgtcgggcccgagggtgatgtgttcgccctcctcttagtccccccgagggggtcgg

SEQ ID NO: 69258 - DNA, 3334 bp, Oryza sativa
ccacatttattgcggtttggatgagcgtgtcacgccgcatgtaacgcagtgcagtgcactcatttatccggtctgtgaccagtcacagaccggtcaggtcgtgggttaggtggcgacaggcgatctgacgcacgcctcgccccatcccgtcaggacgagggcttctaggcgctcgtccccagctggagctagcgtgttacctcccagagatggcacgttagtcctagtcagatatatgctaggcttcatcctaaccattacaggcaagatgttgtgtgaagaagggcgaacatgcagattgttaaactgacacgtggtggacaagaatgaccgatttgtgaccggtctgacaatggtcatgtcatcagcagacagccatcttcccacgtcgcgcctgcctccggcggaagtggaggtaggtatgggccgtcccgtcagaagatcattcggacaatggcgatgcaaatctccgtccattaataaagaaaagtcaaattggagggagagatggggcatgtggtatccccttgagatataaaaggaggaccttgcccactttgagaggggacgggacttttccagattgggaacccagaacgagggagaggctggctcatactttgtagttccttcatacacgaatccaccaaaacacaggagtagggtattacgcttctcagcggcccgaacctgtatacatcgccggcgtcttgtatggttcctgtctcgcgaaccttccacagattgggagcttagagtctcacccagggtccccggccgaaccggcaaaggggggccagcgcggtctcccggtgaggagccccacgctccgtcatctggcgcgccaggtagggggctctgcgagtgatcttctgagctcttgcactctttcgtgtgcgccaagcttttcctattcagcctcatggctgagcaagcaaaggcgcacgacctctctccgagtgtgagtggcgacgacggggagccgaacccacgccgtcgagctcgtactccaccgccccctccacgccaaagtcctaagcggggggaggcgctcgagagggccgaaggatccgcgacttcgacatccacaggaggtggaaaagagcggcgagatggggagcgtcgtctcctcgtctatggtgacggcagcacgccccagggcgcgctccaagctgcgggcgcgctcctatgtcacccgcccgtcgcccatgacccggagtctccagcccaacgttggctggacgatgtggccaaattggtcatgactgcacggcagcatctagatgctggtgggcggtcctccgccaccaaggcctctggtgctgctaccaccggctccgcgtcgtcaagacgaagggcgcggcgagcggcagccgctgttcgccattcggccaccactccttcgtcgactccttcgacccgggaagatctgcgtggggggccggacgcccgcaccagcatcgagcggcggcgtaatgaccgacgtgctacccacgcaacggagggcgcttcctcgtccagagtgtcacctcaacacggaagcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggagacgacagggtcatggcgaatttctttcccatggccctgaaggggcaggcgcggggttggctaatgaacttgccacccgcgtcagtccactcctgggaggatttgtgccaacagttcaccatgaacttccaaggcacgtatccgcgcccaggtgaggaagcggacttgcacgcagtacagcgaagggacgatgagtcacttcgctcgtacattcagcggttctgtcaagtccgcaacaccataccatgcatccctgcacacgcggtgatttacgcgttcagggggggtgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgccgcttagacagggcggcgtgacaggaggaggaagaagaggtcagtccattccgacgacgagggtcatgtcctcgccgagtcgccgtcgagggcgcttcgcgggccacccaaaaggggaggcctgcgagcgacaaaaagaaaaaggccggcgctcccagcagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaagtccccggcggttccttccggcaatcggcgaagtgaggccaagcagaaggcccctgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgcgaagttggggcgtgtcctcattgatggaggagcagccctcaacatcctttcccccgcagcctttgacgccatcaaggccccggggatgatgctccggccgtcccagccgatcatcggtgtgacgccggggcacacttggccgctaggtcatatcgacctcccggtcaccttcggtggacccgccaacttccgcacggagcgggtgaactttgatgtggcggacctcagtctgccctacaacgcggtcttggggaggcccgcgttggtaaagttcatggcggcggttcactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaaggaggttgccctgggcgacggcccgtccaagaccacacggatcg

SEQ ID NO: 69259 - DNA, 13150 bp, Oryza sativa
  unsure (1)..(13150): unsure at all n locations
ccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaataaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccataggaacttattgttatacaacaatgcccttcgggttaaaaaatgcaggtcctacttttcaacgtactactcgaatttctttgggtagccaaataggacgtaatgttgaggcttatgtcgatgacttggttgtaaagacgcgtaaccaagaaaccttactctcggatctagcggaaacttttgaaagtctccgctccgcccgcataaaactgaaccccgataagtgcgtgttcggtgtacctgcgggcaagcttctcgggtttttggtctctgccagaggcatcgaagccaaccccgagaagatacgagctatagagcggatgcgcccccccagcaagcttagggatgtgcaatgcgtcaccggttgcatggccgccctaagtcggttcatatcgaggctgggggagaaggcgctacccttatttaagctcctcaaacgctccgggccgtttacttggacggaggaagctgagcgtgccctcactcagttgaaggcgtatctcagctctcccccggttctggtcgccccggagccaaatgaacccttactactctacttagcggcgaccccgcaagtggttagtgcggcgttggtcgtggagcgcgatgaggacaatcctcattccgcgcacccccaccctgtgcagacttggcccgggagagagcagggaggagaggcccccgagccgaacggtggcccaaggcccccgacgaccggagttggccctctgcccgcttgtcagacggtgctaggagcccccgacccccaggaaggccctgaggccactgtgggaaggccgtacctatcgccctttgaccccgaggctaaccctgtgctgactcgacccgggaaagagcagggagaagaggcccccgagccgaacggaggtctaaggcccctgacgaccggagttggccctttgcccgcttgtccgacgatgccaggagcccccgacccccaggacggccccgaagccactgtgggaaggccgcccctgttatcctccgaccccgaggtcatcagcacagaagacaagtgcgccccgcgaggctgcttggacgaagagtgccccagggatgcggcccctagcgaagagaatcggccccaccgaaaggtgcagcggcccgtctactttgttagtgaggccctccgggacgccaaaacccgataccctcaggcccagaagatggtttacgctattctgatggcctcgaggaaactgcgccattatttccaggcgcatcgggtcactgtggttacgtcttaccccctcggtcaaatcttgcataatcgagagggtacaggacgggtggtgaaatgggcaatcgaactttctgaattcgatttgcactttgaaccacgccacgctatcaagagccagaccctcgccgattttgtggcagagtggaccccggctcccgagcccgtctcgatccctgaggccagcacggacccctcgcagctgcctcacaccgcccactgggtaatgcagttcgacggctccctgtctcttcagggcgccggtgcgggggtcacgttgacctctccgagtggagacgtcctcagatacttggtccgcctcgactttcgaacgaccaataatatggcagagtacgagggactccttgccggactcagagtggcagctggactggggatccgccgcctcctggtgttaggcgactcccagctggtcgttaaccaagtctgtaaggagtaccggtgctctgacccgtagatggacgcctacgtgcgccaagtacggcgtatggagcgccattttgacgggattgagcttcggcatgtgcccagacgggataacatgatggccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctctcaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaagttcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggtcaagtggagcgcgccaatgcggaaatcctcaaaggccttaaaaccaagactttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgagccaccatgtactgcgaggctgatcagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgatgacctcgtcctacgccgcgtccaaacgcgtgctggattgagcaagctttcaccaatgtggaagggtccgtatcgagtggtcggcgttccccggccgggctccatacggctggccacgggcgacggcactgagctgcctaacccgtggaacatcgaacaccttcgttgcttctacccctgagggggggggtcgggtgtcaggtttcgggctcgggccaaccccgcaccccctcgggcgtgcagggttggccgggggctgccacacatgcacattcttatttctcttatttcagtatttcaataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggggaatcggcaaaaacccacaatcgggtcacccataaccctcggtcaccacgttcccggcctggccagtctcgacatgtggatctccccaggcactagccctgacccgcgccttttgaggactgggacctgggcacgaacccttaatcaagctaagacacaaaaggaccacggcacagatcatcctcatctcatacacacagcaagatgaaattgacacaaaaatttcttcatttttgattacagattaagttgatctatacaaaaaagaggcccgaaggccttagaagaaagaaaagaagaaaaaactgaagaatggtgggggtctgggggctcaatccgatgcgcccgggtcgccggcctcgtcgtcactgtcgtctgcaccaccggcattgccctcctcgtcggagttgggggcgaacgcgagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcaaggatgacttaattgtcttctcgagctcctcgggagccgttggagagccccggccatcttcgagaggcgctgggcgagacctccctggttggcggcgtactttacggtctgccctctccagaggcccacttgccgaccggcgcgatctaggcgggagacggcgtcccaaagcatgccgggccctacctcgcctgccaagcgaagggcttcgacctcctcggcggacgagtctagcgcgccctgcagatcggcgatggtgtgttcggcagccgcgaggcgggcggctaagtcgctttcgcccgcggccgccccgccgctgcgcgccctcgcgtccagctccttcgcccgcgcctcgagctcagcggcccgttggttcagtgcggccctctcggcgcgggcaccttccagattacggcgcgcctgctcctcctgcgctgcctcgcggagggacaggctgtccgccagctgttgcgccgcggcctcggccccctcgagagctcgctcccgctcggtgagcgcgtcctcgcggaggcggagcgcggactcttcttcggcgcaggcagcctcgtgcgccgccagcgttgcttcccggatggtgacggcggcctcgcggtccgccagatccctctccacgacgcaggcgctcttccagcgccatggcgcgcgcctcaagggcctcttcgcgccgccgggacgccgcttcggtctccgccgcccgctgttctcgggcagcggcagcgtcaagcacctcctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcggcgtcgagctccgcccgctctgcctgcagggcctccacctggcacttaacccatccaacaccgtggtgtttgcgacggccaaggcctgcagaaggggctctgcgttcagtggggcgatagaaggcgtggggaagagccgccttggagaggatgccacgcggctcgggccgccgatggaagtgccggactcggggatgttccccggacccggttggtcctgagcgtcgcccgagggagtgggcccaagcgacgtgcccgcagcctcgttgccagctgccccggaagttgtcgcctgagcgtcgcccgagggagtgggcccaagcgacgcgcccgcggcctcgtcgcgagctgcctcggaagtcgccatcgcctcgtcctggcgaaatccggctttctcccgagcggcttcctcggcctggcgggctcgggcggcctcctcccgagcggcttcctcggcctggcgggcccgggcggcctcctcccgagcggtttcctcggcctggcgagcccgggcggcctcctgggcagcctcctcggcttcccgtaggcgatccgcggcctctcgccggtcagattcccgcctccgggcctctgcggccgccggatcctcggcctcagactggccgagcttggaatggcgggagggacgcgacgggatctcgctgaaacaaaagaaaagaccagatgacgaacaagatgggtgagtgaaaactcgcgttgaaagaatgaatacagccacgatgggtgagagacgaacctgcgagggggtcggttaaacgaccactttggaggggaaatgaggtttccccgagatggttctgtctcccccatcttgcggggccgcttcttcttgcgctcccccttgggctgcgatgtcggcgcggccccctccgggcgcctgctgctggcacgcgccgccccgccccctcggggaggagatgggggaggtgatcctccctgcttcctcttcccccgggcatcggcagggcggctgctccccgggcccctgtcgcgggacccagaagcacgaccccctcccggggtagattgttcccccttgcggctcccgcctgcgccgtcgtggccctttggagctcgctcctctgaggccccgaccgctatcataatggtcaggatggaggcgcggtctggatcgctgcagagggggaggattccttggggaatgagggacgcctccacggagttgagattcagcacccgttggaccaatatcttgaagtcctcaggagcccagtcccatctcactccctggtgggtcctcatgaggtcttcggacccggtgtactcccaggcgccccgagcgcgccgctggagcggcgcaatccgacgacggaggtagtcgccgtacaccatggcccctgtgagcccctgggatcgcaggcccgccagacggtcgaggacggcgtcatagccatcccccagatctaccggcgcccgccagctggaagcctgtgccgggggctggctcggaagtcggaggcgcgcttcgtcggcgaggggggtgtagaaccagtcgctcttccagtcgtcccacttcttgcggagggcgcaggggatgtagcggttcagcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccagtatcatcaccgcgttgggggtgaggtgcgccatctagagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcgacgcggcagcccagcctgcctctcgctcacgatgcgggaaggcggcagcacgctaccatcgagcagagcggagccccatgccatggcgccggaggaagaggagattaagagcgagtgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgcttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgtcatgtccagattcgtgtgctactcaagtaatgtggcagtcttgaagagaccgctcattattgacagccgagttaccattgccgatgtgcgtgatttgtgaccgttgggtttctgcccaattgtggagaccggtcccacctgtcaccaggccttaggagtggcgtcacgcccgaccgcttcccttgaggagggcgatcgccctggcataacgccgggggctactgtcggtgacatgggaccgggggtatcatgactagaggcttgaggcagacacaatcgcccacgtggcctggcaccctcgggggacgtcgggcccgagggtgatgtgttcgccctcctcttagtccccccgagggggtcgggccgcacccgcctcgccccgagggccgaggcgccccgacccctcgtcggtctttcctcngngtgcatggcgtgcgtcagnncacggncntcacctaaccacatttattgcggtttggctgagcgtgtcacgccgcatgtaacgcagtgcagtgcactcatttatccggtctgtgaccagtcacagaccggtcaggtcgtgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggattcatcctaaccattacaggcaagatgttgtgtgaagaagggcgaacatgcagattgttaaactgacacgttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaattaaataaacggcgcagacggctccactccacaggcagcttgaccaaggctacacctaatcctccacaccatcagcctcaatgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttataatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacaattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaaattgaattatgacgcaataatgaattatttttgaaaaggaaaaggggatttattgcgtcagcggctagggtttgggtggaccgggcgcacgggcggcggttcacgcgaacggacggccgagattgatccgatccaaatcggacggccgagattgatcgggtccacggcggttcacggcggacggccttgatgacgccagcaatgacgtcaccgacggcggcggcggctcggcgaggcagacgactcgagcggcgcacgctcaccggcgaacggcggcgctacggcacgaacggaggacaccaacgggtagcggacggcacggcgaactcaccgacgaccaaagcgacggcggacgaccaacggacggcgacggcgacgaggttgaaacggcggcggtcttcggcttgacgacggcgacgatgctccggcggtctccgacggcagcgaaagagcggacgaggacggcgacgacttggcgacgacgacggcgaccttcccgagcgacggcgacggctggaacgacggcggcgcacggctggagcggcggcggcgaaggcaaagctagggcacacggcgctagggctactccggcgacgagaggcgaaggcgagggtggcggcgagaagagaagagcacggggatccttttaaaggggctcgggggcggcggcgaaggcccacggcgacggcaacggcgaaggaaactcgcggcttggagagaggaaagccgatccgattcgaactcgaatccatcgatttccaaaccgatttagccgaagtttccaaaggagaaaaggtagaggagatcccggagatcatttcccctctatcaattcagccggaaacggaaaggagcggccggattggaaagcggcggcgacggcagctcggcggcgcgaaactagggtttcggcccgagaaagacgacgggcctgacaggtgggacccacctgtcagcggctgcgagggcgcgcgcgcgcgggcggctgcggactgggccggactgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattaaacttagattttcttttcaagacttttaaaattatttctaaaaattccatttaaacaacaatttatatattttgaattttcagggtgtgacaaacctaccccccttaaacagaatctcgtcctcgagattcggaagaactgacaaacagatacggatgagctgacttcaattcatcttctcgttcccaagttgattcttcttccgagtgattactccactggactttgcaaaatcggataactcgattcctggtccttctctcacttgtttccaagatacggatcggtttctccacataggtcaaatcctcttggacttctatctgttcaagattagcttcttcggtaggtacccttaaacacttcttcaattgcgacacatggaacacattatggactcctgccaaagattgaggtaactctaactgataagcaacctctcctcttctactgacaatcttataaggtcccacaaaacgcggtgccaattttcctttggtctgaaaacgatgaactcctcgtagaggcgtgacacgaagatacacataatctccttcttcaaaactcaaatctctgcggcgattgtcggcataactcttatgacgagattgagccactcgcaatctttcctgaatgatctttaccttttcttctgcttcccttaggatatctgtcccgaaaacctgacgttctcccgtttgatcccacaaaagcggagtgcggcacttccgaccatacagtgcttcgtacggagccatctgaagactagcttgataactgttgttgtacgaaaattctgcataaggtagattcttatcccaacttccaccgaaatctaaagcacaagctctcaacatgtcttccaaaatttgattcaccctttcagtttgtccgtctgtctgcggatgataagcagtactaaagttcagcttagaacccatctcttcttgaagtttcttccaaaaatttgaagtaaactgactgcctcgatcagacactatcttcttagggacaccatgcaaacacacaatccttgccatatacaattccgccaagcgactaccggaataggttgtctttaccggaataaaatgagccactttggtaagtctgtcgactatcacccaaatagagtcatggcccgatgacgttctgggcaaaccagtgataaaatccatacctatttcttcccatttccattcaggaatcttcaaaggttgcaacaaaccggcgggtttctgatgttctgccttgactcgctgacaaacatcacatactgctacgtattctgcgatttcacgcttcatacttacccaccaaaatctttccttaagatcctggtacatcttagtactaccagggtgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacctgatcaattagagtgggcttcgcttctaaggctgcaatgaaacctctaccgacaattc

SEQ ID NO: 69260 - DNA, 1049 bp, Oryza sativa
attatttcttaaatgcaattccatttattaaaaatacttccttagctcaaataaatcccagaaaaatctaggaattatagaattaagcaaagtatttaatgaaattttatctggcccaattttatattggaatttattaattaaacttagattttcttttcaagacttttaaaattatttctaaaaattccatttaaacaacaatttatatattttgaattttcagggtgtgacacacgtggtggacaagaatgaccgatttgtgaccggtctgacaatggtcatgtcatcagcagacagccatcttcctacgtcgcgcctgcctccggcggaagtggaggtaggtatgggccgtcccgtcagaagatcattcggacagtggcgatgcaaatctccgtccattaataaagaaaagtcaaattggagggagagatggggcatgtggtatccccttgagatataaaaggaggaccttgcccactttgagaggggacgggacttttccagattgggaacccagaacgagggagaggctggctcatactttgtagttccttcatacacgaatccaccaaaacacaggagtagggtattacgcttctcagcggcccgaacctgtatacatcgccggcgtcttgtatgcttcctgtctcgcgaaccttccacagattgggagcttagagtctcacccagggtccccggccgaaccggcaaaggggggccagcgcggtctcccggtgaggagccccacgctccgtcactgtttgttgttcactttgctgttgaatgggtctctcctagtagttaagttacctagattgctgttttaagcttcatgctcaggggatacacttaggacatttggaaagcaaatctcctgtgtattattatctaaagagaaggtcagtaatcatgttgtattctcttcatgctactttcccgtatgaaacaagcaaatgactgaattgtatgtgaaagcggaatgattcacgtagcacattggttgcttagagatgcaaatacatgtagcaaggctttagcaaattcaa

SEQ ID NO: 69261 - DNA, 22399 bp, Oryza sativa
aaaggtataatgtagctaagaatgttttcttagtattttcccggtcttggtgtttggtgtagaccagatttgctagataggcgccgtactatcaagaggggtctatgaagcgagcttgtggatgatcttgtgccatattagttcatacgcatgtaggtgcattttgtgggcttgtctaaccaagtgtgatgagttttctcaagtcttaaaccaagagagaagtgggcatgtccaataggagtgagtgacatcttgtgcgtatgtccggtggatatcctttggagtgtgagccctttatccttgacttaagttgtgtttattggatggatttttcatgggttggatggccttttgaataatctttccatagagtccaagaacaccaaattccgagacccgagtcaagagatatcgccgttttactaacggtcggttgagctgaaaagtgacctgcggtctgaccgtgggccttaggccggtctgaccgggtctgttagccggtctgaccggcgtggtaaggccggtctgaccggccccactggtctgttgcactggtctggtttttggtggcgatacagagccgccagagccgcaaccggtcagaccgagccgacggcggtctgaccgagccgtggacggtctgaccggccactacactgcggtcagaccggccagtgtcacgcccggaaattcactagtaatttccgaacttatttgtgcataaaatcctcctccaggaatcagccgaggtacacaaactgacaatttaatatacagattcatcaataactaaagcgaataaatacttacttaagaggcacttagtcctcaacatgaagaaaactgcagcggaaaaataaaatctagcgaagctccggctccactcccacaggcagctcaactggggtataagccaaacgtcttctcctcctggatcctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatctaatctccaaaccaggagctaagcaaattattatcaggtataacatccataactattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacctaaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggtacggttaatgtttcacaacagtagctcgcgaaccggtccttaattgccatgagcacgactctcaaaaccatgtgctcacaacccaccattatcaagttttagttggcaagtaattaattaatcaatcacgattgaccatcgtgaactatcattaagccatcattaaaaaaatagtgagtcataagttatcccaatagtgtgctaatgtttctaagcatggctaagcaatcacatctaatatctagttgaaccaatatatataaagctcaactagtccaattataatcacccaaggtatcaaggaataaagtaatcgagaacaaaagggccataacaaagagtaggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgcactcgcgaaccttcgcaacgacggaaacgacaagctaacacgcaaaacgaagaaaaagactaataaaaaccaaataaacaatacatgaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggagaagggacgataacgccagcgatgacgtcaccgacagcggcggcggctcggcggagcggacagctcgggcggcgcacgctcgccggcgaacggcggcacttcggcacaaacggagggcaccagcacgtagaggacgacgcggcgaactcaccggtgaccaaaacggcggcggcgacgaggaggaagcggcgaagctcttcgggtcgacgacggcgacggcgctccgacggtcttcggcggcggcgaagcggtggacggggacggcgacgacttggcgaaccgatggtggcaacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaaaaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaagaaaacggcgacggcggcgcgctagggtttcaggcggcagcggcggctcgaggaagacgaacctgacaagcggggcccacctgtcagcggctgagagagagaggagagcggcggctcggcggactgggccggctgggccgagggaaagagagaaagaggttttgggccgactttcggcccaaagccaaaagaagactttttaaaacctttttcaattaaattatttcttaaatgcaattccatttattaaaaatacttccttagctcaaataattcccagaaaaatctaggaattatagaattaagcaaagtatttaatgaaattttatctggcccctttttatattgagatttagcaaattaaaattagatcttctcttttaggcttttaaaatcatttctaataattccttttaaacaacaatttataagttaaggatttttaaacaagaaaagctcttaacaattatacttagatcattaatgatcaaataattactgaactgttctttgtattatttaagaattgagctctgaaaaatccgagaaaatttcagagagttgacttaaccatggagaatttaataaaaattaaatccatccatgctttagatttaagaaaattttatttcccacattttacttcacttgtaaattaaagatcatttaatataaattccaataataatttattaaataatttataaatcctaaaacgaaaatcaggatgtgacagccaggttgagtgggctcaatgattgccctgtaacggctagttttctaaccgttacaaagtagtccggtctgaccggcctcacaacggcggtctgaccggtagagcacaaagttggggatttcggttccaacggctagttttggtggttgggggtatatatacccactccccagcagcaagggtaaggttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgccacctcctagacggcttgtggaggtgttgcccagtgacctctccgaggagattgtggaggaggcccggcaccgtttgtgagtggtttggagttcaccaccttcggagtgaaggaagaactacctcgagtgatcgaggcttgggtagtcctctccgtgggccagctcccgccttgcccaccccttgacgaagggggcgtgcggtggcttcgtggttgagcagtggaattgggctcgtctcaacggggattaggaaaccggcgaatttccgaacctcggtgaaaaaattccttgtctcttgtctcatttatttgttgcatttacatttgtgctatttacattcatagagacatatttgagcccatatcacttaggtttgcaaaacttaacttagttgcttagttaaccttgcacctcaccttgcctagcaacttaggttagttttgtttaagtgccattaagttttaaaaccgcctattcacccccctctagtcggcctccttgatcctacacttgcctcttgctctggcatgcgtggggcgtaccgttaatgagctaactggcccgagatatgtgattaaaacttaaaagttctgcataacgtattaccttttctcttcccttttcctatttagaacgtgaaaatattccgacgtgatactacgagcgtctttgcatcataacgctctatctcttgtccctttgctctggtatgtgtggggcatgccgtcagttgctttggtatgcgtgagacataccatgagctgctccgttgtgtgtgggacacaccgttagttgctctgttatgcgtaggacacaccctcagttgctccgttatatgcagaaacactatgagttgctctattatgtgtaagacaccgtcgattactctgttatgtgtggcacacaccatcggttgttccgttacgtgtgggacacaacgtcaataagctaaccaggacactggcccaagaaacgtgactaacatcactatctgccagctaggttccaccggtcagtcgaggcttaaataggaagctacatctcacggtttccaatgtagtacaacgagtgcatttatgccttgtaacgctctgtctcgcgtggaacacaccgtcaatgagccaactgacctagtatgtgactaaaacttagaaagttctacacattgttctaccttttctcttcccctttttccttttgtaaaacatgaacgtacttcgatgtagtactatgactacctttgtgccttgtaacaccgtttctcttgtctcttgctctagtatgcgtagggcgcaccgtcaatgagctatctcttgtctcttgctctggcatgcgtggggcgcaccgtcaatgagctaactggcctaagatatctcactaaaacttaaaaattcatgcataactattatcttttctctttctttttcctatttagaacgtgaaaatatttcggcgtgatactacgagcgtctttgcgtcataacgctctacacttgtctttttgctccagtatgtgtgggagacataccgtgagttgctccgttgtgtgtgggacacaccgtcagttgctccgttatacgcggacacattgttagttgctccgttatgtgtaagacacaccatcgattactccgttaaatgtggcacacaccgtcggttgttccattatgtgtgggacacaacatcaataagctaagacacactgctagttgctctgttatgtgtaagacacaccgtcgattacttcgttaaatgttgcaccatagtagaaaaaaccggactggtcaccgaaccgtccggacgtctaggtcacgggtcgaacggttggaccgccgggtcaaccggttcaagtgcaggtgaaaaaccgttatttactcatgtactcatttcaaacacaatatatgcgttgctcttttggctagaaaagtttgcgatctccccagagatccacgttcgaatcccatgcgcactagattaagtgctatttttggctgttgggccgcaaattactggattgggccttgatttggcccataattttgtgttaccaggctgggcatgccggttattttcccctccagtctttttgcacgaatagaccggccacatcgctggttccgatttttcacgatcgaaccgccgacttggtccggttttttgcactaggtgtggcacacaccgtcggttgttccgttacgtgtagaatacaacgtcaataagctaaccagcccactggcccaagaaacgtgactaccatcactgtctgctagctaggttccaccaatcagtcgaggcttaaataggaagctacacctcggggtttccaatgaagtacattgagtgtctttatgctttacaacgctttatctcgcgtgggacacaccgtcaatgagccaactgacccagtatgtgactaaacttggaaagttctgcacatcgtcctaccttttctcttcccatttttccttttgtaaaacgttgaacgtacttcgatgtagtacaatgactgacttcgtgccttgtaacaccgtttctcttgtctcttactctggtatgcgtagggcgcaccgtcaatgagctaactggcctaagatatctcactaaaacttaaaaagtcatgcataacgtattaccttttctcttcctttttcctatttagaacgtgaaaatatttcggcgtgatactacgagcgtctttgcgtcataacgctctatctcttgtctttttgctccggtatgtgtgggtgatgtaccgagagttgctctgttgtgtgtgggacacaccgtcagttgatctattatacgcggacacattgttagttgctccgttttgtgtaagacacaccgtcgattactccgttaaatgtggcacacaccgtcggttgttacattatgtgtgggacacaatgtcaataagtgtgtgggacacaacgtcaataagctaagacacactttcagtttctctgttatatgtaagacacatcgtcgattactccattaaatgtggcacacaccatcggttgttccgttacgtgtgggacacaacgtcaataagctaaccagcccaccggcccaagaaacgtgactaccatcactgtctgccagctaggttccaccagtcagtcgaggcttaaataggaagctacacctcggggttttcaatgtagtacaatgaatgtctttatgccttgtaacgctttatctcgcgtgggacacaccgacaatgagccaattgacacagtatgtgactaaacttggaaagttttgcacatcgtcataccttttattttcctcttttcccttttgtaaaacatgaatgtacttagatgtagtactatgactgtctttgtgacttgtaacaccatttctcttgattcttactctggtatatgtagggcgcaccgtcaatgagctatgtcttgtctcttgctctggcatgcgtgaggcgcaccgtgagttgctccgttatgtgtaagacacaccgtcaattactctgttaaatgtgacacacaccgtcgattgctccgttatgtgtaggacacacagttaattactccattaaatgtggcacacaccgtcggttgttccgttatgtgtaggacatagcgtcaataagctaagacatactgttagttgctccgttatgtgtaagacacacagtcgattacaccgttaaatgtggcacacaccgttagttgttccgttacgtgtgggacacaacatcaataagctaaccagcccatcggcccaagtaacgtgactaacatcattgtctaccagataggttccactggtaagtcgaggcttaaatcagaagctatacctcggggtttccaatgtagtaaaacgctctatctcgcatgggacacatcgtcaatgagccaactgacccagtatgtgactaaaacttggaaagttctgcacatcgtccaaaaccttttgtcttcccctttttccttttgtaaaatgtaaacgtacttcgatgtagtactatgaccgcctttgtgccttgtaatgtcgtttctcttgtctcttactatggtatgcgtagggcaaatcgtcaatgagctatctattgtctcttgctctagcatgcgtggggcacaccgtcaatgagctaactggcctaagatatctgactaaaacttaaaaagtcatgcgtaacatattaccttttctcttcttttttccaatttagaacgtgaaaatatttaggcgtgatactacgggcatctttgcatcataacgctccatctcttgtctttttgctccggtatgtgtgggagacgtaccgtgaattgctccgttatgtgtaagacacacaatcaattactctgttaaatgtggcacacaccgtcggttgttccgttatgtgtgggaaacaacgtcaataagctaactggcaccaccagcccaagaaacgtgactaacagcacagtctaccagctggtttccaccggtcagtcgaggcttaaataggaagctataccttgggtttctcacctccatcagttccatctcatctcatggcttatccgtcttgccgcgtgtggtcggatggcctcccgcgaggggcgcgcggcccgcgagctgcagccggccggcccacgagctgcagtcggcgagctccgcggggcgcgcattgaggggtggcgcggctggcgagcttcggctggcatggatcgaatggcggcacggacggcgagcactggtgggcgcggatcgagggcgtggcggcgagttcagacgggcgtgaatcggagggcagtgtggccgatgcgtgcagtgagcagtgagctccgagtctctgaccagctgcaggaaggaacaagaagagcgaggacgtatgccgacgcagaggaacggcgtagaggacacgacctccacggcacggtcgcgacgctctttccccatgccccacaccctcgatcccgtcgaagaacgcgtgactttctttggccactcgggcttcagatttgtgggcccagacacactcgtggtaagtggtaacaactctctcggattctccggcgtggagcgtttgggcagaacgccagcacatcgcactcgtgactaacatcactctctgccaggtgggttccaccggtcagtggaggtttaaataggcagctacgcgtcggggttcctcacctccaccatttccatctcatctaatggctcgtccatctcgccgcgcgtggtcggatggcctcccacccgagctactcgccataattgtcatgcagctcaactgccttgccgaccgcgcctgcttctcctttttccttttgtaaaacatgaacgtacttcgatgtagtactatgactaccattgtgccttgtaacaccgtttctcttgtctcttgctctggtatgcgtagggcgcaccgtcaatgagttatctcttatctcttgctctggcatgcgtggggcacaccatcaatgagctcttgtcatgcataatgtattaccttttctctcctttttcctatttagaacgtgaaaatatttcggcatgatactacaagcgtttttgcgtcataacgctctagctcttgtctttttgctccagtatgtgtgggagacgtaccgtgagttgctccgttgtgtgtgggacacaccgtcagttgctccgttatacgcggacacactgtcagttgctccgttatgtgtaagacacaacatcgattactccgttaaatgtggcacacatcgtcgtttgttccattatgtgtgggacacaacgtcaataagctaagacacactgctatttgctccgttatgtgtaagacacatcgtcgattactctgttaaatgtggcacacaccgtcggttgttccattatgtgtagcacacaacgtcaataagctaaccagcccaccggcccaagaaacgtgactaccatcaccgtctgccagctaggttccaccagtcagtcgaggcttaaataggaagctacacctcggggtttccaatgtagtacattgagtgtctttatgctttacaacgctttatctcgcgtgggacacaccgtcaatgagccaactgacccagtatgtgactaaacttggaaagttctgcacatcgtcctaccttttctcttcccctttttccttttgtaaaatgtgagcgtacttcgatgtagtacaatgactgcctttgtgccttgtaacaccgtttctcttgtctctcactctggtatgcgtagggcgcaccgtcaattagctaactggcctaagatatctcactaaaacttaaaaagtcatgcataacgtattaccttttctcttccttttccctatttagaacgtgaaaatatttcggcgtgatactacgagcgtctttgcgtcataatgctctatctcttttcttttttgctccggtatgtgtgggagatgtaccgagagttgctccgttgtgtgtgggacacaccgtcagttgctccgttatacgcgggcacactgttagttgctccattttgtgtaagacacaccgtcgattattccgttaaatgtggcacacaccgtcgattgttccattatgtgtgggacacaacgtcaataagctaagacacactatcagttgctcagttatgtgtaagacacatcatcgattactccgttaaatgtggcacacaccgtcggttgttccgttacgtatgggacacaacgtcaataagctaaccaacccaccggcccaagaaacgtgactaccatcaacgtctgctagctaggttccaccagtcagtttagtatgtgactaaacttggaaagttttgcatatcgtcatcgagctccgcggggtgcgtatcgaggggtggcgtggctggcgagcttcggctagcgtggatcggatagcggcacggacggcgagctctggtgcgcgcagatcaagaggtggcaaggcggcgagttccgacgggcgtgaatcagagagcggtgtggccgatgcgtgcagtcgccgatgcagaggaacgactagaggacacgacatccacagcgcggtcgcatcactcctttcccacgccccacgccctcgaagacatcgaagaacgtgtgatttgtgggcccagacgcacttgtggtaagtggtaacaactctctcggattctccggcgtggagagtttgggcagaacaccagcgcatcgcacttgagactaacggcactctctgccagctgggttccaccgtttcgtcgaggtttaaataggaaggtacgcctcgaggtttctcacctccaccggttccatctcatctcatggcttgtccgtctcgccgcgcgtggtcggatggcctcccgcccgagctactcgccataatcgtcctgcagctcaactgccttgccgaccgcgcctgcttctcggccgtctgccgcgcgtggcgtgacgcggcgccctacgccgacgccccgcagcgcggtgtcccgtggctcctcctcccggcccgcgacgcgccgtccttcttcagcctccactctggcgccacgcgccgcatgcgcctccccgatggcgtccgcggcacgcgcttctgcggcgtccacgacggtggctgggccgcggtcgccgccgatacgtggcgaggcttcgcggtcgtcaacctcttcaccggcgtgaggctccccctcccggagaagctgagggtcgaggtcccccccggcggcaaccacgaccagttcgcgttggccgccggcttcacccgccaccacatgctcatccgcaccgtcgtcttctcctgccctcccacctcgccgtactgcatcgccgccgcgcacgtgtccagcgcctccaacatcgccttctgccagccggcgtcgctgtccaccagctggaccgcgtaccggcgcgacatggacatcatccaggacctcatcttccacaggggagcgctgctgcagggcttccacgtcctcaccaacaaggaggaggtcctggtgtacgcgcccacggcgccccaccgccccggcgcgccgctgaagctcgcctgcacccgctactcgctgcggccccgcgacgactaccagcccgacgacgccctgccgccgacgttcatcgcgacccgctacctcgccgagtcccgcgggaagctgctcatggtgctgcgccactacaccggcaaccccgtcgtgcggcgccgcacccgcatgttccggatcttcgagctgacgttcggcgagccggcggagcccaggcgcgccgccaccccgtgctggtgggtggagatccccgagctgaccggccgcgcgctcttcctcggccgcagctgctccaggtccgtcgatgtggcgcagttccccatgctccaggaggacaccatctacttcctcgacgacgcgaacctcgacctgtccatggtgctcaacaacgggagcacgtactgcaacgtcgacatgggcatgtacaggaagggcgagaagatcaggcctggcgctcgccaattcccccgtgaattcactgcagactgctcgcctccgatctggctcgtcccctgattattcagtgggtattccagcgtgttactgcctgtcgtttgggatttactccattaataaatcgctggcagttctgtagggtttcagaaaaatgaaaaatgtatcttgacatgttgtaatcagggtttcatttaccgccggggccgcggttaccgcgccccggcggtaagcacggttaccgcacggtaaccgcggtaaccgtgacaaaccgcgacaaaccgtacaaaatttatcaaaaattcaaattatttttcaaatttatttgaatttgacgcggttaccgcggtttaccccttaccgtacccccgcggtaagcgcggtaaccgcggtaaccgcgcggtttaccgcggtaaatgcaaccctggttgtaatcaccaatgaaatcctcgtcgtgtcattgatgctcaattttgttgtcccttcagatattatacttgtcaagaatttgttcagcttttagatttagacttccaggtaatgggattcaatgttccaagtagaacatgttcaagcaattacagcaaggtgcacggaggattaacagcaaacatacacacaagtgacagagaacaaggtgaagcatggcgtgtacttgtatacgcatactttgacacacacgtcatgcataatgccactactatgctagcgaaaggtaagaggcatgcaagatgcagacgctcatgtctgacgtccctgctcataaaccaccagctggtgactgcagtccccactagcagccgaaactgaacccaggtaaagcgcatgaacggctacggctgcatgagatagaaagaggaaacggccaagccaaagccgtcgtgatcaccaggccagagaggcggccgcgccgcgcccacgggagtcggtgggtctagcccacgaatgtttgcgtctcgcgttcacagtcagatacgttcatctcccagtactttatagacttttctagttacaaaaacaaatcgctgaatgctttttttatttcctaaaaaaacccggagtctggtgatgattagatttgtttttgatttgtactaaaaattttacactaaattttttaactgcaaatataattcatactataaagtttataaataaaaaacatatttatgtaaagtttgtagcataaagtctatataaaaagtttatatataaaaaagaatatatgtagaaagtttccatgaaaataactcatataaaaatgtttccactaaaaaggctacagagaaatactataacgaaaaaaataaattcggaaaagaaaaggattgagaaaaatagaaagactgatacataatgtactagagaatcacgcaaaggaaaatagcggaaaatcgaaaagaatcacataaaaaaggaaaaatgggaaattaaaaacgggagaaagatactgcaacgacgcgacgcaccaatatcgcatcgctacgtctctcatcctcccctatcctaatctatttgcctgatgtattagtggcgaacgtttgccgaataaccttttcggaaatgggttcatcctccattttaacaaaacgttcaaattaggtcccataaaaatatcgatggctgctttaattggtgaacatgtcatcttacaaatcctactattataaaaatacgaggcgtttttggcacatcgcactagtagaaaaattgcttttgcaaatgggctaaaaatatttttctaggcggagctccacgccgccggtactttaaggcatacaaaaatatacgattttttttacatgcggacattggccccgcccgctaaaatcacattcgcaggtgagcctctaaatcttcataggcattacattcacccgcctgcaaaaacaatcctaccgaataaaagaaaatcgcttgctaccactcccacccgctgccccctccccctccaatcgtcggctctcctccctctcctccttcgtccgccgccaccgtcggctggctcccctccttcgaccgaatctgggagggagggaggaaggggagtgccgcctccgccgctagccgactcccctcctccggccgaatctggtgagagggaggagagagagcgagctgctggctctccttctccatccaccgccgctgccatccggctcccttcctccggctagatttgggagggagggagggaggggaggggcgccgcctctactgctaccgccggctcctcctccgtccgccaccgccagccagctcccctcctccggctgaatctaggagggagggagggaccgcctccaccgctgccgccggctcctccttcgttcgccggcgccgccgactcccctcatctggccagatctaggagggaggggagaggtaagcgtcgtcggctacaatggcccccgcctccgccctccgcaccaccggctgggagaggagagcaagtgaggggggaggaggggaaaggtgagggagtgaagggagaggtggagggttatgggtggaggagcgaggacttagtgggtgaaggataggaagtgggtagcgcgtggatggcggatttttgcaggcggaggacttaaggtccccgcctgcgaaataggcgggactagctttatggtatcatgaactacttttacaaatgatgattttataatccgtctgaaaaaataaaatcgtaacattgccaaaaaaaatcaattttttacccaggtgcatgtactaattcctgcgcgagttagctctgtctcacacagcttcgcgcgcacaacttgtttaatttagagtaaagtccatcactggtccctaaacttgtaccgttgtgtcatcccgatccctaaactcgcaaatcgatcgttcaggtcctcaaacttgttcgactgtgtcatcccggtccctaaacttgtagatcactcgtttaggtcctccaacttgttcggttgtggcaccacgatccctaaacttggatttgaatatcatctgggtcaaataggacggtctaaagactttatatttaaaaataattcataactttttcatgtgaactctaatgaagacaaactttatatcaaacttgtagcactcgacgcgatctacaactttgtagttgaatttttttttattttaagtcattttttgtcccaaaatgtaattttaaaattaaaattttaaaatctataaacatgcaacaatattttaggaccctaaacagttttaattcaaaaacttttcaactacagagttgtaggtcgcgtcgaaggctacaattttgatataaagtttgtcttcattagagttcacgtcgaaggctacaattttgatataaagtttgtcttcattagagttcacatgaaaaatttatgaattattttttgatataaagtttttagaccatcctgtctagggaccggggtgacacaactgaacaagtttagggaccggtgatggactttactctttaatttacccagtgagcacaataaaccccgcagcggcatcgtcctcgatcggctcgccacgatgacacttcgatgctttaggcttaaatagtaatatgcacgtgctaacgctacaatgacatttgactttaaaagacaatacatgttttgacaatcaagcaaagaatgatgtaaaaacaacaaactttacaatctaaacatgactaatagcatgaattagtatgtatacaatgcgaggaaggtaaatgttatttttcctcattctgatacatagagtttaagtttaatttgtccaaaatttctctcgtgtttagacttttgtttacaacttatgtagggcctaccccctattaaaaaaaataacacccattatctttctcatgcagcacgcttctccttccgctctcctcccccagcttgcgatatcagagcatccatcaaattcaaccgaaaccagcaacctccaccagacctgaccactcttaaccgctagttggtaatgtatatgagaacatttatcaaaactatcacttaatagatcttaagaaaacaatattttgcataagctggtgcgcaaaataaaaagcaacttcgtcggttctcctcttcctcctccgtccgtcgctgccgtcggttggctccccttcttcgaccgaatctgggtgggagggaggaaggggagcgccgcctccgccgccaaccggctcccctcctccggccggatctggagggagggaggggagagagcgagccaccggctctcctcctccatccaccgccgccgcagccagctcccttcccccggctagatctaggagggagggagagggaggggtggggcgccgcctccaccactgccgtcggctcctactccgtccggtgtcgccaaccagctccccttctccggccgaatctgggatagaccttaagaaaacaatattttgcataagctggtgcgcaaaataaggagcaacttgaacagccaatagagcaactcacataaaacactactaatgcaacgctaggaggggaaattttcccggaagtagtgttgatcactggtcgaaggccaactgcatcctgaatttattcacacgctaaaagaacagaacatcacatttatatgcctttaacagcaacaattttacctagtatcctttgctgctaacttctcccagaccatgcgcctgatatgcttgtttaaatgtatgtcctccaaaacagtagcagctctttgaacaactacactcaaaaggttagtaaatatttaggcatcatgatcatctttatgtagacaacctagagcaatatgccatctagtttcactgtacagctccgagaaccatccatattacaaatggaacttctaagtaaatattaaatattatgtcgacttcatacattcatgaaacactcaggcaatacaggctaaatgattggtatctttttaaatgtgtacagatattacaattgcaatcatacttggcacattaaaggtttatttttttgtgtcgattggatctttcaaatagtaatcaaagttaatgaagacaacctgatcacctcttagttagaccatgaaatcagtaaaaccctccactccaaaactcatgaatgcttagaggtacaccctatgcatgggttatgtatatgttgtgtttctggtggtgacctaaattagtttcagattacaccttcagccaaccttgagcttggacaagtccaagatcagcttttctatagacttcgctcgctacaatttagaataagagtaaaataatggtctgctgaacttctgaaaattagcaaaacttctgataattgaaaagacactgctaagacatctattttcagttatctatttagagggtagagaggtattgcaaattaaaaaatatatgagcctaaagcattttaacccaaattatatatcaatgtaactcagtaacaagcttgcaagaatgaagcatttaatagcaaaccataagaaattatttatttgaactgaaagccttagacttttacatgaaaacaacatacataaatttcaaacaggagatgcacacagaggaaacaatattagataatatatattcatggatccatatatttggaagtactttttttaccaccgtattcagataataccagatcggactttacgctgaatggcaatgtgacatacatcagaagtgtttttcaccagagttctcagttctacaacgatattaaatttagaaaagaaagcaaaccaccaaaatagttcgccaaagatcaagttaattttatcgaaaccaaacatgactgatgcgatgctaatgtaaaccggctaattgcaaaaaaaaaatgaagtagcagtgtttcagtttagagtaaggaatggtacgtcttctatctggtactgcagcaatagaaagctagtaagctagcactgatcatttcatctgttaatcatgatatgtacataattattcacatggttggcatatatgcatattttgttgctagtttggaacccatttgttatcatacatatttttttatatctttctgaaaatgagtataaaatgacacgcaattcaattttgcatgtaactatttattattaatgaacctgaaccatcaacatatttttgttgctgtacaactgggatatttaatgcttaaatttttacattttggtaggatgtattcttttctatgtgctcttaaattgaaaaaaaaaatgcacactcaaaaactgaaaaatacataagaggctttaaacactccattatagaacatgttgatcacattttagtccatactcacaacagattaaggttttccagcttttgaggcataattacattattacataaatggataaacatgtactgttaaatccaatcttgcagctaggccatatgttcttaagaaattatatatagactatacatagttatcatatatgacatgcacagagaaccgataagaactgttaaaatggtaaatttgtcccattgagacagaagaaacaaatataactgaaaagtggaggccttgtgcatctgcaagaattgggcgaataaatgataggactgtccattcatagatgcgaagcacaggctttttgggtagtttatgccaatgcattcaagacttcaagcacctaatagcaatatatcttaatatatgaaagttgaacccccaaaatgcaaaattacagcgccatgtcatgcaggaaatatggaccgtccaattttttgctcagaatgtcaagagccatcggatcctttaatcagagaaatctcttcccggtacttcaagaaccttctttgtaaaaagaatccttccatgtccgtgggaggcagggaccccaagccaagccaagcgcctctcctgcctgtcacctcatggactccgcatctgccgccacctccctccaccttgctgccaccatcgggtcgtcctcctccccataccgagcgccaccactggaccatcttcctcccatgcaatgcgccgctagaatctcctcctcccaatgtccagtggcgagatcctctcggatcccaaacgatgggagtgaatcgcctcctcatccgcatccctactgccatctcctcacttccaatgcccatcaccggagccaccacatccatctacccagatccatcaatcctgcactaccttctctagctagactaaattctttttctggagtgaaattaagctgaggtatttacttcttaatacttgggccttcattctctacattttatagatcgtgaccggtagatgaaaagtttcaaggaaccctataatacatataaatacattgctgaatatgatagtgcaaatcaacaccacgagtttctattttcttactgacataactactgcttagcatgttgttcttcaacttttcagggtgctgaaacattctcatcatttacccttttttttaggaaatattatataaataatctcagctggctgaccaaagcttgaaatttactttcgaattgctttcaactacaaaacataaaaacaaactgaaatcaccatgattgtgtggagcattataggacgagattgggtggaatgcagacagatttataaaactgaaacaataacatatcagaatatagtagaaaatttatgtcttcgtgatattgggtcaaagtaccagagaaagtgagtaacattaatttgttttcgcagagtgccaaaagagctaccaatttaattattgatggcctgagaaagtattaacttagtcttaaacatcatatattcgtagttgcacttatactgctccacgctaccacttaatgcttatactaagttaactctttgacaagtagtgctactgtaactggtagacaacccaaaaggtctacaactgaagtcaagttgcagttgcacttcagttgtaataagccatggtagatctccagttattgaaatcttattgccttattggttttaaagaaagatcaagtaaacttggagcaccataaaaaaaatccatatcgaatatactgtaatctatagaagtcctaaaagaaatcattatttacttaaaatatggttcgaacatgcaggcaataatcatactgatttttaggtgaaatgttacatgccacagctactttgtggcattgatcattgccatagtcatcacattattcaccgcaatattaatgcttccaatcttttgagtgacaaccgaggcatattgaaaatagccgattttggcctagcaagtttctttgatcctgaacaaatgtcggttcatcgattagatcatcagaaagaagattcccattttgttgatggttgatgaatgcaaagcatattaagaagcacaagttaagattataaggccactaggaaaggaagtgctccttatgaatcttcgacttatgttgttgatatttcgtaatgcaataaactaattctgtttaggcgcacacagttccgatatgcggctgtgacagcacatattcagagtatcaagacatccaaatttgcaataaaagcatttggtacttcagcccctatcagtattctttctcatgtctgtgttcctgcccttttttttacttccgccccaatcaatattttttctcttacgtcttggtaaataaaagcatttgcaaagaaaaaaaatcccaagttctgttccaattaagcttaaatttttttcaaggatttatgaatgatcccatactcggagtcaatgctttggtccttgcctggttggattgtaaacgtgatttttttcaccaacagaggtgcttgaataatcatatacaaggggccgtgtttttattgtcgtactttgggaaccaaaagtaaaaggttgatcatcattttctgtatatgataagtgaaagcatctagcagagaaagaggttatagtcgtgcgaatgcccgacttatttaactagtatatcaatgatagtaccatcaagagagatgtacacaatatcgtaccaagaattaacgattgttatttctaaaatgtgatttaattttcccaaaccagtaggccaaacttgtagttgggctcatattggtatgtgcaagtgtgcaacatatatggtctctctcttcaggtacctagctccctagtgttgacaataagcttagtaatcagtacaggtatcttgagcgttgattttctctcatgattcaggtcatccagtaaagaatccaaagtggcaaggttgaaactttaaaagaaattctcaccttatcctcaggaacacttttgcagaggttggtcactaccatttgctccatcttttttttttgccaacctaaacacctcaataaggactgacagtcttgacgtctttgccatttttcaaaatctagtaatcatcaattcattatttcagtgcaagcgtgaactgcatattagatggataccttgtttcttatctgaactaaatcaattgacagatccactatcaggagctagaacctaaaagatcatacgcaccatagctttcgatgttaacttctccaatcaaaggagattttgggggaagctcaggtgg

SEQ ID NO: 69262 - DNA, 2852 bp, Oryza sativa
ttgcaacctgagggtcgcctgtgcggtggatctgagatatgctgcggcggccgtgctcggtcagccggagcttgcgagggcggggctgaagagactggcgctcacggtgatgggcgcccacatggagaaggagaaaaacattacgaagagcagatggggtgagccgacgctgacgtgggagcaggtcaactacgcctgcatcgacgcatacgtgtcctatgagattggccggcggctgctctctggtgaacctatactggccgctccgttgtaggtacatacacgcagggcgaacttgccaccggtgcaatgtttagttcgaatataaattatagagataagtacgatttagagatggaattctaaaagtaaaatagagtcccaaattctagagataaatcaactataacttatccattcttggtctgtcgacacctttcacgtgtgccctgtaatgtaatatcaatcctataatcttcctgagtgtcatatcaatttgctaccaacctatcttagattatttttagtgatgtttatcaatagatcaatttcctttttagccaaccctcgactcttctctattcggagatgtatccgtgttgcttcctttttcatcaacgcagttttgagcacacgagtataacatattgatttggaataaatctcaaattctcaatccaggtatgtatatataccaatattgtgtgagaactcccgtcgggtacagtggtgactacgtggtgagcacactacgtggttcaagtgtctctccttcttttagcttgtgggcatatacaaatttatcatctgatattatataggccgtgcactgtctatttaccacaaagaaaattcgcaatgtcccccctcttcttcacttctataatcgggttgcattgaattgcagtgtctatgtttttttgacgctcggtactcatcaattcaccttctgctgtccctaatctcaaatttaactaatcgagttgagtttgatagggagtgcgggttgagagacatgggtgctagtgtgctactactaaagtgagctagctagtttgtactgtagtacattccacaaagggccgtgtgatctttcaccttttgatgtttggaccacttggccatgaatgctccggtctaaggtgcggtcaaagaatccacgttagattcgagcaaatgcggaggagagatataaatgatccactctaacgtgtggtcaaaaaatcaacgtcatattcgagccaaggtggaggagagatatgaatgctccactctaacatgtggtcaaagaatccacgttagattcaagccagggtggaggagagatggaagaaaaggggtggcctctacaagcttgtgaattgcgtgtattatgcaagacaaggtttcctcacgctagaaaaaaagtatctgcacgaggtccaaccccccccccccacacccccaaagcatgcacaaatacgaccattgaaaacttcggagcgacgtaccagactagagtgtcactgggatggtcgttgcctcaccggggaagcttcgccgacccccaacgccccgatccatgctgcctagaagccccaccaccacgtgcaaccatgaagcccaccagccctcgacaccactcgccgtcttggttggaatcttcatcggcctaggggccctaatctgtgccgcccaaagttctacgggcccaacatgctctaatccatgctgcccgaagctccgttggtcatcgtcccctgatctgtgctaagcgaggtggatctggaggagcagttgtgcccgtctttgctcttccgcgaaggagcaacgacgatggacacatgaggtcactgacagagtcccgtgtgtcccattgaagcagccaaaaccaggataagttgtagcagacgcacaaagaggagtcaaatgtcaccgttaggagaacgctggagagccgtcgccacagtcggggggagagcagaggttggggtagagtatggaaagtaaggaggggaaaggggagagacaatcaaataatgaagggattttatattatttttggattttagggtgtttagtgtaaaattttgaactttctttctttagagttttctatatgcacaatttcttgatgtttcggcgaatatttactctttcctgtcttatttgttaattcataacctgatctaaatttagaaaacacgaggattaaaatagaaaatattagagactgcacaaaaagttaaagacacaacttaaagctacctggaagagatttttttgatgtggccttgtcctagtctgcaactctgcatgttgtgcacccaccattatttatgacctaatgcttccgaaaagtctcttcagctggtccaagcttggtaattgtaaatgggccatgctggaaacatagccgaaaagaaagctacgagcccgtccacgatttgagtgactaaaaccgtgctaagactgtaaatacaatggcctaaagaactagtatgaatatgcgacggaacacattgaacatagaattcaaaggaactaagcgaggtggatctggaggagcagttgtgcccgcctttgcttttccgcgaaggagcaacgacgatggacacatgaggtcactgacagagtcctgtgtgtcccattgaagcagccaaagccaggataagttgtagcagacgcacaaagaggagtcgaatgtcaccgttaggagaacgctggagagccgtcgccacagtcggggggagagcagaggttggggtagagtatggaaagtaaggaggggaaaggggatagactatcaaataatgaagggattttatattagttttggattttagagtgtttagtgtaaaattttgaacttt

SEQ ID NO: 69263 - DNA, 4593 bp, Oryza sativa
gcatcccctagcacaagagagagatgaagagaggggaggagagagaggaagcagaagaggaggggtgagttagagtgacatgtggggtagcgtgggtcccaccatcattattattatttttgtgtgtgaaactgatatgtgggtcctatggggtttattattttcccggatcaaattgccacgtaagcgccacgtcataccacgtcagatcgagaccgagtcaaaattagccacgcagacgccacgtcagtcaaaaccgccatcgaaaccgtcgagggacctgatatgcaccggcgttgtatctagttttgcggttgaaggacgaaaatcagattcgttgacaagttaaaggaccttagatgaacttattcaaaaaaacaaaaggaagaagaagaaacagctttctatgagcttcccatgaagtcgatgagctcaaattatttgctgcgagaaaagaactcagtgctgtgttacaaatcgagtcattttgaccgcatgacttattgactttctcccagtgcacgacaccattggcatgttgagggggcagatgccagatgaggaacactcctacagttaacttttcttcaaaaaattgtgcaggttagctgaattttcttcttcaaagatccaaatcatttttcttagtccttgtttagcttgagacttgagatgtgtgggtctgattcagcttttgcgtcgaaattacagggtagacagcctcccattgctacatgggtcggtagatgcgtatcatcaaggtgccaaatggccaataggcaatagcatcatcaacaattcacatcttacatattacaatagagtttaaaaatagaacttcctccacgcaaaaaagatagaaacaacatccatttgggtatctccgcgcatagatatctggaaccttactacctcaggagtgttcttcatctggccccctctacatgtcaatggtgtcatgcactgggagaaagagtcatgcggtcaaaatgacaaccagaaatggttgtttctgtaaattcaatacgatcaagggaacacggcataaatgcttgaaatcttctggtaaactatcaatttagggtgtatttagttcacgctaaaattaaaagttaggttgaaattggaacgatgtgacggaaaagttagaagttttgatgtgatggaaaagttggaagtttgaagaaaaagtttggaactaaagtcggccttattgttttcgtatgacgcactatcaatttgtttgacatgtctaatgtcttcgagaaaaatagtttgacatgtcagtagagtgatgtacacaggcatgcaaaggaagcaaatcacataaatcacactaactattttcaacacaatgaaaaatgataagcggagaagactactgttagtgttattgttactttaaatatggtatatatagcatgtgttcctgatgaaggaaatcacaaacatgcaaaaatcgtcatgaacaacaaagaaatgtgagagctgaaaaggcatcacagtgttaactggagaaatgagctgagctaattcaagaataaaggtgataaccacagcactgaaaacaaggccaacaaataaaaatgggatggcacattatggtagaatgcgcgcacaaactggaaatcagtgggcagtgatcctcacaatgctagaagctcccccacaaaaaagtgacagcagcatttgagcatctataacaagaacagatttatatcgagaagaactataggaacaagctgaacaagctaactaataagcaaccaatctgcatgaagttttaattttagacacaattattgaacagccccaagatgtgtaatgtcacagttgcaggaaccaatcatctacaatatgtatatgttagctaacgacatttgctcatattcgcttatctcggggcaaaagatgatactttgaaacaactgtctgtcacttgtacacgggcaggatcgcagtaatgatacatatcaacttctaagtgtcttggcatcatttgcaggatggacttcaatgttcagaagctcaagagatattgattccaacgaggaaatgataaatagttgaatctactctaaaaatatgatagtaggaaatatggagtgatttaatccagagctgaagcttgagcatgttcagaattttcacttcgagttaagggtgattgacctgacagtagcttttctctactgccatgattaacaatttaacagacagcataatttcacttcaacactacaccgccattgcacaattctcaccattatgattgcgccaatatacaaaatctacattggcaatttagcgcgtggaacatcgatatcaatacaagatggaatgtgaactaacagatccacatacagaaatctcatagtatgaaacaacaaaccattgtaaatatcaaaggtggtacacaagattagggtgagaaaaaaaggggagtcctaaaattacctagtgtcacgcaatggacaccttggcgccgacctcctcgagctgcttcttggcatcctcggcctcgtccttgctgacaccctccttgaccttcttggggaggccctcgatgaggtccttggcctccttgagggccaggttggtgagcgcgcgcaccaccttgatgctggcgatgcgcgcgctgctgggaacctcctcgatgaccacgtcgaactccgtcttctcggcgggggcctcgtcggcggcggcgcccgcgccgcccgcgccgggcgcggcgacgacggcggcgggcgcgaaggcggcggcggagacgccgaggcgctcctggaggtggtccacgaggccccgcgcctcctcgagggtgagccccgcgatggcgtccccgagctccaggaccttgggggactcggtggcggtggacgccaccacggcgacggcgcggcgtgggcgggcgcggctggggacggcgaaggaccttggggcggcggcggcggcggcggcgggggaggaggaggaggggagggagaggagggagaaggcggaggagagcgcggtggaagccatggggatggggggagtgagctctcgcttccggagttgaggtgagctgcgggaggaggaagcgaggagacggggggataagatgaggcaccgctgggataagacggcacgctatatagtgcgccgcgagtggctaatacgcatttttttcgttgcgatgcctaatcaaattgtgcgaactaggagtgctgactacttggaagttaaaagagggatataatacatgagagcagtcccaaaccatagcgtttaaaggtagtgtatatggtaccatgtcaataagacatcacaataaaaattacactccataacttatggtttcttaaagtggaccattaataaatacatcatctctcttctctaccaatcatatttattctttatctattatgaagaaactattctcccccaatgcaaaacttgatagtgtctactgcataggttctcgtgttgaagctgtgtcttgtatgagacccaatttcttcctctcttcactctctctcttaattaatatagtgccacataagataaaagtccaacatgacaatgtagttaatgctatagacaatatcctaggtggagggttgggactgccatgataaaacatatccctgctttacaaattaatcatcatataagtttatacaccaagaccaaggacaatttaaatcatatcaataaagacatcatagacacattctcccacgatgcatacatcgattaaaacctttcgttataaaatatactccctccattccaaaatataaggcataaccacatttaacccaaagaccaagaaacaattattatcacctctttgtttgaatcaatccaactaatacaatatatgcacccaatagaattaaacatcttgtgagtgtatgatttaaaaaataataatgtaagatagaagatatgataattaattgccatgcatgcatgcaggccttatattatgaaggaaaaagtacgaattaccctccgaactactgtgacagtatgaattacccctccccccggaaccacaaaactagacatattacacctcgaactattgataccagatgaattaacccccccccccccgaatcattcctaagcggtttttctcctacatggcatacacatgtcgctgacgtggaaattcaatcaacaaaaaaataaaagaaaatatagggcccacctgtcattatctctcttccccctctccttctctctctcaggcgtgtgtcgacgggcagtgggcagcggcagtggcgtgtggacgggtggtcggcgtgcgggaggcgacggcagagcgcaggaatggcacagcaggcaacgggtggcgccgaggagggcattggaggatgcggcctacgtagtcatcgtcgtccctctctctctctaggctcaggcaagcggcgggcgacgagtcctcccctgggagggcgcggcgggcaccgcgcgcgacggacgtggtggggagggcgagacgggcggcgtgcagcgccgaggacattggagacggtggtcgtctctctctctccctcgttctctctctctctctggtgccgtcgggagagccaagcaagg

SEQ ID NO: 69264 - DNA, 13665 bp, Oryza sativa
gggcacgggcgcggtcacgcctgccacccgcttttccaccacgcccgccgcgcccccgccacgcccgccgcctgcccctcccccaccacgccccgccgcaccccgccacgcccgccacccgccgcgcgcccatcaccggccaccaatgacatctgagacagtgacagtgagagattgagagaagaggggaagagagatgtgtgggagtatgacaggtggaccccacctttttaaaaaaaaattgctgactggattgccacgtggacgtcacgtaggacgataccactttggattgggttgaggggggttactcgtccggtatagatagttcagggtataaaatgtctggtttcgtggttaaggggggtaatttatactgtcgtcatagttcgggggggtaattcgtactttttcctattatgaaatatttttaaaaagtagttgtgacctatattttggaatggagggagtaataccttttgttacaaaatatatatgaacaagaatacgtagtgatatttgtattttagaacagatgaagtgcatccaacaatctccgatcaacgaaataaggcaccagcaaaacagattttggtactaactggagttcaggggaagaagattatcaccgagacaacgttatgttgtaggcaataatattaaaccgcttgattcaatctgatggagctgggtgttaggaaacgatacgcaaataaacaataaaaaataatatataaattacggaagatacgagatttaacgtggaaaaccctcctaaaatagaagagaaaaaaccacgggtgccagccagtaaaatatcttcaatattggggtgaggttacaacaccgaacggcggcttacaataagtatatttgaaggtgtaacctaaaaggataacgatccgtacctagtgtccgtgcactaccataaatcttttaagtagaaactttcaaatgtaactataataattatcatatggttttattataactctactatagcttatagctacaatataagttgtatataagtatagaaaatatatgcaactttctatacctaaattataattatatagatgttataacgtagttataattattgttactcactgtaactattataattgtaatgtaacttatatataaatagagtagcacgaatcctggccaacattgtatggccgaaaattcagacgccaggaaagaaaaaaaactgccacaagttttctagcaattctgatctaaaatgctactagtcatgcatgtaggatgcatgagcccctttagactaggtttggtgcattccgcacagagccatcagtgctactgatagaaatgtggccgtcaccgtgcgtgccaatcgccttgctgtgcttgttcttgccatccttgcagcagtacttccagttgaagttgagaaccaagcatgccactaacaacaggccaacggccaccatgacgatcactagtatgacctcctccttgtggttcatgtcctctacacccttcaactccagattcagcagctgcatatatatatatatgagatgttgttaaaaaaaaagatcggtaaaacatagttttgtcacgtgaactgaaacaccaggtttttggatgcgaaaaaaaaaacacacataaagaagagtccgtcgtatacatacctagagagatgagcagagaggagcggaggatcttggagcgctgtgagaggaatcgcatgtccaatctctgctcatatataagggcgtcaagaacgttttccaaatgtgagaggtttccttataggagagcccgcgagtgcgatacaaggaagaacacatcgcgatctcgcatttgctgccatctatcagtgccatgcgatacgatcccctcataaaacctgtggatcttcttccaggtgaagcgtggagagcgaacttcaaatgtggaagcgttgattcggcgaatctatgcttacaacaaatacagaagtttttcccccggaacgacaactgtgtagcgggtacgcttggtactagcgcgccatgggccgtgtggctcaggggctgacggactcatgcggcctgcgctgttgcgtatgcaacaaatccaatttgggttcctcaatcgatatgtgtccaaccttaccgtatccctcaactgcaatactaatatctttgaccacttaactatgaaagctagtcctaccaagcgaatcagcatgcggagctcacatgtcagtgaccccatctctaggggtggatatcgagctggctcggctcggcttggctcgttaggataacgagccgagcttagaaacctagctcggctcggctcgtcaacaggctcgagccagctcgttaagctcgcgagctaggggcaagagacgtagtcggcgagcacaaggaggaggggaggagcttgacggaggaggaaacgagctcaattgagctcgccggcgaccacatggacatggaggagctcgatggtggaggggatgaactcgacgcagctccgccgacacttggaggagacgagctcgagcccgccggtagcgtcgggcgctgggggcggacgccggcggcagcggcgctggatcgctgggggagaggcggagatcagcggtgatgggcgctcgatctcccggcggcggcgggcataggggataggcggagaccgacggcggcgggcgctcgatctcccgttggcggcgggcgctggcgagggagaggaggagaccggcaacggcgggcgctggtgggggagaggcggagaccggcggcggcaggtgctcaatctcccagcggcggcgacggcaggggagaggcggagcggcgtgtaacataccaaaaattaaccattttctaattctgcattatgctgagtcttatgttcttaataacttcctaaacctaggaaaatataattagagggactttctaaaactaacttgcataaaatctctttctggtatttaacttcttttgtgtttttcatttaaaaattaaaatacatgtggttgaattgatgtatttcctgatttggtttaaaaccttcttttgactaaaattcctttattcaaaattagtttgaaaaccctttctatttttttatggattatggtccaagaaaccttcccaattttacccttgaacctaaaccaaagtaattccaattttattggaattaattgttagcccattctttgatcttaaaccgatcctttgattcttgatccaaattcttccttttgatctagccactgatttaattcccgtggcttgatttccttctcagcacaagaataatattattacaaatattgtaaataattgctcttatactaagataataagattatatccttgtcatccaaatatcctattagcctcagacaattctttgaaacccatgccatatattttgagtctaaaaatcctatttatcttcctccatttatttcctctcctcatttcatttgagtgcatcaaataaattccgttatattcaatctctcaaaatattgcactcaaactagaaaatatctctttcggaaattatatccaaatataatttcctttcaaaattccttattcaaattatctccaaatatattttgctttcaaaatcttctattcaaattccttccaaatacaaattctcctctaaatcaaattattcagcccctaggaaaaattagactttcttccttctacgtttgggccgaattctccttttcctccttttccttttctcagtccaagccggcccaacacccagccgagccgccaattcgcgccgccgctcacgcccgtgccgtgttcgtcctcctccgccgctgccgtgccttgccctcctcctccgccgttttctccttctctaagctaccgccgccgccatattgccttcgacgccaaggatcccctgcccaacatcagccgcacatcatctcgctaacgtcatcctttgtgccgaaccgacactatcgtccaatgggaagaaagagtcggcgccgtcgtcctcttctccacgccgccgtcgccatgtccttcttctcctcctcttcttcgaaccgacctctcgccgcctataaatagacggcgaggtcccctctttttcacacatcatcatagcttgaagctcttcctctctctcctcccatggccgatcgtcgacgccgtcggtcgatctccccatccgtagctcctcttcccctctcctcgcaccaccggcttcgcctccatccggcgagtccatttttcccctttcccctctccctccacctctaagtcaagtcaccaccaccatcatccatgccgactcatggtgagcccttgccgccgctgttccggccatctccctcactccctccacctgccactaccctcaccgggtgcgcgtcgtccgggaacacgtgtgtccgccggcgtcgcaacctctcgaccaccggagcaccggcgcccaacctctctctcctctgtgttctcggcagaaagaagaaggaaagaagaagacgggagaaggagagagaaagagaaaagaaaaagaaaaggagaacggagtgacaggtgggcccttctacagtacaatttcgtattttctagatttaattcaaatctaatctttagaagcccatatctcctacaccatagatccgattccagtcaaacttggacctaaattcatctaaattcaaaagctacattttgatatcaaatttgctattttactattttatttgaaattccttcatgccatttgaatttatatttgactttcgaatatttcctttttactccaaaatagcctttagccactaaaaagccgccggttgaaactttacgccttccatggggacgttcgcgcggtctactggccccgacgtcgaaccgttggttgtaaagcccggcagaacccaaacccaaggtcaaagtgctgctcctggcaccctacgcctcgacgcgtataacagtcggagcttcactattccctcgaccttcacagcacgccgcatagttagctctcgagctctgtgtgatcctagccgctccaccgccacccacggttgttggagtaacactccacccccaccaaacctataccaacctcctattcctctagccgatatgttgtcggtcgacaccggctagagaaaggtatcaaatctactcgttatgctctagcatcgactagcatacaaccaaccaaaccctagccgatatgttgccctacttcacaatcggcttaaataccaccaaaccctaggtatcatactgcccaaacctaccaccagccaatactagccacatactcacttaaccagttatatcctttattctccaagcaaccaaaacccacacatgaaatataagcgccagtagttgcttaatcccttctagcctccaactctctagaatatccgcataaaatatcagcaccgtaatccatataccctataaaataaaatagatagactatatcctaaaccctagccctcctaactgtttatctctttcttgctattatatggattttattgaaattggttcttcatctttcttagtagagtctattttattttggatggcaacctgtgatatttcgaggattggataataaggttgcttatctcggatttatttgcgttggagcaaggcaagttattattcctccccttgagcataattaccctatattctatatctcttttctatgcattagtcattcatgattttgaatgcataacctgaacatatagcaaaccagatatgctagcttttgcttagccctgcctagttaggctgcataaaaatataatgaacctagattgggacagtacgtaagatttggttgatttctgggtggctagtactgtcccggtcgatataattgccaccaaatacttatgtcaaacgaacgagtatgaccacagcttcttgaatggggacagacctagatattatgttaattagcaatgtggtacctctgtacagtggttccttttgtaagtcctcgcgcaagaggcaatcttatgccgagcagggcatcttatgatatttaccgaggcgcaggtaaatatattgattttcgctcatgagctgtgtgtgtgattttatgtaaacctggttgagatgacgggggtctctcaacccgttctctctaaaaaccccgggaacgccagaactcctctcgctgctgataacgttacgttcagagcgcatagggactagagttcatggaacaggtgccacaattgttaataacctaatagtgggccatgactaagctaatgaatattggcaagtcatggactgccggtaaagcgtacatttactgcagtaaagtgaaaatgaatctattcgaatagccgtgctcacggatttgagtatcgggactcatatggtatttggttagaaacctaattcaagattttattaaatactgatgcatttcaaacatcataggctttcttcttctacattatctgctttctgcaagtaaatctagtcctactcaaatactgctatttcatacattcatattgaatataatagcttgctgagtacattgtactcacccttgcttcaaccccatctttttcagagtccatttggagttcttatcgaggccgggagttcaatcacataagttagttcccttttaacttaatcttcaagtctaggttatttagatggtttaagtctatagtaaaacagcagagttaggtcattctaaagcttctgctgtaatagttagccacaatctcgtaaataccctattactttatgtaataatatctccttcaaagctatgtctaaacgtatgcaaagacgatccagattgttgaagctgtatcaacttattgatccagggcttgatacagtctaaacatgtcggttaccgaatcattagttttgggacccgacacggcgacggcggggggaaaggcgcggcggcgacggcggctaggggagagtggggaattgagtgaggactaaggtttgcaatgtcttgggcttgggccattttgttgtattgggcttttgggctgtgatggagtctagctcattaaggctcgcgagccagctcgagctggctcgttatctctaacgagctaaactgccagctcggctcgttagaaaattcaaacgagccgagccgagcctgtcacgagccgagcgagctaacgagccacgagctttctgtccacccctacccatctctctactctatcctctaagtgccggggaggaatagggttgttgcttggtcatcgcctcccgcactagtcattgttgctcgctgctcgccaccgctgcccacttcctaatggacccaaagctcgctgccagcggcttcttcgaccgctaccatggcgggggtagaggggagaggaggaagcatcaatgacaaaagattgctgaccatgccgcctggatccacttgccagccttaaagctcgtcgcctgcatcctcctcggctaccgctgtggaccaagaagagggaagaggaggcaatgttgaaccattagagacataagctcgctggccacgctgcttagatccgctcgtagactccttggcagccaccatggctcaggaagagagaaggcgaccactaagcagtagccatagaagcttggtggcatgccacctagatccgcttgcggccccgaagctcgcgcctgtggccttctcggccactgccatggggtgcgaggcggggagatgaggtgatgatgaagcattaatgatagaagctcgccggccacaccacctagatcttctcgccggcctcgaagctcatcgcctacagtcttcttgggcaccaccatggagcgagaagcacccgttctcaacttctcattgatgaagatgcatagggagagagagaagaaagagaagaaagagagagtgagaaataagaggagagtcattgacaagtgtcataactaggtcaatgagccacatcagcgaaaactatcctcaaaacatcatctatatagttattttgtaccagttttaaacttttaatagttagaaaaatcagtgatatttgtgatggggagatatgaatttaatttgggaaactataatttgatgagaaagtcaatgcgttacttatttcgttgcgtatttcgcggaagggatacgggccagaggccacatcacagcaccgtggggcgggtgcgctatcagcgagtgggcgtggccgacgtgatccagcccagtattcgagccgcacacggagcgcgagagaaaacaagacggacgaggccgcctgcctgccgcccgcgccgagcgccacgcgaggggcagatctggccgcccgatcgaccgctatccggccgcggaacagtggagcttgtgacggtgatccccgcggcgcattccgtggctatatatccacttgcgcaatgtcagtgcgggcgtacggtacgtcggcggtatctcgtccgcggcagctgcaatattctcggaacgaccaaggccaacggcgcttttttactgccaaacgggctgcagtcttctttcccgtcgagaatcctcaaggctcaagccagtgtccgtgtcttggtgtacgtacgagccctacacatctactcgattcgatattgcgatgctgcatttattgattactacttactccctccgtcccataaaaaaccaacatagtaccaatgtgacatattctaatattacgaatctagacatacgtctgttcagatttatagtactataatgtatcacacattcgatatttcgtttcttatgaaacggatggagtattactaactgttgcagcttcgctctcactggtggagaaggggtttttactcccggttcgtaacccccatgtactacgaatccgggactaaaaatgtttttagtcccagtttttaatataaccgggactattgtgaaatctggtcgaccgaccaaagatggtttctccaccggtgtctcaaagagaaaaacgaaaaattgcatcttcattcagggggagtagctcgctgtgatgtctctttcaggccaaaattattcaagtaggcaacagagattaaacaacggatccatcatccatcccctgccgccattacgcagtttggttcagctggtacactcttaaaaatctaaacggacaacaccctccaggtggagttggtgcacgtacgtacgtgcctgttgtctcctgttgtgacttgtgtctcctcatcatttagttctaacatcgtacatcatcatggcaactgatacggattagtcacagtttattctttcgagccagctgggttagctggtcgctacttaaggtctgaaggaggaggggacgcctagtttattcacctgcctttggtcctttccattttgataaggtatatcccacttgtaatctaatctagtcctgatgctattattgaaaactcatccttaatttgattccctttgtccagtcatttttcttttcttttttgtcgtccacgtatgcctatcgtgtaatgctgtgtatatatgtcgtcgaacaataatctcgacgctgattgctgatctaactgaccaatgaactaataaataataacttgtgagagagagcaatgaattaactaattcttgcaatagatattcttatctggtttttgaaaccacgcaagcaaaaataatttatttgcatcctgttttacaattgaacacaatgcgctacacggaactgcaaaaagtatgctgttgaaaaattatttagtgcatactattgcctctaatcgggggcggatccaggaaaaaaaattaaggggttcagttatacggtatcttcaatctccagctatttaaggactttagtttatcatttatggtgaaaaaatcgaaggaggtgctccagaggtatccatgggtcttgagggtgtaggggggacttgagtccccctgcacccacgttggatccgcccctgcctctaataaaatatctggcaaacatgcacacaaatcgcaactctttgttttttcaagtgaaagagacaaatgggcatatcaatatatttcttataattgttttattcagtattttagtggaagaataatatacctatatgtcagcttgccgtctgcttaatttacaaatatatattttttaaaaaagtggctattcccggaatataagggataagatggtttcctgaaaggccatatgacttctgcaaacattaaaaaaaattatgaacaggataggtatattaatcagttgctgcgaaatggcaaagctgactttgtaaattttgttcaggaaagtgttcggtgacaaattatttaagagaactgactaaagtttgtagtttatggggtgatttgaactatcgcaatagttaaatgggtaattcaaactttttactcataaagtagaagcatgatcaaactctcaactctagataactgacataaatatataccggggtccattctaacttcagtcttcaaggacgtgatactaaactgtaaaactagactttggttggtaattgatccttcattgccagtttggcacagctcaaatcaaagaaattacaagttacaaatgcaactgacagaaatactgcagtagagactgtagagtcgtagtgatgcagaatataacaagatagaggctgtgattagatcagaggtgtaaagttttagcgtatcatatcggatatgccggtacataatgaaagcattaaactagactaataaaaaaactaattacagaatctatcagtaaaccacaagacaaatttattaaacctaattaatctgtcattagcaaaccacattgttaaatttttttagcatatatttaatattttatgcatatatccaaacattcaatgtgacctgatgtaaagttttgtcagggatctaaatagggccaaagtaacaacgcagtaatgcacggcatatgcacatcgatcacacagtgttcacatttcacaagcacccccatatagctagccaaggtcacatggcgatgcaggagaaccgcgagcagatgagtagcgcggttcacatcacctgcactgtagttcacagtgcggctatagcggccagcccagcggcgtttgaccgaagcttaaacatgcatgacactgtgcgcatgaacatgcatgaattgcagtctctgcagatgtcgcatcgacctggcactacgtaaaccacacctggatctggatctggcacatgaattgcctcctctagctaatttcactgcaaaaaagaaaaaccgcaaactaaacaccctatcatgtactgttccagctagtagaacacagtagtatagtactactatactacagccccatcgtttggcctaaacagccaaagaataagccaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttggataaaatggcaaccgatgggagccctagtagatcaactgctttggtgggcttttaattaagcagattccatttgaaagtttaatttactggagctgtgagtgtgcgaggtcggtcaggttagttgggaaggttgacacggagaaaaccggtcagtcttgtcatcgcggacagcacggacacgtacgcgcacgcctacacgtgtgcaggcgcggccacatgcagatgccgcgccggaagtagagaacacgcatgcgacaagactacaagagactgctaggatatgagaattagggggtgtttgggtgctaaaaaataagtctcgggacttattttttggtttgagggactaaaatcacctaaacacccccttaacaacctgcatacagtagtgtttgtgttggaagcctgggagggccaagctagccaacgtgccgcgatctttggtgatctttgataagatgtgcagttgtgcactgcacagactcgaagggaagagagagagagagagagagaaaagtagtacagtactgtatacgctgcctgtccattctgactgacaattttgtttgtaccgacgagcctcggctacgcgactactcctacacgcgatagttcacgacgagaaaagttaggaaccctccgaactatcgcggtcatctgaattaccccctaaaccacaaaaccggacattcttcacccctaactatacaaaccggacgaattacccccctcgacccaatccacggtggttttggtctacgtagcgtacacgtggcagtccagtcagcattctatattttaaaaaaatgtggggcccacctgtcatacacactctctctcactcacgtcagcggcaggcgggggcaacggctgagggcggcggtgatgtgaccatgactaccacggatgcaaccattgctcacattatggatgaataagaagatatcgagatcacgtcgtccaagtgctagaatccgattcggccacctgctacactactgacttcaaacggttaccgaatctgcatacgacctccgttttcggcccgtgagtatttgatggaaagctcttggagccctttttctgacggatccagcctcatctccgaattccatctcgtgtggccggaatcacaggcacaaggtgttgcatcacctataatgggcctatgggcttgtaacttcatttgggactccggcccaggtggggcccatgtggggtgcgccccaaccaggtggagcacgcccctaggcacccctaggtcgtcctcccacccctatatatagctaggtactccttcagggtttattgggttttgttagattaaagtttagccattgctacttgcttgcagctcgcgtgtcagctagaccgcccgtctgcttgttcttcggaaccccaacttatcgtgtgtattcattcctatttgcaatatcagattgcttttatcttgttcttgcttgtttcttcgatttgcttgcaggaataaggttgatctgcaccggcaagatcaacaacccacggagaggtgtatcgatcgcaaaggcgcaacacaatgtcttgtacggttgtagtcggatcgtcaacgtttctcccaaatcgtagttatctcaactcaccgaaagatcgggccaaacaactgccttgagtgtcgaatggaactcagggttcatcaggtggcctcggcgcggaggcggcgggggcggcggctgagggcggcggaggcgccgtcggcagtggtgctgccgccgcgtcgccgctcggcctagatggtcactggcgacgcatgcacggcggtgctatgcggtggcggaagaaggcggcgacacgaaaggggagaggaggcgcgagcggcaagggcagcgactcgggatggttgctcgggacacgggaagggcgacagcgacgagaatcgagggggagaagggccgacggcggagcgtgactactcagcggcggtgggaggggaggcacggcgcgggagctagtggggaggccggcggccaaggcggcgggttggggtggttcaagggaactccaggagggtggtggcgcgaggaatcgacgaggaagaccacggcggtgcacaatcgagcgcggcggcggtgaaacagagcaaaaggggaaacgacggcgcacaatcgagcgcggcgacgtcggacag

SEQ ID NO: 69265 - DNA, 1818 bp, Oryza sativa
cgccaccgccaccaccaccttcgcactgaggccgccgccctcagccgctgccccagcctgccgctgaccgtgagagagagaggaagagtgaggagagtgagagagagtgtgtgtatgacaggtgggccccacatttttttaaatatagaatgctgactggactgccacgtgtacgccacgtagaccaaaaccactgtagattgggtccaggggggtaattcgtccggtttgtatagttgagggtgaagaatgtccggttttatggttttggggggtaattcagacgaccgcgatagttcggggggtaattcgtactttttccgaaaagttatgcctgggacttcaaattttactgcccagccatccgtcttaaaataaaatataaaatttagtactaaataagatacgttttaatatatagtattgggatatatcttatttaatgctaggttattatattttgagacggagagataatatgatttaattttaaaagtaataggaatcatttcatcaattttgtggctcatatttgatcttattttctaggagtagaagttggctaaggacctgcagttcgaactagtgtttttgttaactaaaatgatagttcatgaaacaagccaagtcattaatgcagaattgattaagcattaattattataaacttaaaaaacatatctatctaaatttttgaagaaactttatataaaatgattttaaaagtgtatcatttaacaatttagaaaatatgtcaaataagttataaaagccaaatgccctgtacaattcagcctaaggtttataatacatcgatcgaaaaatccccctccccacttaatatattagttgcttgcaatttttgatgtgaaaagttaatacaaactgctgatgtctaaaccaattattcaggccctgctgtgtattggagtactgcatatttctactagaacaataccggggttggaccgtttgagtactttttagactgatgcgtgcattacatcattttaagaattggatttcaaagaatgttgcttttatgttggaatccaaatcgcatacgtttcacgataagtacagagtatcattatacaatatttagtgattttaaaatggtatggttttatatctccactagagaatcgtcgcgccaattggcacgctctttttaggctgtgcttacgtgtatggacatatatattttaaaatatttcgcaggattaggccaacttcaataagttgttcatttaactcagaatatagcaattgagtatctactcacttatctcaaccgatcatacccctcttatttaatttctctacttacacgcctaatttattaacacctatacccaacttcgaccaattttatagacattataatgacaaagcatttctcactaaaatataactaacaaaaaaaataccaattaaataccctcgaaaacgttatttctagccattctcatgcatttttgtagtggggagaaatacttatgatgtccttatcaatttgtaaatccaattaaatatgtatatctttgtttgattggctagaaaaatgttttcctaaagggttacgtaacaaaccttttattatttcattgtttctttttacatgacacctcctgctactagattctagagagaatctagtatatgccactgatcttgtcccacgtctacgatttactatcgtttgtcacgttctacaatataccatcgacttttgtttaacttctacgatttaccattgccgtccggttagcctttattaggactgtacaattttgtccaaatgagcaaaatacccta

SEQ ID NO: 69266 - DNA, 5565 bp, Oryza sativa
ctaccgcgacaacctatcagccaccgccgctgggataggaatccatttttcttgcgatttgtttctgggatttttcttggataatctagactcctctagcatcacacgttttgtaaaaaaaccctctaggaacttgcatttacatttaggtccgccagattttttttcaccgctgatatttcatcaaacgactgtgaaagggttgcaaatacgtggcgcgttcttgggccgagaattccgacggagcgcaatgagtggtgacacgtggctcaattagaggcccgagattagaccttgaaatcggtttataagattctttattaaagttctatgatcgggtcctagtttgttcatttatagaagatgtatgatcatcccattaatactatggcggactaaacatggtacgttttcacaatttatgcgcaatgagacgcgcactatttatttatttaaaaatgataggatacatttattgtattttttatatcttcgtcctttattaaatgttctatgaggcatagtttttcatttatagaagatatacgatcctctcattaatattatgttagatacacatggtttgtcgcaatttatgcacattgagccatgcattactttatattttgagattgtaggacgcaattattgtatttttcggatctccggccattcttcattaaatgttctataagacgaaattttacatttaatagagaagatgtatgattacacatggattatcataatttatgcacaatgagccttgtatttgttttttattttaaagtaccaggatatatttatttgtttgtctagatctctttctttactaaatgatctacgattgatatttttacataatatgcatattacattttatagaatatgtatggcactcacattaattccatgatagaatacacatggtttgtcgcaatttatgtgcaaagaaacatgtgtcagggttatggataccacatacctaatagtagtcgactaaatctcggcaggacccaccatataccatgtcctatacggaaacaacttgcggatataggaggagttccggataaggaaagacaaccagagttctaaatggaaacgacaaggactactcggattatatccatattggtttctctagttctacttggacaagtggacacctatggttataaatacaaggcccaccatagaagacacggaataatagatcaagtcacaagatcaacatacaagccaacatacgccaagacaagccgtcggatatcgacatcagagatatgcctagatcgaccctatccggtacctacagaggccggccgtagggatctagcgttgtctctgatctcgccggacacgaactcgaggaggaagactaccctgttgtcgactacgagtcagaccttcagaccgccatgtcgacaacagttagataggctaccccaaatattgtactggtgcgattatggtgaataagagcaataccggcttcggctaacaggatgtagggttattacctgacaattcaggggcccgaacctgtataaaaatcccctgtctccatctttttacctcagtctcgcatatatcctagtaccaacgatccccatactatacaaataccggaatcgcgacatcaaacgtcgacaacatgtattatttatttgttttaaatgccaagacatatttattgtatttttcgatctcttttaatttatttattttacatttatagaatatgtattatcctcacaatagtgctatggcatattacaattgatttatcgtgatttatgcacgttaatgctatcttcgcttctatggagtacttaccatcgctcatcactaatcagtagtactaagtacattcggactttttaattaaaataaaaaaaaagacctctgtggctggagtatttgtttttcttgtttagaagtaacaatttggaggttttatcattgcttatgcctccaaaattttattttcagccttcggagaaccaaatgtaatggtatatatgaaactttaccatttttccacctaagaaaatgacaacttaccattaccaaataggaaaaaacaatcaaagcgagagaactacctgaaaattttggcatttggtaggaaaaaaatgtttttttatttcttcctttgtttttgtaaagaaagaaatgaagtccatcatcttcgtcagaggtttgctccggtccatcacatttccgatgcacaataacagcagtcgccattccctatataaacctgtcccgagaaacagaatctctacttctctctcccctcccgtcttctttgctcaaatagccatcgcgagtctcgcgaacttccccagctgcctcaaagccggaggagctcgccgcccactccatgcctcgcgtgctccccgcggagccggcggcgaccaaggcggcgttggctcgcggtttctgacgagctcgcgggcgcggaggcggggcggtcggcgactcggcggcatcccctccctccctacgctgcaaccgcaacaagtaagcccgatcgatcgctgctcctgcctgtttcagtgtttctgctccggttaaaattcagaaagttcacgggaaatgcattgcgaattttaactgtacagatgtttcgtttagtcctatctagaaacttttttttttaacggttcgaccgcgacgacgtttttgtctcaaatgaaaacgaaacgacgtttttagtggagagactacagcaaaatttccaatgttcagaactaggaccaggaggatactctagtctatagctatagctgccataaacgcagatgattttgagaaacgtggcccatgcaccaccaccaccaccgcgccatagctaaacaacaagacaacgtaactcagctagctgcagtttcactttcacagtaggaggaggaaggaagcaaggaacgcgagaaagaggccacagcacatgcagcttcttaaatacacagtaccaactaaagtgtcgcaacagtgctcgtagtattattgcaacgcagctagtagccgagagcagcggtgtgtacctcgacgtgtgtgacatgacatcctaggaagagatctctagccgcgcgctgcccggcctgaacaatggcaggatcgtcggcagtgcagcggcgccgctgcaacgctactagctactcctcctcgctgacacgaagcatcagcttcgtttactacttgtcattaataaaaatctcgatagcagcaaggtttggttgagttgagctcatccggtgtcttctgacttccatggtcagcttgctcgcgtaatctcgtccgttttctaatgcctctagagtccaatggaaatatggaatcttgccctttgtttacgtcagtagttgctgtagctctatctggccccttcgtcaggacaaaaggccactgtctctaacatattaaaattcaaacggcttcgaaatgtttacaagtaggtatacttgcattggtttcaattttaaaaaggatcaaaaatatagttggcgtatgaatgcttcaccactcattttttttctgttactataaggagtggcattcctgtccgtgcacgggtcatgcagttccaaatactattaattagctcattaacgtgtattagaacgcaagaagccgagatcggcgcgcggcttttgctgttcttgttataacggttgcagtaaaattattggagcttttgatgataaacacggcttctttccacatagaaagctactgaatttcccactaaaacgaagcgttcatcaaacaatcacctgtgtggaccaaagcaataatagcatcgtctcttaactaatgccattaaaatttaggcccaattcgcttttgcttaaccaccgaatgtacattaaacatcaaatgaagcgtgcaacttggtcgccgcaacaaatacaatcatcgccatgccgtccaagctatgggtatctatagatacaattatttgggggacaagggctcggcatgtttttgcgctgctgtgtatttaattctagtccgatgtgcaacagagtgggattgatggcgacccaagatcagtttgtttacagccaatcttgtttaaccttaggtgtactttggtcacgcatagcttgtgccctgttctaaaggacacgtgtaatggtatcgatcactaccctggtttgaattatgccttctttgtaagcagtgatccttttggaaaatttgtaggaactagttcgatattggtaaataatactcgtaagtacaacaattttgcaattcaaataggacctaagagtaagactcgtaagttttatttttggtctggtccccttgttactatgaatcttctacggagtacacattttttgtgtggagcctacagacaattcccaacatgatcagatattcaggttccttcttctctgacatgttctatccataccactcaggcaccttcctctccactctccagctatcttcccctcaacaattaatattcagtccattgattagagaacacacatacacacacacaaaaaaaaaatcagatatcttcccccacgtagctaactcgattcattgtccaataatgaatcagccggcgaaaacccccaaaaaagaaagagagaataaaatgaaaggaacgcaaaagaaacctataggtaatcatctgaagtagctgtcgctagaaatctgtatcaaccacaccatggggggagcagggccctcttgcctttcgatcgacacgcatcggtctctgccaagtaaaaacgtcgccaaaggccagcagcgacggcagggtcgcgggaccgacgcgtcagatgcctcgtccggccgtgatggctgctacagtttccgctcgtacccgtcctacgtgtccgcacagtagctcaacccacaacgcaatgaaatgaagcagcattgtagtggtagtaatattttttactgtttagtggattatatgttgctgcgactgtgagcaatttacttcggtagtagtaactgtgatggttgcttgcttgttgtttggtcatggtgatggtggtgtgcttggtctacttggaggtttaggccactctttgatggcttcaaatctgccaaaccttctatttaaggtgtccgtgtgcatttacttgcatgtgtccatgtccagtcctttggttttgcaacatgtggtggccgcctgcgttgccagttcgccaattgggcccaaaaaaaaaaggaaaaaaacgtcacctttttttcacgtttcgcctcacggccctcaccgggaagcggtagtgatggcggtggcgccgcgcaggccatgaccatttccctgaccggattgtcgttaagggctcttctcttattgttgttattattatcgttcaaaaatggacaggctgcagcagcagcggcggcggcatgaggcgctgaccgggcggcgccgtggtggtggcggagggatgtcgcggcggcacggccggttccggttcgccaccggcggcggcgacggcgacggcgacgaggaatgcgctggcgtggcggtggtggaccaggcggactgcacggcgcattcgtgccggtcgtgcg

SEQ ID NO: 69267 - DNA, 15895 bp, Oryza sativa
gacggcgacgtctcttgaccgtcgagacaaccaatgccagccccgtgccgtcgaatcgacgccatttgctgctcccccagctcgatcaattctcccgtgcgatttgtcgccgcgctgggcgaacgcaagtacaacctgtgagctgtatgccatggtccaagtagaaattggtcggcgacgttcgagagagcggcatgagtgattgactcgaacttcgaaggacttgagttcatgatttctctctctcttctccttttttgaaggaaatcttcttcctttttgttgttcagggagctcgaagtgtactcacaagtgtagataatttgtgccgtcgagctccttcctccatccaagcataatgccgtcttcggtgatcgctctgtacataccaccatttctcagataaattttatctgcgtgataagagtgtggcattgcgctccaactttggctcagtactatgttaatggatgtcagttctgtatctgcattgccagcgcctgcgctcgccaccgacgcggccttcctgcgcctgcgaggctgcaactgcgcactgcaggcatttgcaaatggcaaaaactaagagcaagtttaatagtatagcccactactggctccaattcatctataactaatctaatagctcatttatacaatagttacatactacactattaatatctggtctcacctgtcatacacacgctgcgtcttagagtccgtgctacatgtggctacaaatctgtagcccgctgcccttctgtctcctcatttatctgcttaaaatatatttgcagctggcttatagcctgctattgtacctgctctaagaggagctctattttttttaatcaaaagggtgggtacccctccatttctagtatcagaaatgtgcaagtgtataccaagatcgttcatatctgaaaacaatcccagataacgaataggcaaaagaggagccctactgacggaatgtatacgcggtgtttcaaaatgcaagttaacaagttaataaacggatgaggtttaaagttattttgaattttaacgaatcttatctgaatttcaccgtgtaggtaattggcaaaaccgctagagagcgattttctgtgggcaaatgttttttttgtaaaaaaaaatccggattccatgtaggagaatataaaagatctgttgcttcaggtttcatcaaactttcaatagaagaaagtactccctccgtttcagggtcacagtcaaactgttttaagtttaatcaagtttatagaaaaacgtagtaacattttcaacataagataaatttattatgaaaacatattcaattattgatttgatgaaattataaatattacaatatttttctataaaatcagtcaaacttaaaactgtttgatattgatcaaagtcaaaacgtcaacttgaaacggagggagtacgaagtttacaactcgttcatcgtccctgaatgactctaaatgaaagcccacatgggcccatagtctgtacgggaaacaaagagaaactggaaccgaagaccatgatgggccggtccgtacgaggagcgccgaaatacctcgggccgccgcaaacatgcattgctgccacaaactgctatcatgtcccgaacagaggatttttacactttcgtttttcagatttggttttcacctcaaaacgaaattatactgatagtatagttttgcccagccctgcgttccgaaaagtgaaacacgttggcccagcaacaaagaagagtttgaggagcctttgcaccaaagagagattgggatgatgctcgtgctgcgtcatgtacactcatattgcctggttggtccaggtagggaagcctagataaaatcataaaaaggaaggatgacgacggcccgggccggccgggactgcagccagctagccagccaaccgtagctagctcggtcccattcccatctccctctccctctcgatcggcacggttcacctaaccgtcctgattcttcaagggaatttctcccggtcatcgattattgcgctcgagattccctagtgctactaaatccgtctcaaaataataaatacagttgtggtatttttgtcaaacatttaaccgtccatcttatttgaaaaatttatgaaaatatttaaaaaattagtcacaaataaagtattattcatgttttattatctaacaacaataaaaatattaattataatttttttttaaataagacgaataatcaaacgttgaatataaaaaatgtaaaactacatttatttttggatggagagagtaatagactcaaccacaccctctccctgatttggccaatagtgtaccggcgatttataccagtggccagccggtcgcgttcccagcggcttcgacgccaccaccagccaacatggaaaccacggcccgttcgtggtcgcggcggatgagacatctgctcggtttggtttttttcatcgacccacacggccgcaccgctagctaataactcgattctccccgttgctgttctgcatctgcagtgacacacaattaggtgaactaacaacgtcgcacttgaaaaaaaaaaaggtagggaaacaaaaccacttggcaaaatctagcgaaaaagaggagaggaggaaggaacaggatagcacaagtacgggcacatgtcataaaccgtacacgattcgttcaaaaaaaaagaagaaaaaaccgtacacaatccgaaatcgcatttctagttgggtttctagaagcgccacctcccacatccccagctctccgggcccgacacgtgtcccgcacaacctacgaaatcaggcgtactcgccactgacaggtggtcccagggccgtgatggacccaccagtcagtgacacgggaggcggcccttatctactacgcgcgcgcgcgagacccggccataataccgccttctgttgttaatcggttagcttcgcgcgccgccgccaccggctcgacccgagccacgcgaaaattcgaaggaatccgcgaataaatccgaggaggagaccccaacccgagtaggcgaggcgaggcgaggagcgggagacgtcgttggccatggaggacagagaccgcgaccaccgcggcggcgccgacgaggacgccccgggaccagccgccgccgccgtcgcagctgtggacggggaggacgaggtggaggatgatggtgggggtttctccttccccgtcccgccgttcgccgcggacgcgttcatcgtgcccgtgtacccggtgtttggtcggccgatgtccccgccgccgcgggaggcggtggtggaggaggaggaggaggatgagccggagacggcaaccctgcgggtgccgttgggccggctgctgctggaagagcgggagttccgggcgaggcagcgggagagctcgggaacgtcgccggtgcagccgcagcggcggcggccggacgacgagggcgagctggagggggtgccgccggagagctactgcctctgggctccgggcgggcagccgtcgacgacgccagcgtccccgcggcggtgccggaagagcggctccacggggtcggtgctccggtggcgccgcatcagcgagcgcctcgtccgccggagccacagcgacggcaaggagaagttcgtgttcctcaacgcccccggcggcggcgccccgtcgcctcacccgcccaaggacaacgacgatgcaaacggcggcggcagcgtcggcaagggcgacgccggccgccacggctggagctattacagcaagggcggcggcggcggcagcggcggccgtcggagatcgtatcttccctacaagcaagagctcgtcgggttgttcgccaacgtcagtgggttgcggcggagctatcacccgttttaaattcgatcctttcctcctctctctctccctcttcgtgttcgtcctctcctgtgcatatatagatactctcagtataattcgtagtgatagaataaaatcggcgtgttgacaaattgtaaattgtaattagctcgtgtaaagtaaaatggtcctacggctacgtgagtaagcatctcccaaacatggagattgaaatcttatcttatctataaaaagaaaaaaagtattgatgaagcatatggttagcatttgtttgttctttgtttacatgtttagtagttacttcagaattgatgcaaacagagaggaagagttcaggatgggttttctgttttgtcggctgtggctgcttaatttttttttggttcatctctatctcagatagaccggatttctgtacgcttagtattaaaccgaccaacaccattaattattgattagaggattttgtttcgtggcggcttgaattagtactagatttttagttgtttgtcaacgtgtcatcatttgttctttgattaagaggttgtgtgcgaggcaggatcagcggcgacagttgattttcaatacaacgatttcgcgtacgtagtgaagtaacccggcatggggcaatttagtttgtcatcaatgcttcatgtgaatttagcgaaagctatctgcctacctgtcacgacgtgaacgtacgctattgatcgtttcaaagctctcacctaaattctctatccgtgcgtgtgagctttgtcactaaaagtcttaaaactatatttattcgtggggatattccacaattagcactgggtgaatggtttgtcgtgttggcgatagttaccactgctactaaactactacagtacctatttcttttcatggtaaagagactgtgccatttcgataagcaagaatctgcttaccaatacgagcatctccctgacgcacacctccttccttttctcccttttctttttcttttttttagccacttactatttctatttgcttcttgagtggcaacttttacccgtgcagattacacagcaaaaactagcaaaagccttgttacgtgttacgccccaatctcgatcgatctccaaactttcccccggttttttttttgtgtggaaccggtggtttggtgtccatctcccgtttcgttgtcgcacccacagcgcccatccaccgtggtgcgtggcaccatccgtcaagttggctgcgagggacgaagatttgcgagtttgcgacgacggggaaagggctccccgagcgcgacagctactcctccgctaaccaaacccaaccacgcacacacgggcacactactcgctctagttttagacacaactttaaaagttatgacgagaacaaaaagatctaatacatactacctatcgaaatctaaagtcaatggttatataaatttgtaccaactttgaatgaaggttacaaatggatttgaataaatgtatctttgcatcgtgagttactggattatatgtgatctctgttcagcgaatcgtgtaataagttgttgcagtatcgctgaagcaaagatcaggatttattttattattgaaaaagaatctccgagtacgcctagattttagtcttttttgtccaaccgcgatcagtagccacgttcatgtcatcgtgtgagttgcgtttcggggtaaatcgatcaggtcggcgaatgcagtgtcgtccacttattattatcctctcccttgtcgagccggtgagtgatgagtgagccattagcgtcttgtttgctgcctagcttagctagaacgcacgaaacgaaagagccacggccacggcacgcgtgggcagggggcctcgctagtgcggtgggctcacgccgtcacgcgcgccgttcaaaagcgagggggaacaaggcggcgacaagggggaacgcgccgacgtcgcgtccgacgccgacgccaagtgatggctctaaccttaccaagagtgctggtctttaattcttttagagaagtgtcggacaaaggccagaagttgtaagacaattcatcactgcttttcttctctctcccagttacacttcattcttacaaataccatattactgtaccatcatcaaagctcagttgataccatggattagtaatacccacccaacccatccaaacgatgagcagatattgccgtattgcctggacgattatggcatttgtttttttttacttgcatattttggcagcacgcagggagtacatggagagtttgaggctgaattacattgttcagggagcggaacgcaggtcaacaatctcgaacctcaaatttgggttgaatataaccttggagcaggtttcatagattgggccgccgtccgttgtctcccggtgggcgtggaacccactttcactgcactccctaagcacacccatccctcctgggtctgtcagcctgaatattccacagttcctaaaggatttgagagcatatgcatttcactgtaagtgataataaattggcagggggcaccaccaaaagcaaaaggaataataaattgaaactgtacaaccgtccatagaatacttgcctagtaggatcagtgggagcaatcacaatcgcaacggcctctggtaacataacctgaagaaatccagcactttatgtctaccagaattagaggaatggcaaagcaaaccaaaatttctttctgataaagtcgtcctgagctagtagattaataattgcagtagtggctagtaattcctagctagattagaatacagccaaaagcacaaaagatttggtcgtgctttcaccaactgaattaacttcgtttacatgtcttactgcaggcaaagttttaatgcaaataaggaacctaaggcctttttaaatgataataatgcatacctttgattattttattctataagcctaactacaactgctcaactaaggatagcaccatagatagtgtatgcagatgtcagggtggtgtgttaagtcttgttatgttttctcttgagctttggtgccattttattcatgtgattccatgactccatagccccctacgatagcttgctaaacaaacttcacaccaatagaaatcctttttgtcagatgaggcgcacaacactgatatgagagcacttaaagatcatgaacagtaatatattcagagtttgcagctttcgttctagaatcggactatgtacattaaaatcacaagatctataataggaaaaaattgatgcatatcagtgcatcaaagtattataccatcctttataaattgataagagctgaactttctattgatacaccatttattttgagacaaaacattattatctgtcatataattacctggtaggagtattgagtgtgcagatcaattgatgataagaaacacgtttgtgaagggtgtgtctggaaaagataatgaaaaaaatcaatctgtgagctgctaactaaaataaccattatatatgaacatatcaagaaggtcatgcatgggttccattttaagttggatttgataatatgaaagttccaaggatatcaagacaaaagggtaaataatggttgcgagtgttacatgtatccaccctgcagggtaaagtgattgctccgataaaatagcatgtatctcctcctcactgacagcctggcactgcatttgggaagataaaccaccgcttcagagcgtgacaaccagatatgcgtgcacaaaatatgtaaaaatggctatgatgtattaatatttaataatgtatctatgtttcaaaacagtttaatttctgacgtacagaatgagcagttgcttcttgctttggtatgatcaacatagtcacatagtaagtcccatctctctgcaaagaagcattgaagatcacaatgcaaatccaaaaataggtatgattatcatattggcaaaccattttgtgaagcgaacctacaaattcatctaaaagggacttacaaatgaagcacctaggattccacaagtctctacattgttgcctgtattctcctttgcaagttcgatgaattcatctgtcaatctaactgactgaagaacatgcataaaacagttatttcatcttaaactccagtttcttcgtagtgacatcacaaatcgagacaaagggatgataatggaagcagaacgtactatctgcatgtcatgcaaattgacagatgctgaagactgccccactgaagatcttgattgctcatcagcatattcaggatcctggctaaaagaaacattgccgaagctcgaaaggtcttctatccaagaaacaataggagatgggtaatggtgcttcacagagtaggaaccggtattgcgatctcttgctggtctacaattaacttgatagtggacaaccttttgttcattggtatcgattttatccacataatatggtttacttggcgttggatgcgtcccacatttatttgcattgatttcaactctgccatttagcactgaatatatcatgatggcataatattaaatacaaccacacaaggaagatgcacatgaggccagtattgtatacctcctgccacccatggctaggtcttggcaccagacttcgacctgcagatcagatcatctcaaacgaatataaacgcacaaaatcaaatacaagagggatttctttgaaaaggaagtcgaatcagccgatttatttccaaaaggcatgctatccattgggacataaactgaaagctgatgaagaacatcagtggcgggagtttcatgagctgctcaacaactccagaatggttcggtttcaaccacagcttaagcaaaccaacaaaaacgtggcatcttatcattaatcctataaacaaatgacacataataccactacaaactgataccactgcatcaccagccttgcaaggataccttattgcttcagaaagctaaaactatcccggactagattaatccacgtgactgctccttgccacctactaactaccaagacagcacgaaaccacccagcggcagcagcaacacagagcgagctataccgacgattcctctctcaacccgacatgaacctgccagcggaataccaccggaaaaaccgattccccaacgatcgataccttttgagagggagagaggctcaccttgagaaatccggaacagcagctggacaacctcactggagttcgctcgggccaaggattggagaagggacgcgggagagagagggaggggaaaggcgagcgcgcgcgcgctgttcttaccgcaagcgcaaaggacgcgaacccgaatccgcggcgccgtctatagaatttcacgcccccacacacgcacacgcgtcgtcacgctggccgggctcgtgcgtgacaagcgggtgggcgaagcgattgagagagaggagaattcaagatagggacgaaaagcaagtcgaggtgtcgaaggggggaagcacaagaaagcgggaagcgggcgtcacgctcgcggcggggcgcggccggcgtggggttgcgtgccggtgcgtgggagcgacgcgcgcggtggtgtggtggcgccgcgtggggcggcggaaaaatgcggtggattcgtctcgtctcgtctcggctcggggaatcaatcgagaggcgggtggatgcctgatgacgtgagagcacgggacggacggctgagagtgggaagtgaaaaaaaagaagggggcaaaagaaagcatgtcggctgtcctagccgtacaagaaattctttgtagataagctacggtgacgaggcagtttcttgttctatgggtgtgtttagttcggaaaacagaaacaacttggtgtgtttagttcacactaaaattaaaagtttagttaaaattaaaacgatatgacagaaaagtggaaagttatgtctaagaaaattttgatgtgatgaaaaagttagaagtttgaagaaatagtttagaacttacaagggtacggaagtttaagctcgaaccttttctacacctgttgcacttgtcatcccggattgagaaggcgatagtctgcgacttgcgaggcatatgtggctaaattctcccaacgtcacgcataggtcacttaaagatgggagctaaattatcatttgagaagtactagttcagctgatatgttagtttatacagatggggaatttcacacgccatatatctgagaaattcaatatcacccaccaatcatcttccagcagatcagcaagtaaccttgtgcaaatcccaggacatcttacaaaccagcgtatcacgtatgattggaacaaaactctctatgaagtttcataagcggaatcatccagttaacttcatatataagacatcaaaacgcatcaacttctttcatgtacctgcttatgtgtacattcttctaccgctccctgttgagataacacgattatagtgccgtttctccggtttgcagaatcatagctgacgtctaaccagtaattcctttaagattcattagtactgccagtcggttctccctacactgactagagaacagtgtacccacaaaataataatgataaggaaaaatgagcataaaggtgtagattagaggtagtagtcctacgctatacatgacaacatatttttgtataacatgatgtgaaggctacataatttgtgggctatggctaataatcaagagagacaataacagataaggaagaatgctcgtaagggacctaggaatccagatctagctaacatgacaaaggaagctgtcatatcaacctcaaagttggtggttgcatgatagtaacaaataaatgggaaatcgaacaacagaacaaagtatgctttcatcttagtagggacctgagggcagctgcagaatgcagagagcccaaggtaaaactgaccgcagcttaagtttttgtttaaggtaaatatatacgctcatagaaacataaatgggaatgaatatttaaaattaagtaacaaaaaatgataggaccccatgttatacttgttaatatttaaagcaaaatgggaaccacaaattcaaacttttacccaagacaaaaaaaaaagtttgcttaccatcaagatagtctctccaagagactttccaccatacttcgttgccctatgccactcaaagattctgattttataatcgcatttgatacaacaatgacattacttggagaaggtgcattaacctacaaggacattagcgatttatattttttccaaagaaacaaagataaagaggatacataaaagagtgatataatcaagacatatacccacactcggccattcaggccaacagcaatctcaaatgaaagtttttttccaagggcctctagaattggacatgttggagaacttaacaacctacaagcaacaatttacaaaatataagaaaataatgcaactgcattgaagaatgctagtatgtaatgtcctcacatccgcgacaggccagtagacgtgtcaaacatatagccatcttttagttgaccaaattcggctgctttcccagtagctgtaaaatacaagccacagcaatatattcatattgaagtaacagaactaatgcaataattagacaaattcaaacataacagtatagcctgaaatggtgtcattatgtaaggtcaaatattatcatatagaaaggagtgacagaataacaaaagacgtacttgagtacttctaatggattagtataaaatagaaaatcccaatgctgagttgtaagataatagttttaccatccatgcacgagagctctgggttcatgatgctatttgctttcaccactcgtgcatatattaatgtaccaatctgcaggagaatatcatggggtaaggcacagattgggcctgctgtacatgcctctttagtacaaagacaaaggaggatgaaaagcaacaaatcagtgagttgctgatcaaaatgaaagataggtgttttacaaacaacatatcactttgttgaagttatagatctaagcccatgttactgcatagaacatcagaaaatattggctatataactctaggcagtagcagtttaaaacaaggagaaacctgacatttgcattgtgcaagaacacaattattcaatgaaataaacaatattctcctatacatcataacagactgagttcaccattattttctgaaactaagatgatagctattcaaactaagataatttcaagtatatctactaacacaaaatcatggtatatagaccacctaaagtaagaaaaatgttctcaaagctggcaatcaataaaagcaggataccacagtgaacttcatgacaaaaacctatgaaagaattgagttggggaaacaaaatcaacaaccattgatgaatgatgatgacccattagtcactgccatacctcgaactttggaatatttctcctggtaccaccttcaaatgcaagaactggtaaaaaggccaaattaggaccttttatatccaccaagaagttctgtaatgacagaatccagctcagcaaagaggtaagaatatatcatatgaggtgcatcgtgatgcctcatttaatgacaaaactaaaagcaagattttagacagttagtggaagtccatatcagttcatgtagtatatttgaaatgtacagaacagtgattgtatcaaaacaattaggtccacatactaaaaaatgcaccatatagaagaattaatttacataaatatacataaatgtacttacatctggtttggtgtcaaccacaacaccaagaactgtatcttctacagaaggtatatactgcaaaagaaataagaataaaagccagtgaacaggctaagcgctgaaggacaaagagagtaaagaactatgtgaaatccccattctacctttgagaagatataaaggctaaaaacatggcaagcataacccattccacatgggaaacaaatcataacattaaactggaaataaactcaggatggcacacgcatatgccatctacctaaccaatttgcatactgtgtcaaaggtaatatagtgggaatagcaacataattatctttctgttcaatcatgaaacattaaggaaggggcaaacaaccttctgccgcactaagaaaagcaatacatgggcataaagcagcacgccatacagacacagtgagcgtatttgatcaattcacattctcattagtccttataacgatccatggacccctatatacctctcaagcagacaaagttgacacacatgaggtaaacatttttttttccattgtgttatatatgagatcaaacaggagcgctcaccctcttctgcgagctctcgacccagtatttgctgggcttcgaaagccgtagcctcccagcactggtagcctgtatggtgtcgcaatcctgcaaacaccggggagcactcataagcataacaataaacccttgattaaaccctaatccctaacaatctctcacaaagccccacttgccaccacgaaacgaagttacctgtcgcaggccggcgccgagcttgatggtctggttggtcatctcggcgaggtcgaggacgacgtccccggggacctgggaggcgacggtgatgcgagtgagcgagcccaactccgcagggatagcgagtcggaggtcggggtaaggtaagagggcttgggacgcgtaccacgtggttgtcgacgagggcggagggcggcggcttcctcgattccattgcacggcggcggcggcggcgcgcgggtgggcgggtgcggtggagactggagcggaagagcggaacggacgaacggtgaacgcggcggcggcgcttcggtgcgggcgtctgcttgcctgagagtgcttgctgtggaggagatgggcctagggtaagttggaacacatgctatgggcttggcaggtgatgagtttggcaggagatgggcctagtgatgagtttgggctgggctaatgttgttcacttgcagcccactatttggaccactgagaggacagaataatctattatattattaaaaaaataaaaaaagagcctccacgttctcatggcctagaaattctcacattaatcgaagaaaaagaaaaagcaaagtccatatagaaatacaatttagaaatagttgaaattcggaattaaaaaataaaaaatattagaagaggagactagagtccatatagaaatacaatttagaaatagctgaaatttggaattaaaaaaaggaatattagaagaggaggctagagtccatatagaaatacaattaggaaataactgaaattcagaattaaaaataaggaatattagaagtagagtatagagtccatagaaatacaattaggaaataactgaaatttggaattaaaaataatgaatattaaaagtagagtatagagtccatatagaaatacaattaggaaataatagaaatttgaaattaaaaataaggaatattagaagtagagtatagagtctatgtagaaatacaattaagaaaaaaaatagaaattcagaattaaaaaaataagaaatattagaaatagagtacagagtcatataggaatttaaaactaactaaaatttggaataaacataataaaattaaaagtagagtttagactccgtataaaaatacaatttacaaataactaaaattcaaaattaagaaaaacatgggaagaagagtttaaggtcaatatgagaatataaatatatggatacattttagaactaactaaaattcgaaattaaaaattaaagaatattgaaagataagtttagagtccacgtagaaatacaattagaaataataaaaattcagaaataaaaataaataatattggaagaagagcatagagtctatatagaaatacaaaaaattcgaaattaaaaaaaaagaaatattaaaagacgagtctagagtccatatatgtcggtgacatgggaccgggagtatcatgactcgaggcttgaggcagacacaatcgcccacgtggcctggcaccctcggggacgtcgggcccgagggtgatgtgtgcgcccacctcttggtcttcccgagggggggggggggtcggaccactccagcctcgcccccgacgggggcggggccccgacccctcgcgtcttgtcctccacgtgcatggcttgcgtcagcccaccaggcctcacctaaccgcatttattgcgcctcggctaagcgtgtcacgccgcacgaagtgcagtgcagtgcactcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctgagccgacgtgtggtggacaagaatgaccgatttgtgaccggtctgacactgctcatgtcgtcagcacacagccaccttcccacgacgtgcccgcctcaggcagaagtggaggtaggtatgtgccgtcccgtcaggaggatgttcggaggacgaccgtgcaaatctccgtccatttatgaaaagagaaaaagtccagtttggaaagggaggggtgcatgtggtatccccttgaagtataaaaggaggaccttgcccatagagaaagaggttgattctttccagattcagagcctagaacgagggagaggtcggctcacactttgtagctccttcatacacagatccaccaaaacacaggagtagggtattacgcttctcagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcatctggcgcgccaggtagggggctcagcgtgtgttttctgag

SEQ ID NO: 69268 - DNA, 16661 bp, Oryza sativa
gtgggcggtcctccgccaccaagacctctggtgctgctaccactggctccgcgtcgtcaagacgaagggcacgacgagcagcagccgctgttcgccgttcggtagccactccctcatcgactccttcgacccgagaagatctgcgtagggagcagggcgcccgcgccagcctcgagcgccggcgtaatgaccgaagtactccccgcgcacggagggcgcctcttcgtccagagtatcacctcgacatggacgtgaggaccagccctccgtgcccccggctggtggtatcggctgtagagcctttgtggcgagtcttcggaatgtccgttggcccctaaggttccgtcccaccatcaccgagaagtatgatgggagtgtcaaccccaccgagtttctccaggtctacacgaccgggattgaggccgccgggggtgacgacagggtcatggcgaatttctttcccatggccctgaaggggcaagcacggggttggctaatgaacttgccacccgcgtctgtccactcctgggaggatttgtgccagcagttcaccatgaacttccaaggcacgtatccgcgccccggtgaggaagcggacttgcacgctgtacagcgaagggacgatgagtcgcttcgatcgtacattcagcggttttgtcaagtccgcaataccataccatgcatccctgcacacgcagtaatctacgcgttcagggggggtgtgcggcacaaccgcatgctcgaaaagatcgcctccaaagagccccagactaccgcagagctttttcagctcgcggaccgagtggctcgcaaggaggaggcctggacttggaacccctccggttccggagtggcagcttcggccgcccccggatccgccgctcagtcagggcggcgtgataggagaaggaagaagaggtcagtccgttccgacgacgagggtcatgtcctcgccgtcgagggcgcttcacgggccacccgaaaggggaggcctgcgagcgacaaaaagaaggaggccagcgttcccagcagggagcgccctaccggcaagtggtgcaccgtccacaacacctccctccatgaccttgcggactgtcgcgcagtcaaaagcttggctgagcggacaaggaagtgggaggaggagaggaggcaggagcgccgggaaggcaagtccccggcggttccttccggccgtcggcgaagtgaggccaagcagaaggcccccgccgaggacatcgatgatggcgataatgacctaggtttccaagagcctggggctaccatagccactgtcgatggaggagcgtgtgcgcacgtttctcgccggagcctcaaggccatgaagcgagagcttctggccgttgcccctactcatgaggcgacgcgccgggcgcggtggttggaagttgccctcacttttgaccagtccgaccacccgccgtgcgttgcccggggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggcgtgacgccggggcacacttggccgctaggtcatatcgacctcccggtcacctttggtggacccgccaatttccgcacggagcgggtgaacttcgatgtggcggacctcagtctgccctacaacgcggtcctggggaggcccgcgttggtgaagttcatggcggctgtccactacgcctacctccagatgaagatgccgggccccgacggccccatctctgtccatggcgacctcaaagtcgcgctcgcttgtatggagcagcgtgcggaccgcctcgccgtcgtgtccaagcccgagggcggcgacgagaggcttgacacatccgcccccgccgccccgaagcagcggatagtcacgtctgatgaggtcccggtcaaggaggtcacactgggcgacggcccgtccaagaccacacggatcggtggtcttttggacggcaaataggaagacgcgctcgtctccttcctgcgggcaaacgctgacgtcttcgcatggagaccggcggatatgcccggggtccccagggaggtgattgagcaccgtctcgccgtgcggccgggtgcaaggccggtccggcagaaagtgcggcggcaggccccggaacgtcaagccttcatccgcgaggaggtggcgcgacttctggaggccggattcatccgcgaggtcatccacccggagtggctggcgaacccggtggtcgttcccaaggcgaacggcaagcttcggatgtgcatcgactacaccgaccttaataaggcatgtcctaaggatccttaccccttgcctcgcatagatcagattgtcgactccacagcggggtgcgaccttttgtgttttctagatgcatactctggttaccatcagattcgcatggctagggaggatgaggaaaaaactgcgttcattactcccataggaacttattgttatacgacaatgccctttgggttaaagaatgcaggtcctacttttcaacgtactactcgaatttctttgggtagccaattaggacgtaatgttgaggcttatgtcgatgacttggttgtaaaaacgcgcaaccaggaaacgttgctttcagatttagcggaaacttttgagagcctccgctccgcccgcataaaattgaaccccgataagtgtgtgtttggtgtacctgcgggcaagcttctcgggttcttggtctctgcccgaggcatcgaggccaaccccgagaagatacgagctatagagcggatgcgcccccccagtaaacttagggatgtgcaatgtgtcaccggttgcatggccgccctaagtcggttcatatcgaagctgggagagaaggcgctacccttatttaagctcctcaagcgctccgggccgtttacttggacggaggaagctgaacgcgccctcactcaattgaaagcatatctcagctctcctccggttctagtcgccccggagccaaacgagcccctactactctacttagcggcgaccccccaagtagttagtgcagcgttagttgtggagcgcgatgagggcaatcctcattccgcgcacccccgccctgtgctgacttggcccgggagcgagcagggaggagaggcccccgagccgaacggaggcctaaggcccctgacgaccggagtcggccctctccccgctcgtcagatggtgctgggcgcccccgaccctcaggaaggccccgaggccactgcgggaaggctgcacctatcgccctctgaccccgaggctaaccctgtaccgattcgacccgggagggagcagggagaagaggcccccgagccgaacggtggcctaaggcccctgacgaccagagttggccctttgcccgtttgtccgacgacgccaggagcccccgacccccagaacggccccgaggccactgtgggaaggccgcccctgtcgtcctccgaccccgaggtcatcggcacagaagacgagtgcgccccgaggggccacttggacgaggagcgccccggggatatggcccctagcgaaggggatcggccccaccgaagggtgcagcggcctgtctactttgttagcgaggccctccgggacgccaagacccgataccctcaggcccagaagatgctttacgctattctgatggcctcgaggaaactgcgccattatttccaggcgcatcgggtcaccgtggttacgtcttaccccctcggtcaaatcttgcataatcgggagggtacaggacgggtggtaaaatgggcaatcgagctttctgagtttgatttacactttgaaccacgtcacgcaatcaagagccaggccctcgccgattttgtggcagagtggaccccggctccagagaccatttcagtctctgaagccagctcagacccctcgctgttgcctcacgccgcccactgggtgatgcagttcgacggctcattgtctcttcagggcgccggcgcggggatcacgttgacctctccgaacggagacgtcctcaaatacttggtccgcctcgactttcgagcgaccaataatatggcagagtacgagggactccttgccggactcagagtggcagctggactggggatccgccgtctcttggtgttaggcgattcccagctagtcgttaaccaagtctgtaaggagtaccggtgctctgacccgcaaatggacgcttacgtacgccaagtgcggcgtatggagcgccattttgacgggatagagcttcggcatgtgcccagacgggataacatgattgccgacgaactctcacggctcgcgtcctcgcgagcccaaaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaagcatacctcacagataagactctacctgaggaccgtgaagggagtgaacgcgtccaacgcatttccaaacgctacgtgctggtagaagggaccctctatcggcgcgcggctaacggaatcctcctgaagtgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaaacaaatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtggcccgaggcttatccggtcgtcaagatcgataagcactctgcacttaaatttattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaactaagaccttcaatatcctcaagaagcatggcgattcgtggatcgaggagttgccagcggtgctctgggcaaaccgaaccacaccaagccgagcaaccggggaaacgcctttcttcctcgtctacggcgcagaagcggttctcccatctgagctcaccctgaggtctcctcgggccaccatgtactgcgaaactgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgacgacctcgtcttacgccgcgtccaaacgcgtgctggattgagcaaactctcaccaatgtgggagggtccgtatcgagtgatcggtgtcccccggccgggctccatacggctggccacgggcgacggcactgagttgcctaacccttggaacatcgagcaccttcgtcgcttctacccctgagggggggggtcgggtgtcaggtttcgggctcgggtcaaccccgcacccccccctcgggtgtgcagggttggccgggggctgccacacatgcacattctcatttctctcatttcagtatttcaataaaagcagtttcaatttcctaagggctgtatctgtgccgttttttttcctttttgaagaattttgacttgaaataaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatctccccaggcagtagtcccgacccgcgcttttcgaggactgggacttgggcacgggcccttaaatcaagctaagacacaaaaagaggatcacggcacagatcatcctcatctcattcgcatagcaaaataaaattaacacaaagaattttttcatcatttttgattgcagattgtaagttgatttatacaaaaaagaggcatgaaggccttagaagaaagaaaaagaaaaaactggagtctggagggggcctgggggctcagtccgatgcgcccgggtcgccggcctcgtcgtcacgatcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccggaagggaactcttccagcgccatccatggagagaagttggggtccctggcctggtaactcgctagtacgagttcaaccgctccttgggcgaggtccctcgaggatgacttgatggtcttctcgagctcctcggggagttgttggagagcccaggccatcttcgtgaggtgcggagcgaggccctccaggttggcggggcgtgtcattgactggcctttccagaggcccgcctgccgaccggcgcgatccagacgggagactgcatcccagagcatgccgggccctatctcgcccgccaagcggagggcctcggcttccccggcggatgagtctagcgcgcgctgcatgtccgcgacggtgtgttcggcatctgcgaggcgggcggctaagtcgctttcgcccgcagccgccccgccgatgcacgccctcgcatccagctctttttcccgcgcctcgagatcggcagcccgctgctccagtgcggctctctcggcgcggacggattccaaattgcgacgggcctgctccgtcagcgctgcctcacggagggacagggagtccgccaaccgttgcgcttcggcctcggcctcttcgagagctcgctcccgctcggcaagcgcgtcttcgcggaggcggagtgcggactcctcttcggcgcaggcagactcgtgcgccgccagcgttgcctcccgggaggtgacggcggcctcgcggtccgccaggactttctccgcgacgcaggcgcgctcctccagcgccatggcgcgcgcctcgagggcctcttcacgccgccggagcgccgcttcggtctccgtcgctcgctgctctcgggcagcggcggcatcaagaaccccctgggcggcgtcgagctttttcttcagctccgcctcccagttcccgtgctgaaggcggagggagtcctgcgcctcgatcatcgcagtggtggcgatgagggcagccccccgctcctcctccacctctcgagcgatctccgccagtgccgtcttgcgggcctcaagatctgagacgtgccggcggtgtgccttgcggcccgcttctaccatggcctccaccgagcgccgcccctcctcgacacgcgcccatgcggcgtcgagctccgcacgctccgcctgcagggcctccacctgggcgttgaacccatccaataccgcggtatttgcggcggctaaggcctgcagaaggggctctgcgctcagcggggcggcggaaggcgtggggaagagctgccttgaagaagacgccgcgcggctcggcccgccaatggacgcgccggcctcatcgcgggccacccccggacccgtttggtcctgggcgtcgcccgaaggggtgggcccaagcgaggcgtccgcggcctcgtcgtgaactgcctcggaagccgccatcgcctcagcccggcgaacccgggcggcctcctcccgagcggcttcttcggcctggcgaacccgggcggcctcctcccgagcggcttcctcggcttggcgggcccgggcggcctcctcccaagcggtatcatcagcctggcgagcccgggcggcttcccgggcggcctcttcagcttcccgtaggcggtctgcggcctctcgccggtcagattcccgcctccgtgcctctgcggccgccggatcttcggcctcggactggccggacttgagatggtgggaggaacgcgatgggatatcactgaagcagaaaggaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcacggccccctccgggcgcctgctgccggcacgcaccgccccgccccctcggggaggagatgagggaggtgttcctcccagtttcctcttcccccgggcgtcggtagggcggttgccccccgagcccccgacgcggggcccagaagcacgaccccctccgggggtagattgatccccccggcggctcccacctgcgccgtcatggcccttaggagcctgctcctctgaggccccgaccgccgtcataatggtcaagatggaggcgcgatctgggtcgctgcagagggggaggataccgtgggggatgagggacgcctccacggagttgagatttagcacccgttggaccagtatcttgaagtcctcgggggcccaatcccatctgactccctggtgggtccgcatgtagtcttcggacccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctgggggcctgcgccgggggctggctcggaagtcggagatgcgcttcgtcggcgaggggggtgtagaaccagtcgctcttccagtcatcccactttttacggaggacgcaggggatgtagcagttcaacaccggcccccgcggcaggaaatagcagccaccaaccaccgacggcggcgacaccgactgcacggtgaagaaccaccggaacagccgaagagatgggcgcaccccaatgaacatctcgcacaggtgtgcgaagatgcccaatgtcatcactgcgttggggataaggtgcgccatctggagatcgtagaactccaggacgtccatgaagaaagaagaaaatggcggaaccagccctgccattgcgaaggggagaaagaagacggaccgccccgggtagtctagcgccgggcgtccctcacccagcattactatctcacggccggtggcagattccggcatgaagcggcgcggcaacccagcctgcttctcgctcacaatgcgagaaggcggcagcacgctaccatcaagcagtgcggagccccgtgccatggcaccggacgaagagaagatgaagagcgagcgcgtgtggcgaaagaagggcgcagggaagaaggagttaggacgcaagcggcgaaggcaaaggaaatgatggcgaaaggaaggagacaaatcccatcctcagtgcctttatacccttgccaacgctgtgcccggctcctcgtttctcgcgcccattatttcgccccctcgtttctcgcgcccacgcttccactaatcccattcgcccgcttgcggtgcgtgagatggatatgcggttgcggcagtcgagatagatcgtatcgtgcgcgcgttaattacgctcgccgaccgaagcaacattaccgtatcaccaggcgaggcaaatcggctcgcccagattcgtgcgccgctcaggtgatgtggcagtcttgaagagaccgcccattattgacagccaaattaccattaccggtgtgcatggtttgagaccgttgggttttttgcccaaccatggagaccggtcccacctgtcaccaggctttatgtcgcgaccgggaaaattgccttctcccgaacgctagtgtattaatccccgtcccaggaaaagccggggtacaccatacaaacatgatataaaagacacatctttattacatcgataatatttacattattacaagggcacttcaggcctgacaaacaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggggggtacaaggggataataataggggttaggttttgcagtaaacagcatttaaaagtcacttagttgcccaaagccattttgtaaagacgatcctagagctacacagtattattaaacaaggtcgtgaaccctcacgaacctgccttaacccaaggcctacgatgatttggaccgaactggcaacccgacctgggttccagctcgtcccaagccaacccaggccaaccattccatattttagttgttgagcaaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacacccgacttcatccatctccaatccgtgtacttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtgtgtccaattccaacataagccgaccattccatagtgtccaaatgatatgagaatttcccaagtctaaagttataaaaccacctaatgttgcctaattaatcagcgaagcatctacctaaatttaaactagggataccacgagtagagtacccactagttggggttttatttattctagggtgaacaaggtaataataataacaataacaataataatatggtcataacaaaggtaaataggcatggctaaataaaacagtgacaacgcgggaatttaaataaagcgataatgcaataatttaaatcaacataattttacaaactgggattcaatatgttcaaggatgatgtgacttgccttgctcagggagaacggccttccgaaccttcggcaacgaccgcaaaccacgcttcgggaacctccggaacgacgaaagctacgcgaagcacacaagcaaagctacaagcctataaagaagcaataacaacacataaaaagaaagcacatggttctttaggttataacaaacattaagagacttgaacgggtcgattcggagctcgtatgaccaggatatgatcatccgaagtttaatgctgttatatggagatttgcgaattattataattaagctttgcaattataaaacatgtgtaagcgctagcctggaaaagacaggaaggctgcgccgttgacatgcggaccccacatgtcaacctaaaggaccgcggtagaccggatacacagagacggtccacgggtcgacggaagcggaccccgtgtgtcaaccgaggcgagtggccaacaaacggactccactagacaccacacggcctgcacacgtggaaaccacgcggctaccgagcgggcacactaacacggacactacacggtcaccacccgcacacgtgaacgactaccgacaccggtacacgggtaccggggtcgacgaccgcacaacgagcacgggcgacaccgaaagggcgaggacggggcagcgaggggaggaaaccttaccaccacgcgacgaggcgtgggaacgacaacgacgaacgggcgcggcggagacagacgggcacaacggagacgaacggcgaggggacggcttcggcggcgatccttgggcgaaggcgagacgcggccggcacgaggcttgacgacgcggagccgaggacgaacacgaggacggggctgcagcgactcgcttgacgaacgcggacgacggacgagaacggcttgacggagggacgaacgccacgacgatcgggaacgacgagaggacgagggcgacgacgaccggggccggcgaggaggcgacgaggacagccggcagcggctgcacggggacgaggatgacgtggaacacgccgctatgatgacgatgacggaggcggcgccgcgagacgacgagccggcgagagggaacggtgaagacgacgacggacaccggcggtgttcggtcggaggggaggcgaggccgaggacgacgtcgcggctgcgatgccgaagatgatgggggtgtggccgaccggtgcacgggcgaggagggacgggcggccgaacaactccggcgaggcggatggagaggttcgcggcgatggcgttccggcgaaaccgaggagtggacgaggtggagggctacgtcaccatgccgagggaggggacggcagcgccggctgatgcacgggcatggcgaaaggggcagccggaggagatgccgccgaggaggaaggagaggccggcgcgggcgacggcgttccggcgaaattcgggcgaggaggaggtgatgccggggaagaaggcgatgccgcggtgtcgaaggaggagacggcggcgtcgatcggcgcaccggcgatgaacagcagccggctggagggagtacagtggcaccaatgccactggttgccggcgggggcaccgttccggcgagtttccggcgaggagacggtgaggccggtgaaggggacggtgttgcagagccgagggaggcgacggcacggccggacgatgctccggcgaggagaggaaggcggctggaggtggccggcgcgaaggaaagaggagggcgacggcgggaacggggctagagaccacggggaggctcgggatggggttaaaacggtagaacggagtgcggggatcccattttatatgagagaagagggagccggccacgggggaggtcggaacggcggtggaaaatccggccggcggcaatggaaggcggccggattggcgcggccgttcccggcgattgggggcggcatttaagggggaaattagggggaaatgaagaggagtcaatggggattaatttcccctatttaatttgggaatcccatgcttgaatcgagcggatttagaggaggaagcgagctagggttcacgggagagggagagaggacgaccgggcgggaggaaggggacgacgcccggcctgacgcgtgggccccacgcggtcgggcgcgcgtcgtcaccgcgcgcacgcgcgcggcacgtgcgggaggggagcggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaagagggaggagaggaggacttcggactgggcttggcccaaaggaggaagaggagggatttttaggttttctttttattgaactttgataattgtttttgttgtttaataattatttctggtgctctgaaaattcaagtaaaatttgagggctctttttagaccaaggagaatttaacaaaaattctccgggccacattggaatttttcttgtacgtatttttagtgtttgccaatttctttccgaattttaattaattctattattccttttagaaaataaattttaaattttgggatgaatttatcaggacgtgacaaatccaccccccttacaagaatctcgtccccgagattcgaggaggctagcaagaagataggttgggcggtcttctcttcttgtccgacttcttccgtcgcatcttttataacaaacttgcctagcaaaacttctccactctggactgcttggctcaatctcctgttgcagatggaatcttctcttcacctgacttttccctggttgcacctctagctgacttcgactggattatggcacttgaagatgggacttcagttccagaacttctcataattcatatctttggcgtcaacctcatacaagttacccacttcacgttatgcgtcgatgtcagcttgtcattactaggatgccctgctcgttatcatgagaatatcatgcttgtcatttacttctaacttaccactattcacttcatgttgtcctcggttagcattcaacgtattcctttacacctttgaccttgatgtgttctttccgatttctcttatcaatcacctttcgacctacttctttgcctggtaataaacatctttttcgatatcttctatcagtcatcttttgaccttggtcgctaagtattcttcactccgagagttgtggatgcttctggtggcgatgaggtcctttggtctgctacctttcagtgaaaccttgaagtgtttcgccaaaagctatactgactgtcattgcctttgatccggaaaagacacatctgaaactcttagtccaaacaaatgtctctttggttaatcacttgattttcttttccatcctcaggttggttattagctcgaggttagaatatagttcctctggcacgagaccctaggtcccctttgtcagtaaacaattatacacatgatcacatatccgcatcttccaaaagaatcctcttagaacttgtttttattacaaatctctcccatattacatgaatacaaggcactgtcttaaacaaaaagggaaggtgcttaacatcggtacattgtttccactatgggttagaattaacatgaggcctcacaggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagctgtccatctggggatgattattgtgacttggagttggaattggtggttggaaatccttgctaacattggcatcagtggtaccatagttgctatcaccattggagtctttctcagtgtcaaaattgctaaggttgtcattctgggttccaacattgatactatcgttgacatcttggtgaatgctactgacattgcacgctttattcgagtggtcactaatggggcaagaaccatggttgttggtggtatcatcattattagtattgctagtgttgttgtctgcattgcattcatcttcttggggcaggaactcttgatgcacaacaggagatccggtgatctgaagtggctcagtgcgctgtctttggttaccacctggaaatactgggatgttgacaatccttctcttgcagttcgtcatccgattatgctcactttcgagttgcatggctttgtccacaagtttctcaaaatcttcataatcctctagaagtagttgcactgcaaactcatcttttaacccctggagaaacttctcttgtttgtcttcatccgtttccacatcttctggtgcatagtgagccaaacgatagaactcatgcaggtactctgtgacggtcaaatctccttgcttcaggtagcgaaactctcgttttcttagtgtgatcattcctgtgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcctctcgactgtgcgccaccaatcactggcttccataggatcgacggccatggcaaaggttggaggccccgttttgagaaattctgataacttgcactgttgctggactgtaggtacttgaacgttggttgcccctgctgggttgttccgattctgtaatagttgaaaggctgttgccaacatgttggtttggttaaccacaatttggattagctctggtgaggtttcggtgatgctattctcattcccat

SEQ ID NO: 69269 - DNA, 2558 bp, Oryza sativa
agtaccatcagggtcacagcttgacaccctcaatgaccagcatccatatgatggcaatgatggtctctgtgggcctcctctcgaaaatagctgttcaagcagcagtgcctcaaagcaacgccatctgataagaagcaagcaaagtttgggcatggggccattctcccttggagttgtactgggattcatagcaggtctctgggtggttttctgtacccttctgttcaagaagtcgtggagggttgcctacttctgcctcttagacaacatgtataacaatgtttgtgtgattgtggttgttcaatggggaagattgccaggaagaacatgagcaagattgtggatgtcgcaggttggtacattgatttgaccagccctattgataaatgaagaaagaagcaggcctgcagcacaattagttgggttgtgtattttatatgttttctacgcaaaaggtggagagactaccttataacaataatattgactagaaagaatacatatgcaatgcatggatattttatttattatttatgagaggtaattgtgttcttacctctattttatactccggttgtgattttgcctttttttttttttagcgttcgtgtttttacctttactttttttctaatgaagcttcacttttcccctattttgttaagatcagttaatggtgtcaattcagccataaaaagacatgtatcccttttacatttgcccaactttttttaggctgtgtttagttccatcggcaaaaaaatttgctgggtcacattagatatacggacacatatttgaagtattaaatgtagactaatacaaaacaaattatataatccgcatgtaaactgcgagacgaatttattaagcctaattaatccgtcattagtaaatgtttactgtagcactacattgttagatcatggtgcaattaggtttaaaagatttgtctcgtaatttacacacaaactgtgtaattagttttttcaatatttaatacttcgtacatgtatttaaacgtttgatgtgacgggacaaaaaaaaatttgccggtgggtctaaatccaccaccccccctcctcttagagttgatatacattttcacacaacttgcacggctgcaaaacttgactaaaaagattcatgacaaatttctcgcaaatattgagataggaaaagagagagagaaaatcaggtagcaacggcatctcgctggtctttgtgaacgggaaactatttagctcgagtggatgtccacccgtttattgcatgtcatctaaatggttatgaaaaaaattgaaaaaatatgaataagatagatcaatataaatatatcaatccacaaacatgtaagttaaaatttaacttctcaagttgtaacaaaaataacaaacaaaactcaaattactatatatatatttacaattaaatttgttatttttgttacaatctgtagaagttgaatttgaacttgcatgtttgtggagtgatatattacatattgatctatcttgttaatttttttgaaaatttttcataaccatctagttgacatgaaataaacggatggacgtccactcgagttattagaatcctctcccgtttgtgaacgagtcgctcgccatgtgccattgttgttggccggctagctagcttgccgcgccatgctgctgcgatcgctgcttgccgccgctgaggggcatcgatcctatcgtcgttgacgcacaagaggggagagagcaaaccctgttgcagcgtagccgaggtgccctgcccaccttccccttccgcaccgtaccatcgtcggagcccgtacgctgccccgccggagctgccaccttccgtacgtgcgctgcgccagagttgctgccccttgatcgagccgccgccttcccgttcccgtggtgctgcgacagactcgccgctggctcgccgctgcctgctcgagtgctgcacgggcggatctatagtacgtactaggaccggtgtcaggcgacaccgacgactctcggtaaaaaggtatagcaaaactgcttattcatatgttataacatcatgatctaagcataattagtatactatgacaccgttagacacgttatgacaccaacgaatcgattttctggatccgccacagtgcacgggattgggatgggaacggccgacggacgctgtgtgttgggctagctaggtggggttgggagttgggactaggtaggttatttttgccaggggtacaatagttcttttgcattttgtaactcttcttctttttctttcgagataatccattatatgccattaactttatcgcacgtctacgatttgccactgactttgtcacgttctacaatatgccatcgacttttgcttaacttctacgatttaccatcgccgtccggttaaccacctttagtactgtacaaatttgttgaaatgaccaaaatacccctatgacaaaaatatccaaaatttggataaaattatcaaaatattatattataaacataggattgtaaacatccaagatttgaccaaaaacttgaaatatgata

SEQ ID NO: 69270 - DNA, 8348 bp, Oryza sativa
agggatatacaagaggaaaatgcttcggtgcccctatccttacgatgtgcctatgcgactggccggtgggccagccttggtcctaatggtaacttgatggaggacaggagagctgcccccggcatgggggcatcgctgttcccgagggaccttgctactacccgggtaaaggcatccccgggtaatagcatgctccgtctagctgccatcaatagtgtcaatgttagttggggcgcgtagtgcgcatttattcgcgcccgctagcgccttgttcttgacttggcttgcgcgagcacatcgaggcataattcactccggctagcacatcgggctttaggggcccctcggagctccgaagcccttaggtagcctccggagctccccttccggactccgggtaccctttcgggcttcggagctcggtcactaggtgtgtcaccggagcccatggcgctgcgacctcccggagctcttccggagccggtcggccgccatccgaagcctgcttaggtcttgttcctctcgccctcaatgagatccgattctctcggatctccggaggcctccggagcaggggggccagccgcggaccgacatggccttgattcacggtcatctcctggggaggatggttctcggagcgctgcagcccttcggaggctagcgtcccttgatccggagatactcccctaacaccttcttattcaaccaagctaggaccaatgaccatgacccttttggatatcaagatgaccacaggtttagatatcctcttaatcagccaaccgttttccagtctgaaaatcaagtgtgccaacaagttgcggaccaagaatgttggtggttggtcaggctacatcactttttcttatatctgtctaagtccatgagctaaaccaaaaacatctctcgctcttgctgtcttagcttgcaccgatattctctgcatctcggcacgatgatatcactcccattactgctcttcgtcctcttcttctctgcgctgctgctcttcccttcgagcagtgacgacgacggtggtggtgatgctgccggcgacgaactcgcgctgctctctttcaagtcatccctgctataccaggggggccagtcgctggcatcttggaacacgtccggccatggccagcactgcacatgggtgggtgtcgtgtgcggccgccggcacccacacagggtggtgaagctgcggctgcgctcctccaacctggccgggatcatctcgccgtcgctgggcaacctatccttcctcaggacgctgcaactcagcgacaaccacctgtccggcaagataccccaggagctcagccgtctcatcaggctccagcaactggtactgaatttcaacagcctatcgggtgagattccagctgctttgggcaatctaaccagtctctcggttcttgagctgactaacaatacactgtccggagcaatccttcatctctgggcaaactcacaggtctcactgatcttgcactggctgaaaatacgctgtctggttccatcccatcatctttcggccaattgcgcagattatctttccttagcttagcctttaacaatttaagtggagcgatcccagatcctatttggaacatctcctctctcaccatattcgaagtcatatccaacaagctaagtggtacactgcctacaaatgcattcagtaatcttcctagtctgcaggaggtatacatgtattacaaccagtttcatggtcgtatcccggcatcgataggtaatgcttccaacatctcaatatttaccattggtttaaactcttttagcggtgttgttccaccggagattggaaggatgagaaatcttcagagactagagcttccagaaactcttttggaagctaaagaaacaaatgattggaaattcatgacggcattgacaaattgctccaatcttcaagaagtggaactgggaggttgtaaatttggtggagtcctccctgattctgtttccaatctttcctcttcgcttgtatctctctccattagagataacaaaatttcagggagcttacctagagatatcggtaatctcgttaatttacaatatctttctctcgctaacaactccttgacaggatcccttccctcttccttcagcaagcttaaaaatttacgtcgtctcactgtagataacaacaagttaattggttctctcccattcaccatcggtaatcttacacaactaactaatatggaggtccaatttaatgccttcggtggtacaataccaagcacacttggaaacctgaccaagctgtttcaaataaatcttggccacaataactttatagggcaaattcccattgaaatatttagcattcccgcactctctgaaattttggatgtgtcccatcataacttggagggatcaataccaaaagaaatagggaaacttaaaaatattgtcgaattccatgctgattcgaacaaattatcgggtgagatccctagcaccattggtgaatgccaacttctgcagcatcttttcctgcaaaacaatttcttaaatggtagcatcccaatagctctgactcagttgaaaggtctggacacacttgatctctcaggtaacaatttgtcaggtcagatacctatgtccttaggggacatgcctctgctccactcgctgaacctttcgttcaacagcttccacggtgaagtgccaaccaatggtgtttttgcaaatgcttctgaaatttacatccaaggcaatgcccatatttgcggtggcatacctgaactacatcttccgacgtgttccttaaaatcaagaaagaaaaagaaacatcaaattctgctgttagtggttgttatctgtctcgtttcgacacttgccgtcttttcgttactctacatgcttctaacctgtcataagagaagaaagaaagaagtccctgcaacgacatccatgcaaggccacccaatgatcacttacaagcagctggtaaaagcaacggatggtttttcgtccagccatttgttgggttctggatcttttggctctgtttacaaaggagaatttgatagtcaagatggtgaaatcacaagtcttgttgccgtgaaggtactaaagctggaaactccaaaggcactcaagagtttcacgtccgaatgcgaaacactgcgaaatactcgacaccggaatcttgtcaagatagttacgatttgctcgagcatcgataacagagggaatgatttcaaagcaattgtgtatgacttcatgcccaatggcagtctggaagattggctacaccctgaaacaaatgatcaagcagagcaaaggcacttgactctgcatcagagagtgaccatactacttgatgttgcatgtgcattggaccatcttcacttccatggccctgaacctattgtacactgtgatattaaatcaagcaatgtgttgttagatgctgatatggtagcccatgttggagactttggacttgcaagaatacttattgagggaagctcattgatgcaacagtcaacaagttcgatgggaatcagggggacaattggttacgcagcaccaggttaatcctaaactgtttatgtctacctcctttcattgttttttttagatttgctctggtccaacaaaaaatacctaaagatacagatacttgtacctcacaatattaaatagttttcgatcattgcattgttagatctaacgatcaggaaacgatttggtaccgtgcccgtgaggtatcggaatctcaagatattttttgttcgaccgtagcaaatctatttttttgtttgttttcttctctttaatgttttatgactatgaaataatttttatttctggaaaacagagtatggtgtcgggaacactgcctcgacacatggagatatttacagttatggaattctagtgttggaaacagtaaccgggatgcggccggcagatagtacattcagaactggattgagcctccgtcagtacgttgaaccgggtctacatggtagactgatggatgttgttgacaggaagcttggtttggattccgagaaatggcttcaggctcgagatgtttcgccatgcagcagtattactgaatgccttgtttcactgcttagacttgggctgtcttgctctcaggaattgccatcgagtagaacgcaagccggagatgtcatcaatgaactgcgtgccatcaaagagtctctctcgatgtcatccgacatgtgaagatgtgagacatgctgatgttatgtccgagtatttcgttgtaatctaatgtgaaaggtgagtgtgtgactgcttggttgtaagctatttcctgatctgcccatcagatcatgtatctggtctattgttgtatttctcaaaacaaccacacacctaagtaggagtacacaatagtgtatttgcgtaatttcaatattgatgcatacccatgctatgtgctaaaattatatactgaaattttgagatgtctgaagttaacagtcaatcggggagcgattcacaccataccgggaaatcgacctaatcagctaatctaattctacaggctgcctttgcatgacagtgtgatattaaattagcccagccctttttagcaaacgatgggagggtcaatgctctagagaaatggatgctgttaggttctctcctctctcgattctcagaagaacacaagaacacaaggatagattatggaaccaattgatttccaccgtcgccaccaggttccaactcacgcctagactttcttctcggtacagaacgggccaagcccaagacattacacggtgaattttttttatttatacattttcttattaaagtatttacaaaaataattttttgtttcgaaaatttacaaatataatcgcttgccgccctttgggagggcgatttttaaaaatcgcccttctacagggcggcaggcgattagatttgtaaattttcgaaaaaaaaaattatttttgtaaatattttaataaaaatatgtataaataataaaaattcagtatttaatgttgcttttactaatgcgcttctcccttgccttggcgtaatctggaactccgccttcgatctgtagcccgtcttcttccttgccgagttgtcgtccttgaggttctcagtctcagcacccagcaccctaaacagatgcctttggttaggaaacgtgggtggcagcaacctttccaagttggaatatctcgaaatctcctacacagatttattttgctaggtgaaagcaccgggtggatggcttcaccggggccttctttaaagcttgctgggatatcatcaaaggggacatcctcctggtcttcaactccatctatgacctcagatgtacgcacctgaacctaatcaactcagcaaacatcgtcctaatccccaaaaaggatggggccgacggcgtctcagactacaggccaattagcttaattcacagtattgccaagatcttctccaagctgcttgctttacgactgaggtcccatatgcacgccttgatcccggtcaaccaaagtgctttcattaaaggaagaagcattcatgacaacttccttttcgtcagaaacatgaccagacgttttcaccgactgagacgagcaatgttgcttttcaaattggacataacaaaggctttcgattcggtgcgatgggattatcttatggccttactgcagcacaggggcttcccaaccaggtggataggctggctggcggccctactctccacttccacctctcaagtcctcctcaatggctcaccagggcggcggatcaaacatggaagaggacttcggcaaggggaccccctctcgccgctcctcttcatcttggcaatcgactctctgcagcgcatcctctccaaggcaacagagctgggcgcaatttcaaagttgcgaggaagaacgactcggttgcggacctcgatgtatgcggacgatgctgtcatcttcattaatcccacccgagacgatgtcacggcctttgcggacatcctacaccgtttcggtactgctactgggctcgttaccaacctccagaaatcccaagttgcggcaatcagatgtgataactgtcacgcccagaaattcccgaatagaattctaagcagaatgtgcattaaaaccgccgtccaggaccggccggggtacacaaacgacaatgttgacatacagatccacgtcttacaaacattataaaagtcttacataaatgcagcggaaaacgaaaaataacaggagctaagccttgacttgaactgcagcgggaacaccactccacatgcatcctcgacggcacggacgaagcctactcctcggagaacccgccatcggacacatactcatactctggggttgggggaaaaatagagcaagactgagtactatccactgtactcagcaggtcataccggaatagtggtatgatgcagggatttaacaagggagagctaaacaggttcatttgcacaatactggcatttataaacagaagtcgtatgcgaaaatagttgtaataattaagcagtattaatcatccactgtccaacgttccaccacgttgcaacaggcccaaccatccacctataccatccaatttcattagactaaactaagatgagtctaatcacggtgagtctggttgaccgcccataaccgcgggcacggttattcgaatagttttactatgataagaggtgtacaactgtacccacaagacatagccccacgacacgtttccgtgtgctgacatgccaccatgacataccggaaagaggccgtgacaggacccttcgcataaccccctctagccaagcacaccacacctcaggtttcacccccgtccccagcgggcgacgggcagtcccctctcgtgcctaggtggatccgaaagcgacagaggccgtcgcagggcccgtcccgctccatcatgcccacccttgcctggatgcgtcagctagaggaaagctacactacaagcccagccgttgcccacgctggcttgtggtaagtacgaggaattcttccagggtttcctgcgaaccggtccttaattgccatgggtgcgactagcaaaaccatgcacccacagcccgccatgtgattcattttaattaaccaacaccagagcggtggtactaatccaacattatcatacaaacctacagtctatgttttaaatgagatttccccattgtgtgctagttgaactaagcatggctaagcaattcctagtccaaaaactattcatgttataaccccagctaacaaaggagcatggtatcaaaatagcatggttgtaacaataggtaatcatcccatagtattattgcaaaacaaatgcagtatttgaaagaaaaacattaggacatttgcaatataggattaacatggtcaagtgacaagcatgacttgccttgctttgctgctggaggaacctcggcgactatctcgaagtacaccggagcgtcggaaaagccggaatctaacgacatacaaggcaaacaatgcaaacaggctataagactactgaaacagggaacaaaaccatttttaatggattctacgcatttttcttgatttactgagacttgaatgggcttaaacggagctcggatgaattagttataaattttagaagattcactgtgtttttactataaacagaaaaatccttaattgaattattgcgcaataattaaatcccgacgagagagagggcggcgccgacatgcgggccccacctgacagtgactcgggagggcggtccacggcggaccgagtccacggaccggggaaaaccggcgcaccacgtggcgcacacgtggcaccgacgtggtgcacacgcggcgcacacgcggcggccacgcggcagccgaaccgacggccccgatctacccttgggtaggctcgcgccggcgcgcgcgggcatggcttaagccggcccggcggccatggcgcgcagcggcgcggcgcgcatgcggcggcagcgcgagacgacgaccggcgacgaccggccggcggcggagagcagcggctaagcggcagctagcggcgcgggagagagagagagggaggggaagggggcctcaccgacgacgaccgacgacggcgagcgacggagggcggcggcgttagcgggacgatctccgggaccacctaataaaccgaaaggaaggttagagggggagaggcgaaagggggagggcgaggacgccggccgaaggcggcggccacggccgaactcaccggcgcacggtgtggagtgggtttcggcggcggaaatcgacggagaaggggtggacggggtagcccttggcc

SEQ ID NO: 69271 - DNA, 11952 bp, Oryza sativa
gacgagggagcttaaataggggaggggagtcccggacgtggccggtaggagcgggattccgccggccaacgtggggagtgggggaggagagagaggcgggattccaatcccgcccatctcgggcgcgggcgcgagcgcgagagagggggaagtgggtgcgggggacgcggtgcatgcgcgggcgtggccgacgtgacccgggagaggcggaggcgtgggcgcggcggcggttgcgggcgcggctgcgccggctggaggaaggggacgggcctgacaggtggggcgtcccggggagagagggaagggcggcttgggccggcccacaaggaggagggcgcgcgcggcggccgggtggactgggccgacggcccaagaagaggaaaaggagggaaaagaaaaagaaaaggaggaaaagattttccctgggatttaaaatattgcatgctcaattttaattggttaaaattatttctagggctctgaaaattgcactaaaaatcttgttagtgaatttcgacatgtagaactcaagaaaaattccacatgccagattcgattattatttgcattgattccttagggttttctcttgatttgcaccggtattttcttagggtcatttattaattcgattttaggcttaggaggagaacttcagggtgtgacaataacatagatctgacagacgtgctagagggtctcccagcaatgatggcaagtttccccttaaaatacttgggcctcccgctagttcttggaagattgcggaagacgaacttgcaacctgtttttgacaaaatcttaggaaaggtcgcaagttggagggggaaaaacatgggagcagctggaagagctacgctagtcaagtctgtgctctcagcgcagccaatctacctcctgactgccttgaaggtgacgaaagaatccctggagcaacttgataagcagagacgtcgttttctctgggctggcacaggcgatatcaccggaggaaaatgcaaggtcaattggacaaagacgtgcttgccgactagccagggaggcttgggagtcctgaacctagaaaagttcacaagggccttgagactgtgatggctttggcacgaatggaaagatccgaacaagccgtgggtgggtttggacacgccttgtgatgaaatcgacaaagacctcttcgctgcctcaacaaagataaccgtcggtgatgggaatatgacacgcttctgggattccgcttggattgatgggcgcaggccaaaagatcttatgccgttggtctacgcgatctccaaaaataggaaaaagtccctacaccaagggaaagaggacgacgcatgggtgcatgacctgatctttgacgcaggctcaaccatcacagtcaatctagtggaacagctggtccgcttgtgggaagcggttcagaatgtgcagttagtcagtgaagagccggatcagattgtttggaaattcacaggcaatggccattatacagcctcttcggcatatcatgcacagtgcttgggggcgccaagtacaaacctcaactctttgatttggaaagcatgggccccggggaaatgcaaattccatgcctggctcatcatctagaatagagtctggacgtccgaccgacttgcaataagaggttggcagaacaacggccattgccccctctgtcgttgcgaagctgagacgggattgcatcttgtcgccacatgcagatacacaaagagaatctggcaccacgttgccggatgggtgggatatcatcaattggagccgtcccagtgggaggaagcccggtcagtccgccaatggtgggaaagcctagcaaatacccccaacatcctaaaaaagggccttcggtccctcatcctactagtagtctgggaaatctggaaggagagaaatcggcggattttcgatcacaaagagatggcggtaggccttctcctagcaaaaataaaagaggaggctagcctgtgggccttagcagggacaaaaagattgcgcgaattcgttccacgcattgtatagtttatagcttaaagtcttttttctttacccttaggggttgtattttctcctttatattcaatgaaaaggcgtactcttgtgtcgttttccgttcaaaaaaaaagattgtaacgctaattagttacatatgtttataaagagttatatgatggtatattttttgtttttaaaattttaaaaaatatatatcaattatataaatgaaaaaaagaagaaaaaatgaataaaaatggagggagccgtacgtactacatacccatgtacgtacttgatcacctgtgcacgggagaacgcacaggagagaggagagtgggacccatagcattttgtttgttttacgatcaatttcatctaacggtgtataatattggacccactaatttaagtgaaaattaaggggtagatgttttgcttttttcttaaaatttctaggattttctctaatttattagagcgcgatgtgacaacttgagagcgcttgtaggaattttaatggacttttagtatataatagatatatttaaattatttggtcagtttaaataatatttgtctgcaaacgagttatgcacctcctaaattgcttccatatacctgcattttttccctgttcagaaaatggaatagctcacctctgtgtcaattggtagcatgatgtttgtagtgctaacagtgtgcttgttacgatattgaaattagcgttccttctggttcacatgatatccaacatacatctggtatattttctgaagctttttctcttcctaggctgtgttcattagcacataattaattaagtattagtcatttttaatagattaatatgattttttttaaaacaacttttatataaaatttatttattttgaaaaaaccgcactgtttaatagtttaagaagagtgcgcgcaagtgagttgggaaagaagggcgaggaacatagcctatcgtttaattaacagtttgattggatagctacaccgaccgacgattgtgttcgatctgcaacaccaccatcgtgatgatgcgtcttgtatgtcatcctttgatgatgcgtttgagagccagcacaaagagaagaaaaagagcatcgtttttcacgtggtcttttgaaaaactttctataaaaaaagttactttaaaaacatattaatctattttttcaagtttacataattaatacttaattaattacacactaatagcttatctcgttttacgtatcttcccaattttctaatttcctagttttactcactatgcgctcatagcacatctatctatgtatctattatttcctagttttactcactatgcgctcatagcacatctatctatgtatctattatatctttaaagtaatagaaaaaggagcctacacgttcgctctcacggtatagaaattctcacattaatctaaaaaaataaaaaaaatagaactagattaggattaggattagttaaaaactaaagaaaggagaaaagaagatgaatcggacaatcagtcaaaacgaaaataagattaatcaaaaaaataaggaaaaagaaaaatagaactagattaggattagaattagttaaaaactgaagaaaaaaaaagattaatcggacaatcagtcaaaatgaaaataaggaaaaccgagtcatacaatacattggaaactgacaatgttttgggaatccgcatgttcacaccacttttagaaacattgaaagacaaaccaatcctaattaaactctaataaaactcttgccgtttccgaatcgtataagtacttgtcatgtcaataaatacttcaacaagctaaccaaagcaaaccagaaatcttcaacaagccaaaaaaaaacttcttgcagtgaccgtcgccgtgatcatcaacaagcacgccacaaattagcaatttcaccgggttcttgccgttcaaacttctcgccagcacgccacaaatctgcaagccagaagttctcgccggaatccacttcgtcaatcaaaaaggcacccaggaattgttcttgctgaatcactatggcatacaagaagattagtgagttgacaacaaaaggtcaaacatggagaatcaaagcgatattgagaatgtaggaatcggtaaattttgcaacagatgagattatgagttttgatatgctattaatggatgaagtccgtacatgcagaacaaggtccgcgaaataaaacggactggcacatcctatctaagtccaacaggattagattaagccgacattccagaaatgcaaaaatcattaaaaaaataaaaaaagaatcactgaagcgctcaccatccggagaggagttgagaggctgttgggggaggatgcgtcgatgctagcgcgtgcataagctccatagaagatcaggacccgacgcggccatggacgcccgccgtcggcggctggggaaggagcagcctcgatctacgcctgcgatggcgtccagggagggagccgcctcaatccgcgcctacggtggcggccgaggacggagccgcctcgatccactctggcggcggtgccggggacgcgccggagaaggggacacggtggggaggggaaaagggcggcgccgctcggacggggaagagagggcggcgccgcatcgatgcgttcgatggggaaggagagaagcgaatcagtgagagaagggttgggctgacatgtgggtcatagaagttcaagggtacatctgtattttttttttatgttctcatagggtctaaaaacatacaagtttcagtaataaatatttcaatgactaaggtgatctgcactaaattttaatccatgttataccggatatttgacactatttagtagtattaaatgtagcaccattactactgctccttattatgggtaatcactggatatactaataccttcatattttaatatatgacgccgttgactttttatccaacgtttgaccattcgtcttattcaaaaaaatttatgcaattgtcatttattttattctgactagattcatcatcaaatgttatttaagcatgatataaatattttcatatttgcacgaaaattttgaataaaacgaatggtcaaacgttagtcgaaaagtcaacggcatcatacattaaaatacggagggagtattaagcaagcaatctaaggattatttaaaggtcagctttgttcataacttttgtgcgctaggtacagcgatcgatccaatatctcacttgcttttttttttcaaaacagtaaaaaacattacagaatatttttccaatattttacagaatacttgctaggtacagcgatcgatccatttattattttcaatagaaaaaacatatttttccagggggtgtttagatacaggggtgtaaagtttttgcgtgtcacatcgggtattatatacggtatcgcatggggtgttcaggtactaataaaataaactaattacagaatatgttagtaaactgcgagacaaatttattaagcctaattaatacattattagcaaatatttactgtagcaccaaattgtaaaatcatgaagcatttaatcgtaaaagattcgtctcacaaattagtcacaatctgtgtaattagttattattcaccctatatttaatacttcatacaggtgttcaaacgttcgatgtgactgtgtgtaaaatttttatgtgggaactaaacagggcctaaaacacattagccaaccatttctaacatcaaaacaatctcttttttagtttaacaatacctcctaacaattatctttcgagtccatgtagaagtaaaaaaaatataaaatgtaaattcagaatttaaaaaaataataaatattataagaggagtagatttatgctcccattttactatcttttaaaaataaaatatgaaattatatgacaataccctctatataatacaattcaaagcagtgcaccgttcccggatcataatcacccccttataaacaaggtaaggactccccagcgacccccgtgggcttatctccgccacttcacagtctggtgctctactatgaaccatacaatacagaaagtaaagccgttgcccacgctggcttgtggttggcacggtaaatgttttacaaccgaaaatcgtgaaccggtccttaattgtcatgagcacgaccatcaaaaccatgtgctcacaacccaccattatcaagttttagttgacaaattaattaattaaccattcatgattaaccttcatgagctatcattaagccatcattatataatagtgaggcataagttatcccaatagtgtgctaatgtttctaagcatggctaagcaattatgcctaatatctagttgaaccattatataaagctcaactagtcaagttataataacccaaggtatcaaggaataaagtaatcaagaacaaaagggccataacaaataataggttaattccacccaattacattcgaaaataaatgcagactttgaatagaaacaatagctttaaacgggatcaacatgctcaaagggttgtttgggatctgtgtgacttgccttgctggcctcggaaatcctcaaagtcttctcctgcaaattcggactctccgggaacgtcggaatctaaagagaaaagaacaaaatcaccaaacagtacataaacaagcatgaacagtacttgaaccaactaaatccgagctaagatgaattagttatgaattttcaaagattaaatcggattaaatcatttatatggattttaattgaattacgacgcaataatgaattatttttgaaaagaaaaagggatttattgcgtcagtaggtcgggtttacggtggaccgggtgcacggcgacggttcacggaaacggacggccgagatctatccatccaaaacggacggctgagatcggccggtccacgaccggaccacggcggatggcaacgatgacgacggcgatgacgtcatcaccggcgacggctcggcttcgcgtgctcgccggcgatcgacggcgcggcggcgcaaacggaggacacctacgcgttgcggacgacacgacgaactcaccggtgaccaaaatagcgacggaggagcaatggacaatgccggcaacgaggttgaaacgacggcgaccttcggcttaacgacggcggcggtattccggcggttgacagcgacggcgaaggggcggacgaggacggcggcagcttggcgaccacgacggtgacctccccgagcagtgacgacgaccggagcgacggcggcgcacggctggagcggtggcgacggcggcggcgcgaagcggcacggcgctagagctctaccggcgacgagagactaaggcgagggtggcagcgggtagaggggagctcgggggtcaatttataggggctagggagcggcggcgaaggcccacggcgaccggcgacgggaaggaaagtttagggttcggaggagagagatcgatccgaattgaactcaaatccggcgatttccaaagcgatttagacgatgtttccaaaagggaaaaggtagagtggatcacggggatcctttcccctcaatcaattcgaccggagacagaaaggggcggccggatttggaatggcggcggcggcgcagctcggctagggtttcgactagaggaagacgacgactgacgggtgggacccacatgtcagcggcggtcgcacgcgcgcgagcgggcgggcgctcggcttgggccgacttgggccgagcgagagagagagatctttgggcccaaagccaaaagagaattttaaaaacctttttccatttaaattattcattaaatgcaattccatttattaaaaatacttccttagctcaaataaatcccagaaaaatctaggaattatagaattaagcaaagtatttaatgaaattttatctggccccattttatattggaatttattaattaaaattagatcttatcttctaggcttttacaataaattctaataattccaattaaacaacaatttatatttttgggatttttagggtatgacaatgacattgaaaaaaactcgatgttccatgaaataggattttctactatttaaaataaaatatgttactaatatacgtagttaaactagatcttctataatataaaataaaatatcctatcaatgtttttaaaaatatatatgtaatttgtgttccggtcagatttctcaaattaaataaactattaatgtctatgttcctaaatacatcataatacatgaggccgatatataataaataatattatgataatattttaaaggaaaaataacgaattacctctaaactattatgatagaccgaattatccccataaacctaaaaaccagacatctcacaccctaaactattaataccgaacgaattacccctgactcaacccgaagtggtttcggttctaccttgtagtcccgtcagcattttcttaaaaaaaaaatctctctttcttctccctccgatccacgtctgtcaatcggcaaggctaggggcggcgagcgggtggatcggaggagctcgagtgaagagcggtggaggcggctcgtcctcagcctccatcggcacgcacctccttgatggacacgtgacctcttcttggcctccactggcgcgtgaagaggacgatagtggcggggcggaggagctcgagctccgtaggcggcttgggggcggtgagcagcggaggcggctcctcctcgactttctcggccgccacatgcacactccagtggaggctgttgtctccatccttttcgtcgcatctcgtcgtcgcatgatgagcgttgtggctgccggaggcaagcacctgcgctggtcttctatggctaggtttggctacgccccccccatcgagaactccccaacaaataaggccgcaactctatctagctaccatagcatgtcgtcgcatcacggttcttaatcgatccccacctagaggcatgcctctctcccgacgagacagaaagcaccaatcaatcaaagaacatcgaggtggatcaatcaagtgatcaagagcaggggaatagacaaagatgaaggagaagagcggcgaagcgacagtgcgcctgcccggcttgtccctgtagcagggggagggagaagagagtggctggggaatgggattgaggaagagagggagagagataggtgagaggggagatgaataaagaaggtagaaagtgtgacagatgggccacacctattttatttttttaaaaaagttaactgtactgccacgtaggtccaaaaccactccgggttgagtgagggggaaggggtaatttgtccggtattaatagttgagggtgaaacatatctggttttcgggtttatggggtaattcggtctactgtaatagttagggtaattcgtccttttcctattttatataattccccatcatatttcaagtgtcaaatatcacttgacgactatacaatgctaatttaaatcaacataataaatgaaaacaccacaatttagttgtgtatctttaagtatatatgatttaattttaatttgtttaagattaagattctcaaacattttttgaatttttataactatttcattagtatatgataagtgggccacataaatgttacatagaataaaaaaatatgaaaaatatttcaagccaatgatattgctataatacaaccccttagtccatcgtgagacttatgatcataaatgtatgtttttctctttgtcaaatagttttcaaaacaaatgaactaccgagtaagttgtgcaatacactattcatgatatattttcttatagttgaggaattccaacatatcaggcataatttgatgaatgtatgttatacactctattgacgtgactataaagtatacttcaataaagcgttgaaaatcaccggacacaaaactatagatatttatcaaaatatatccaataatatggtgctttggagattatcgtggtagtacttaaaaaaacctttatctttgttaaaaaaatcacatacagttgtttaggatagaaaattacgaaaatgtatccctctatgtttagagagaaaataaatgcgggcgtgccagtgtacctagatacacaatgtaaaacaaacataaaagagacacagaaacacatgatctttattaaccgaattaacaagatacagtttccatgtatgatataaaatacgcgtgccattgcctgtcgttggacagatcttgacatcagcgatgtggtcttctggttcctatggtctcgaaagactcccagttaattacctccgcaggtctaggcctgcagagcacctccgattaagctgcttgtggtcgtctcatcgtcttcgcttcacgttttccatgcatggttgtgatgatggtgtagatgtgtgtgtatatatgtgagggcgccggtagcgatccacggcctcgtcggtccgtgcgctggtgttggtggcgtagccttcatatagactccgcccgccctcgtcgctccgcctcatcactcttgagcgacgtgtcggtgtagattgcttgaagaagacatgcatggaatcgcatagcttggacggctcgacgtcatagcaacagcatcggaatggtgtttaaaggtaagatgaattggtgaagtcagttggtgtacacaacagccgaataaacatagctgggcacctcttgactagatgagatcaaagtaatgaagagttgacgaagacagtcggtgtagacgacagccggattaaacatggctgggcacctcctgacccgtcatcaagatcaaatgaatgaagagttgacgaagacagttggtgtagatggcagccggatgaacgtggctgggcacctcccgactcgtcatgccccttatacaacagggacttgtaacaaagatgttgatgaagaagtcgatgcagacagcagccggacaaacgtggcttggcacctcctttagatgatggacctattattgattcggttaatatgataacgaacccatgaaaggggctctatgagggcgccggtagcaacggtgaccttggaagaagtaaacgtctcatcggcgggatgaccgagggcatttgttggtgtagatctggcacgaaggcatcacagatggcaccattcttgctttacgttgatgtagacaagcgacgctccaatacacgaacgagcggcgacatcgatcttgacaaagagggagagaatcctggacgaacggcgctaatgtcaatgtgacagaagagagaacatcacggacaaacaacgtctcatcatcttggcccggtggagggaagtcttcatggccggacggcacgacgactccggcatgacgatggtttacgggcaccaagcagtggtgctccggcgggatggtcacatgacgtcatgaacgaccccagcatgatgaagtgaaagcgtcgcggacgagcggcgagcggcgagcggcacgacaacctcggcttgatgaagagaaagaatcacagatggacgtcatgacgacttcgacttgacgagatgatgacgatatgctccggcgggcggcgtgatagtgttctatcggcatgaacgagcactgcatggcagtgctcggctgcttgataattataacgagctctcaagtgctatagtcgagagcagctcggcgacgtcgatccgcgggtgctccgactatccgtggcacgctccagcaagacggcgtgcgggcaccaaaccatggcgctccggcgtgatgaagtgaaggcatcatgggccggtggacttgacgacagcgtgcgggcacctagcagtggcactccggtattgcataggttgagtagatgttgatggtgtcgcaatgcataggttgcgaccagcaaagtaaggacacccgacgtcttggcgacgtcgtacactagtacagatgatgaactactg

SEQ ID NO: 69272 - DNA, 4925 bp, Oryza sativa
ttgagatgacctccattatctcaatcgggcgcgaataatgagcccgtcaccgatgagtgtcatcggtgatgggctccaagaaggcccgattgagatagttttaatgcccatcaccgatgactcttataggtgtcgggcttctatttgtgtccgttagagattaatgtgcgcccgttagagatgacatttttttggcccgattgagatatactttgcacactatatatactccagcagtccgttgtctgtagtttatcccactgttcactattttggtgggaggttgaagggggcgaatttttgtaatttttttgcaaacaaaaacaggaaaatcataaaagtaagtaaaaggatactaaacatttcctattaatttagtagtacttatgttatgagatgttaactaatattttgttcattgttcaacgatggatcgaagttggatgtacacgactggcttgaggcgtcagtagaaggagtatagagatggcgtattaagttttatgaaagccgcagaggaggataggataagaagaaacgacaagtacatgtgttgtccatgtagcgattgcaggaatgagattttgtgggaagatgaaaaggaagtacacgctcacttgatacgccggggattcatggaaagatacacacgttgggtgatgcatggagagcaagatctgggtactgatggagcagctacagacggaagtggtgtagacaatcatgaagaaggagatgaagaagagcatgacatgtttgtcccatctccattgggcagtgaaatggttgatgtgtaccctgatatgctgcaagacatgttatgtgacattaatgacctagctatgaacgagagagattccatgaagttcaacaggttggtcagtaactcggagactcctcgatacgcaggatgcaagccaaagcacaccaaattatcagcaacattagatctaatgaagttgaaggctagtagtggatggtcagacaagagttttacataacttttgggaatactgaaggacatgcttcctcaggagaacacattgcccgagacgacatatgaagcaaaacaggttctgtgtcccctagggttagaggtccggagaattcacgcgtgtccaaacgattgcatattgtaccacaagcaatacgtggacttagatgcttgtcctgtctgcaaagcttctcgatacaagcgaaagaagagcgcgggcaagagaaagaagtcaaagcggggtggtccggcaaaggttgtgtggtatctaccaatcattgatcgtttcaagagaatatttgccaaccccaatgaagcaaagttagtacgttggcatgccacagagaaaaggaatgacgatttgctaagacaccctgcggattcgattcaatggaggaatatcgatcgaaagcacaaagactttgctgccgaccccagaaacatgaggatatgtttgtgtacggatggcatgaatcctttcggagacatgagcagttctcacagcacttggccagttctcattgcgaactttaacctcccgccatggttgtgcttcaaaaggaaatatattatgttgtgcttgttaatccaaggtccgagacaacccggcaatgacatcgatgtgttcttgaagcctgttatcgatgaccttgagattctgtggaaagagggtgtggaaacttgggatgcatatggtcaggagaacttcacactacgagttctattgttctgcaccattaatgattatcccgcgctgggtaatctttctggacaaactgtgaaaggaaagaaggcatgctctgactgtatggaacatacacgtagtaggtggctgaagaaatcaagaaagatggtttatatgggtcataggagatggctccccctacggcacacctttagaagaaagaagaaaattttcaatggtaagaaagaacttgggtctgcccctgcggatttgtccggagatcaggtacacaacatggtgaaggacattactaatgagtttgggaagaaaagaaaacgtagcaaggaggacaagaagaggatgtagaagaaaaaatccatattttggcggctaccatattgggaagatcttgaggtccgtcattgcattgatctgatgcacgtagagaagaatgtgtgcgatagcttgctggggctattgttgaatatgcctggcaagacaaagaacgggttgaatctgcgtctcgatctacaggagatgaacattcgcaatgaacttcatcctgttacagatgagaatacgggaagagtgtacctcccaccagcttgccacatattgttgaaggatgagaagatcgcaatgctatcatgtctggcagatattaaagttccttcgggctattgcgcgagaataagtaagtacgttaaattggaggatcttaagctggttggaatgaagtctcacgattgccacgtgctaatcacacagatcttgccagttgctataagaggcattctaccaccacaagtccgtcacacgatccaacggctttgtgccttcttcaatgcaatcggtcagaagattatagatccagaagacctagatgggttgcaggctaatattgtcagtaccctgtgtcacttggagatgtattttccactagctttcttcgatatcatggttcatctcactgttcacctagtgaagcaaacaaaaatatgtgggccagcttttatgagagaaatgtggccatcgagaggtacatgggaattctgaagtcctacgttcggaacagagcaaaaccagaggggagcatcattgaaggttacacgaccgaggaagccattgagttttgtatcgattacatggccgagactgatcctatcggagttcctacgtctcgccacgaagaaaggttggcaggtgtcggcacaactggtagaaaaagaattgttcccgatcaagcttcctacgcgcaggctcatttcgcagtgctgcaacatatggttgaagtaaccccatactttgaggagcatttagcgaaggtccgacaggacaatattgatcgatcagatatttggatcaacagagaacatggtgctcgcttcaacgaatggttcaaggatcgtgtagcacggtcgatcgatggcccaagtgagatattacaaaggttggcaaggggtccatcttgggatgtagacacatggcaagggtacgatatcaatggatacacattttacactgtcacacatgatgagaaagcacagtgcaaaacagtggagtccgtatagatgcatatcaggatcaggttggatcgagcacatactacggccgcatagagcagatatgggagctgaactatctgaacttcaaagtccctttgtttcgttgcagttgggtgaatatccgcacaggtgtcaaggtcgacaaggagggcttcacattagtggacctggccaaggttggatacgcagacgaaccattcatactagcgaagcaggacgaacagattttctacataaaagacctcgcaaacaagaagatgcacgtcgttagggatggcaagcgaggaattgtgggggtggacaacgtcgtcgatgaagaagaatacaacaagaatcttcatgtcagacctcatatcgaccttgacgatgatcccgaagacaaagtggcttacgttcgttcagaccatttggaaggcatatcactgtgaatgatgtatttaatttgtattggagacttaatgaatgaattgcatatgtttcatgccattccagttaaaactctttgaagaaatggatttgttaattatgtggttttaaaaaactatacttgttattttaaactatatgtgagatagccaattgttaattatatgaatttaaaaagagtaatatgaattttaaactatatgtgaaaaaggcatttgtcaattagatgattttaaaaaaataataggaattttaaactatatgtgagaaaggcaattgtcaattatatgaatttaaaaaattaataggaattttaaactatgtaaataagacatttgttaattatatgtgataaatcaaatgcaatagcaattttaaatcgggtagaagataattataaatgatttttataacttaaaaatattttaataagtcatctgtgacaggctttagtactatgcccgatagagattattccatctctatcgggcttagttctaatgcccgtcacggataggtatcatctgtatcgagcagagtactaacacccgtcacggatgagtgtcatccgcatcgggcatagtagtctgcccgataaagatgaggattgactagggtttacttagtcaatcctcatccacgggtccttatccaccgccgacgccgcctctcactctctcagatccaccgccgccgccgcctcctcctcctccgccaccgctgatgccgcctcctcctcctccaagccgtcgcctcccgaccgccgccgcctcctcctcgacgccaccatcgcctcccggttcaatatccaccactgcctcctccatagtcgtggatccggccttcctgaccgcccccgccgcctcccggttcaagatctgccctccccgaccgccagcgcctcctccacgcccaagaccgccgccgccagcctcctctccaagttcaccgccgccagcttcctctccaccaagtcgtcaagaccgacgccacggccgcttcagcgactgacgtcaagcccgccgccaagaccgacgtcaagcccgacgccgccggcctcctctccaagtcctccgccgtgaccggcctcctctccgccgcttctcctcccaggtacgcttcctctcccttgttttttttattcattgtggatgcattgtggacgcagtgtgtggatgaattagatgtatggatgcagtggatgcagtggatgttttttgcattgtatagttggatgaattagatattgctatgc

SEQ ID NO: 69273 - DNA, 18590 bp, Oryza sativa
cataagaatagaccatatacacttgtgatttttgggttttttcaataagaacagaccatctacacttgttcattttattttggggggggggagtggcagtatgggatcattttatatggctgttgttttttttttttgcataaggacaaaccctctagacttgttcttatatggttctttgcaaaatttttgggatatttttggtccaatgggatggatgaattgatgtgggttgtgatggttgaattattatggctgtttcttttttgcataaggacagaccctctacacttgttcttaatttcttttgggggtgggggcagttgcaaatgatgataattgaagcataatttctgagcaaaactgaggccaaacttattatatgtcatgacttgtgttttttaggtacaaaaataatatatatgtgacttgtgtagtatgggctgttttgggttattttgagggaaatgggatggatatgcatagaaatctgttattaaatgaagttactgaaattatggcatttaggagaatacgaagtgtcctggttgccaaatctggtttggtcaggttactgcctgcacgataccgaccaagacaaattggtaaacagaacatttcgttcaaatacaacatttctaaaaatcttttatcgttaccaacatcctagattgctttcaaggtcatttctttatggaccccattcccataaattcagtatccaaagatggttgctgtatctatgggaataagggttccataacgaaatgatcttggacgcaatctaggagtttgctgatgataacgttagggatcttggataggaagggttttggttgcctgtgtgttctatctgcatccacctcgtcagcagatatgtagcatccatattcctcagcagacgggatctcgacctcgacattcatatcccactagaacttgctaccgttgccactttcttatgttagtgacattggtagcaagttcgagtgggacactgatgttgaggccgagttcccggctgctccggctctattgagcatggatgctatggttccgtcgacgaggcgaatgcaggtaggagatagaggtatatcaaaccataagagaatgtgtttaaaaagtactttctccccgtacaacagtgacataggacatgtcgcagcaaggcgaaccgatgtcgacaaccactattgggactacatcgagccggaatcctaggacccagaataagattcctaaggaagtctacaccataacagaggtggacgatgttggatatccgacggctccgacgaaagttgtcaaaaagttccctacgatatgcggagtcctagggaggcggaacttcactattctgaaggaccacatcgatctggtccctcaagaagaaaaagaagaggcctggaggcaattcaaagaaagcttccgataccctacagaggccgaggcaggactgaagcggcaggctatccgcaacatggggaattgttggaaaaatttcaagacaacgctggtcacggagtatgtcctcaacctcgcccagccagaaccatttgggaaatacgcattcatcacccaacccgtgtgggatgagttccatgccgccaaatcaacgaaagagtctcgggaaaaaaaccagacctaccatgatctgcaggcaaggaaccttcacccgcaccggcttggcaccggaggctacacggggaaacaggcagaatgggacaaggaggatgaagctgcagcggaatctaacaccccgcaagtgcttgctgatatcccggtccagcgggcaaggaactgggcaaggacaagggtgaagaagaatagtgacggaactctttcgttcccaaatcctgaagatcaagcggtgtaccagaaaatcgtaagttgaacacatagaataagtttcattatgttgtatcttgttcttcgtctaacgcgtcctaactgtaccccaggtcgaactgaatgctgagagacaggcctcccaagaggtctgcccacaaaaacgcgaggatgacattctcacgaaagcgttgggaaacgaagaacaccgtggacgaacaaggggcattggctccaatgttccatggaagtttgggtttccccaatacgcgtggcagtacaagaagcacaagctttccaaggcgcagaaagctgcacgcattaaggcccaacttcgggaggagcttaaagaagagcttagagaagagctcactgccgagctgttaggtatagaggctcagatagaggcacgcatcagggataggtcgaccgatgccactcccggtcccatagtacaagtgagccccacgcagaggcatagcagctgcgcatcaactgaggctccggcagaacagcctgaaggccccgccacggtggaccacataacggtaagcacaacttaataacacatatattatattagcaccacaatacattgcaacatatactaaggacactaatgaatctatcgcaggaacccacatcgtgtaccctagtcgttagggtgacaccaggatttgcaattcctgccgcagagggtcaagcattcaagcctacccaggagacccgagtgcatggggcgcagctgcaagccggcaatgccaaagttcaggtggacttagtgaagcccgattgggttggctacactatcccacacccacctaatgacgagattctgacccttggggctgcacgtgggacctttattcaatggcccaagcacagcattgagatcaatataactccaaggctagcgccaagttctcgtccgccgccgacgcgtccccatcaaactgttgtatctctcccttctgccgttgaacaaagagatgaagatctccaattacagtatgatactgattttggggacgacggtatggaggttgacagcaggccgcacctcccccctcctgccaaacggagcaagagggcgaaatcttctccacccaagcttgacacacgcagaaaagctgctggaacggggagaggaaaaataaaggtgccattagccccaaagaagcttgatcttggcaaggcgccagtagctcctccaaagcctctagccaaattcatattgggcatgccattggtcggagacgatgccttattcaagatgggccctgcttgcaaggagttgcataggtacatggagaagtccaacgcaaggaggaagaatagagagacctccatgttgggccagcacgatggtcagccgttcctcgggcctactgccttcatcgccgtagacttcaaagatctatgggacctctacagggtgcgagcgatcgacaccaacctccttaagtgctactccttgtaagtatttgttagtacgcgatatggtagtgactgtccataaattacgcttaccctgactcttgtcttgctcgtaggttaacctggaagcatgtccatcgtaaagcaccccatgttgccttactcgatccagctgtcgtcaacgagacaacgctgaaaaacgatcgagcaaacatagtggcctatatcaaggactgcttatttgcccgtcaagacaaggacttcattatgtgcgcctacaattaacagtaagcatgtaccgtacttatactcaaatactcaacgcgtacaactgtagtatgtaactggcaatttaataatttcgcgggcgacattggattcttctggtaataacgccgaagtggagtttggtacactaccttaagtccaatatcaagccagaaatatacgattggtcggccatcgaatctgccttgaacgaggcatgggaccaatacgtggcaagaggcgggaggcataaggatgggcatcccaaactcggtcacaagaaatacttcccaatacgtcaacaagttggcgaccaatgtgggttccatgtctgcgataatatgaggagcttcgcagacaaggtgacattgctcgaccctgaggtgtgtaattcaattgtttatacacacataggacgacaaatttacaagtatgtagactaacttggcgccgaacatgcaggaatttatttcaaggattccggaaatcaacttcgaaatcattagagaggagatagcacaattcatactagatgatatcttgtcaccgaaagagatgtttagagtgaagtcctaggtagctcatctcggaatggcagaacatttgcaatgcatatgcgacaaacatttgatttttgtaaatattctttgtaatacaattttattctttagagtaaagtcctaggtagctcgtctctgtatatacttgcatttctagttacatataaaattgttccaatttataacttatttttgcaacttttgatgcatgtcggcggtttggagagaaaaatatatgtgaatgacatatatgtgaatgggttgtggatgtgaatgtatatgtgtttgattttgtgaattggctgtgatgtgatggaatatgaatgtgaattggctgatgtgatgctgggaatgggtctatatgaattggctgtgatggaatatgtgaattgatgctgggaatggggttgctgggaatgggactatgtatatatatgcttctgtcatttttgcagtgggcatggctagcaaaggcctgaggctagccaaaaagacaaattttattttttttggttctaaactcatccctgacgggcatttagctaatgcccgaaagagataactcatccgtgacgggctatagagtcctgcccgttagagattagtcatccgtgacgggcttttagaatacacccgatagagataagtcgtccgaattggactagtttgactcaacacgtggggtcaaacctatcggtgacgggctctggctaaatgcccgatggagatgactactcatccgtgacgggcttagtggtgtgcccgattgagattagtcatccgtgacggactcctaactacgctggtttgactgatcatactcatctgtgacgggctttgtttttggcccgattgagataacatccatccatgacgggcttttgcccgattgagatttttcctcacatcagtgacctttgcccagtgacgggggccttacccgacaatgatgatgctttcagcccgtcatagataagcgatcccgttctagtggtagcaccaggtagatgcgatcttcgacgactccggtgatcttcggcacactccggctgggtagcatcacgatggccttcttcagcgggcggctgatgatgatgattagtcgacgaagatgagcgctgcttggtagcgcctcggcgactcggcgaagaatagtcatcgcggacagagggcatgacaagtcagtgtctcacagcgactcggtgaagaatagacatcgcggacagatggcatcacaaagtccggcgcgatgaagcagaggcgtagtagccgaacgacacgacgacggtgtgcgggctccgggtagcggcgctccgaccggcgatctcctcgagcgtgaggaatgaggacgagcgtgaggaaaatggccaagtccgcgagagcaagcgagcatcgatgatgtcgcgaagagactgcaactggcaaagcgatgtctcgacagcatcacgtcgccgggtagagacgtcgcgaggtagaggtctcgtgaccggcgaggcggggacgtcccggcggcagatagacgtgtcatcggcggacggcgtctccgacgagagggaacgacacgatctccaggaggaagcagcagccggcagcaactcgcctcgtcgccatctcgtgcatgcatgacgacctgaaccgaaagagaagaaaacaaagagactcaagaggctatacccatggtgcggagattgccgatgcccgtggtttagcgccggcttcctggtcgctggtgaggcctcctcccgctgagccggtcttgcccggctgctccggcgaggctgcgtcggcgccgcgatgaagcacgccgctcttgatctcgatctcgtcctgagtcgttgccggcgtgcaccactcctattgctggcgagatctcctattgcagggccgatcctgtacggcggctccggcgaggttgcgtaggcggggcggctgtcagagcaagacgccgatggttttctcctccatgaccttcatctgtgccttctgccctcgcgagtgacgccatgcatgactccggccgcagctccacgatgacatggtgtgatgcatatatgtgctgattgctgaaagcctgaaatacagagagagagagataaacaggagaagaactggacaatgttagatgagatcgtcctagaaggagcggcgtcatcgtcttctccggcgagattccgtggattggcacggcttgttgacgtccgcggttgctcggacgattcccggcagcacgacgtggtgcgttgtcctcgctgcgtggcgacgggccggtggtgttgccgagtagaggcagcagttagcgaaggcggcgacgtccagcgtctcggcaagatcgtcgcaacgagtagaatcatcaccggcagcaaaaacagatgagctcagtcctgaggacgagtggcatcgatcttgacggaggcttgcgatcgatcagcaccaacagatcggtcgacacgacgactccggcgatggcagcacacccggccgtcctccatgcatgcacgtacgcactggaaccaaaagaaagtaaccaatctaattagagcatctccaagagtctagctaaatggctctccaaattaaaatttggctaacttgctccaacagagtagccaaatgcctctccaagccatccggctggctaaattccccaccagactagccaaagttgaccagccaaaaccggctagccatatatgggacccacgcctgtttccccctctctcttcacgcggcagtgcggcacgcacatgtgacgaggccacgagggtgccgtcgcctcgtcgtcgccgcggccggccccgccgtcccgtcgtcgctgtagtcgaccattgccgccccgtcgtcgccgcggccagccactgccaccgccaccgccgtgctccgccccgagctccactgctgcccccctctagatccgccgtcgaggtcgtcgtgagccgccgctgccgagctccaccctgagcggcgtcgagattgttgtcgcgagccgccggcatctcgcctcctgcctccccgcgttgccgcaccaccacgcgcggccgcacgcctcctcgcatcgctgcaccaccgccggcgaagagagtggcaccggcgggcggagcccgagcggcggcggcggcggtggatggcgacgcagcccgagcggtggtggggatggggatgaggcggcggcggcggatgggagagggaaggggggtttggagagaagaggagaaagatgagggagaaggaggaggtgtagaggctgacgtatgggtccaattgtcatagactcagaatagagaggacgaatgaagaggctgttggagtaaaaagacagtttgatttgctaaattaaatggagagttggcgaaatagacatttggagagtcaaatttggagatgctcttagctttaccagtagtggccattagcttgctgttcttcctcgcgatcctgctccccagccgacggaaggtgttgatgtagatggacacagcgcgcggtcggccggtgtcgacttgccggactgatcctccttgatgtcgcttcttgctatgacgggggttgagtgattgtagatgaatagatgagtccctctgagatggatgttgatgaatgtggatgacggcgacgggtcggggtggatgagtctcgatgctctcggcgagagtcggatgaatatatgtcgatgctgcccgcctggctgcctccgtcgtcctccatggacgtcgccagtagcagcgccggtgagaccgtctacgcctcctgtgctcccctccatctctcttgaagccccccgtcatagctgaggatagctgtgccttttataggcacaatgggtcggtggtggccgcgagtagcgcgcggcgtcgttgccaacaagcagccccgatatctctggagataaagcttatctggttgtttccatcgatagagataagaacatgatctcttggttgtttagttttgctgttgatcgatatcgatggaggcctgcatacgcgtccaccttgcccgcttgccggagtatatatacggtcacatatacagctggcccatgtaatcagagcccatcggcccatgtgtgtgtattgctgtacgtagcgaccgatcgagttgcagatggttccagctacccgtatatatatacgtagaccaatccatgcaatacggccgcatacagtttcacgtaaacgtccatgcacatatatatagacgtgtgaaataatcagcctcgatcttgtcctcttgctagctggtttatttgctctcatgcatgcatacgtgtatatatgtatagccaagcatgtacatatggctgaacacacacatgtatatataggccatatagatggacatatgccaagtacgagcatgactcatgcatgaatcaatatttagttagctgtcttagcacattggcattgctagctaaaccggttcctgaaaatggccattaaaacacgcaatatatatatatatatatattttataaatatgtacaaaataccgtcaaacaacagtacaaacagatatgaaacaactacactatttcattattgttccattatcgtgacacatgttgctctcataaattcaaggctttacggtttcaagtaaatatgtccaaatcagatatttacgaaaatatgtttaaaatatagttaagatctattttaaaaatatcatctacacgtaaacattcgtaattaaaattcaagcaacattaaataattgcctgcgcgtatgcgtaggctacctttctacttatataaacgattaacacagcaaatctatctgaaaaatacatcaggtccatcacgactgacgacgatagaaatgagaacaaccctattacaatacatcgatacttattgttacatcaccaagacataaacattggataaactccttatttcagatgtactagctactctcttcgtttcagattgtaagactttctagcattgctcatatatatttagaagttaatgaatctagacacatatatatatatatatacctaaattcattaatatctatatgaatatggacaatgttagaaagtcttacattgtgaaacggaggatatagtacttaatttgcggctgcctttcttgtgaatcttgcccatgaaacggccaccaaaacatatgtcttgtcatatagcttgtcacagaggtcgaagaaagcaactctccatgctttcttgaataataggctgcataagacggcccagagacttaatataaatcccagaataagtccaaagtgaaaaggctctagctgatggtcttggccattatttattgttaaatgaccttgttcgccgctggaacagtttttccgaagaggaggcccacaaagaccattgttgccttcgtacatatttggattttctgagtagagccttatgagacgtctttggcgcaagaaacgtgccaacaatccaaaccacaaaagcggttctgaaccatgagttcatcccatcggggaatgtcctcctgatgacttcctctgcacccttcaaagcgctggcctcaaaccctggagccccaatgtagtgctgtacaaaagaatccttttcatctttcgagttatccggcattggacacacctccatgccctcgaatggtatcccaagaaccctatgcacattccttggacttaattccacatcaaggttgttccccacccttagagtcctgctgtcgcaatttactctgcttagtagccatctggtgaatcttctgtcgatgccatttatctgtgggagttcaagcaatccgccaaacccaatactgcgtaccagatcagacttctctttgtcaaatttgccaatcaactcagcagcatgctttggtgaactcctgctagtcgccccccatacttcaggtacgttccgactgggtgttccggctcgttggcgcctgggaggggggttgcttcagactgatacgagtctcgaccgacagcaactggtgcttgtgcatgtctcatccccggtttggccgctgtttggccggtggtgttcattgtgataacaacactcctgcggtgcgacggtgagaaaaaaaaaaaaacaatcagaatcccctccgaggaaaaacaaataaaaaaataaaaaaaatgacaaagagaaggcggcgtccactatttgacacacagcaaaacgcgcgagtgtgttcctggccgtcgtctccacacaatctatgcgtctaatcttgtatgggttcctctggtgtgcggattggggaaggggaggaatgtttgtgtagggtttgggggggaggggagggaccgatttcttccggcgagatccgccaaagtcgccggagttcagctatcgccggtgtcaatcaagaggagggcatggcggcggcgtcctggttgtggacaagacgaagggatgggggatagaaagggacagagagagcgaacaaaaaaagaggaaaaaatgcataaaactgggacggggtgtggatcgatccgtacgcatggttgggaccacatgcgtcgtgtagctcttttgtatgtgggcccctaggtgtattctctaaaatctgatttactggtaaaatacctcctcagaacactatatacattccgcctcgtataggtacgtgcgaatcttgaagcagatgtgcggtagtccgcctaggtgcagaaaagagtttcccaaccagtaagatcaagtaccctcaaggaagaaaccatattcaccacatgaggccaatcaactactataccatgctaaggttgacgtctcccatgttgagataccgtaatcgtcgtaggcgtgttacccatgatatatctggtgagtaactatttgctgtgtaagagaggtcaagaactcgcaggttggaaagattaccgaggtgaggaggcaccagaccatggaaagggatcccagagagattaagatatctcaagcttttcagagagcccagaaactccggcatatcgccggttggcccttcaagtgagttgtggctgagatcgaggtgctgaagatggtgaagagaaagcagagagtggcttatctcgccgaacaatctcattgcaaacgggttgatgctttccctgctgccaaggttaagcttgacgatatgccccgtgcggtcgctgcaacggacgcctgtccaccggcagcagtcttggccatcttccggccgccatgacgcgaggaggcctgtcgtgtcgtcggcgatgccttccttgaactccaacagcgcgtccatctcgcctgggaagcagccgccggagccggacggccgccggagttgcgtcatcatcacttgcaacgccgtggccgctgccggtgtcagtagcaacagtaccgtggtggtggtggtggtgatggcaagggacaagaacatggcagtgaggaggctcatggtgtagctatctccggtgatcgaatcgatcgaccagttttagagaacatgaaaccgtactcactaacacagtccatggctttttaacccaccatcagacgaagctgcgctgcgggagcctgtgcgtacagtctgtctagtggataaaattggtggtgtttgaatctcatgaagataaacgattaagtgtttcacgcaatacgaggtggtaataacgtgtgattaattgagttttaattgttacaaacttgaaaaatggattaatctggtattttagattaactttgatatacaaagtattcacacgaaacgtaccgtttaatagtttgtaaagcgtgtcacgagtatccgaaatttaatcgcgagctgattaatttccatgtcgtacgtgctcgctcgctggtggaaattaatctcatctgtggaaaaataaaaaatttctccgcgactagctgactagcgacctacgagtattcttttcttccaagctgccggtttttgtcagaaaattgcctagcgtcaagggcgggtacagacgtactctctccgtccgcataatataagggattttcgactttttacttgtaatgtttaactacttgtcttattaaaaaatttatacaaatataaaaaataaaaaaatatgtttaaagtactttggataataaagtaagtcacaaataaaataaataataattccaaaattttttgaataagacgaatagtcaaatagtgcaagcaaaaagtcaaatcccttatattatcggatggagggagtttatctatctattatattatatactaaaagttcatgaaacatcctagctaaaaacactcctaagttgacacatggcactcctaaaaatactccaagccatcaagtggcactctaataaattagataaacatctaatcatcgattttcactttaactaggtagacccatcagtttttaccatcagattaaattctcatctcttcaccctaatatatgacgatggttgcttgctttggtcccaccaaaataataattaggagcaatcaaatgcatagaatcagttgtttctctcctaaaaaatcaccgcataattaattcttggaaagaaaaccgacgttgtggatttaatgcaggagcctgggtgcgtgcttccatcattcaaaaaaaaattgtaccatcgaaaactttttaagtgaatatcacatttgcatcaaaaaaggtgaaaatcactaactgttctaaactatttacagggttcatattcatgaatattgccctcagtagttagtttcagaattttcctgtatctgtttgattaccagggcctgatgaatttttcacggatgctaattctcactagattaaattttcatctctcctccctaatatatgatggtcgcatgctttggtcccaccaaaataattaattaggagtaaacaaagtagagaatcagttgtttctctttctctcccgaaaaaaatcaacaaataaattttcagatgtaaagccataagaaaaaaaagcaatgcgcctctagcccactttctcaaccaatatcaacgacatccttttcaggaacaagaagcaacaaattaaccaagtgagaaataatcctaatcgtatcaaacaggtgagtgatgcaagcaacttccatctttttattgtttgatctcttaacatagccttccacttctctgtttttttatgcatataatttcgcttttttacctacaattttatactactccgtggtgatgttgttcatattctgatctgttgctactagcttctacaacaaagtgatatatcaaagctgaaagctcttgccccttggacaatatattcactaatatcatgtatttgggtgctgtcagttaatttttgagcacttagtcaaggcgccttgacactgcgtgctttgccaccagaaatttgttaattgattttttagataatcattttggaagggtaatgcatgccgcttttttttaaagaaatatagtaccaacacaactgctcatatacacacacgtacacttatccatagaaatcatattcgagagactgaaccaatgatatatatatatatatatatatatatatatatatatatatatatatatatatatatatatatcttcaaattaacaaagtcaccacaagcgtcttgctatcgatgagaatatcgcctactgcaagaataattagccgtaaatatgatgcccacgtcaagtctaggtcttgaacctatgtaggtaagttccaccatatgtaacttagcagccacgctcactaattgcagataatgtggaccgcctcttccctatcctttaactccttttttccatatattatttgagataacatgtagtatataaataataaatatactactataacttttaaattatatatacaatttttatattcgaccacaattatattctttacaattaaatcaatccatatttactatattttcatttataaataataataaatattattttgatccatgatttgaccctttgcgttatatctaacataaaaaaggaaaaacataggttatagtgtcataaattactaaaactagatctaagatgtttgaaaataaagtttactatattatattatttaccattaacttaatttatgatatatattaactatactttaatgtgtaaaataaaattatattttaggacttttttattctttttctggaatccaaacggacatgaaaattataaaaaatatgacaatatggagtatatatcactatatattctttatcggttataaaaatatgtaccactaaattagatttacaatatcaacaagaaacatgtcatgtcttttccctttacatggcatttgataattataacaaatcgtgaaaaaaaattaatgatatatgtaatatcatcacataaatatgcttactatgtagggtgcactatatttggcccatatcatttcacaaatgtgcatgactaaattagatttacaatgtcaacaagtagcagttcacttccggggccttacatggcaattgagaattatatcaaatcatgataaaaattaacaatattgattatatgatcatataaatgtacttgccatgtggattccaatctattcggactatacggggataatctaaagagtccattctatttaccaaatcatgtataagttctacgttttgtagactacaccctaaataataagtaaaataacggatggagtacatgtcatgtttttcccctttgatttcagttaaatacgtatggtgtattttgtatatactaagtttggttaattagggaacataaaccatactaaagttaaatatgagaattcatgcattaaaaatacatttcataacaagaacttacttaacaaaagtgtactttagtctatggtgcttaaatatttataaattctctaaacatactaattatttccgcacttatttcaaactaaattcattttttccacataatataaggagtagaagtaaatagaagtttgccattaaatagataaaataaagacatctataatatacaagaaaatttgttgattaaggtttataaactccaaagtaagatattctaattgctaaaaaaacacacacttgggactcgtaatagttccatgtgacggagcactattgttgcgacacaatagtttctcatcaattaaaaaccacacggtttaaataattttggtttagaatttacatgttgaaaggtaattagaagaaaattaatgacgttcacaacaatctcaaacgaattattgattaaaacatgttcagaatagagtaaaagaatattttaagaaatactcatccacatataagtattcataattaaaattcaagcaacattacataaggtgcctgcgcatgtgtgcgggctaccttcctagtttaactaaaatgtctgaaggaattgaatagcttatttccttaaaataagggagaaatcagcaatggtactggatttgtcaagtgactaggttcttcaaacatgatagaccattggtggactaacactgtgtgaccactaactgacaacagaatcagtaagcatcacaaacttgacagactactgtggagtgtgcatgtggtccaccttaaatttcaactctgggttaggacttaaagtgatcatgtggtccaccctgaatttcagagtgggtctgaatttgtactcttaacaaacagtcctcatcatggcatctatgtctgggaagcaaattaaagagtctgacaaaatttaggctcacatagtgttgatttcacaaagatcactgtactagtttactgttaacaatcctggtacagaatttccttgccatagctgcattaaaaatcctaaaattcaagttgaattccaggtctattgtgtgatacgtatcacatgacttgccatatgaactaccagccaatgatgttgagatcatctgctttgtcctagcgtgccaacatcttgtccccaaggccaggctatctgttctatgaaggtgcccgacgtgttcagtggcatggaggtcaggtactttgatcttctcccagagagctaggaggttgatcttgatggagtgcaggctcttgctgacaaaaacacggttgcaatggtaattgtcaatccaaggaacccatgcacctatagctaattaaggcaagtactaactcagttgttcattttttgattggtgattgggaattgtcatagtgtttgatcagtagtctctgttttttctaggttgccgagactgcaaaaaagcttggcatctttgtcattgcagatgacatgaagtgtatgcacatttgacgttttggcaaaatttgtgcggatgagcgtctttggctcagtggctcagtagatgggttgtgcctggatggcgacatggatggattgtgacaagtgatcttaatgatgtatttcaaaggacaaaaggttcttgaacccaactctttcatccatgtactactgaaatcatcaatgaaatacatgaattttttagttaatttaacagacaatgtagacactttagatgaaacagcaaatctaagcttaacgaaacagcttagattcttgaatgatctaaaacctgaaccttacaatcagcaaaaattctgagtcctggttccattttcaggtagtggaaagcatcaagagttaccttgatacctcgtctgatcctgaaacatttgtccgtaaagatggaagcgttctcacctcccggaggaggctgcacctttgtatttatatgtgtcaaaaagagcccttgacgtggcttacaaacaatgtgataagatttgttacatcgtatgttatccaactcaactaccctattatctagctagatcaactaactagaagataagatatacattgttttacactccccctcaatcataacttggccaagttaagattgtacatgaaatgccgaagattctgtgtagacaatgcttttgtaaatccatctgctatctgatccttggtaccaataaatctgatatccaacattttattggctaccctttcttgcacaaagtggtagtcaatctctatgtgttttgttctagcatggaagaccggattggatgataggtaggttgctcctaaattgtcacaccacagaactggagactgatctatctttactcctaactcttccaagacagaccgaacccaaattaattcagcagtagcattggccatggctttgtattcagcttcagtacttgatcttgaaactgttcgttgttttctagcactccatgatacaagatttggaccaaagtaaatcacaaaccctcctgtggatcttctatcatctagactaccagcccaatcagcatcaaagaaagcactgactaaagtagaactatattttttgaagtgtaacccaacaccaacagttcctttaatatacctcaaatacgtttaactgctaaccaatgttctgaagtaggagcatgaagatactgacataccttgttgacagagaaggccaaatccggtctggtgagtgtcaaatattgtagtcctcctacaatgctcctgtacctcgtgctgtcttctacaccaagaggatcaccagtatgcaccatcaacttttcagaaatggctagcggtgtaggagctgttttacaattttccatgttaaccttgactaacagatctgaggcatactttgcttgattcaatattataccatccggaaccttcttgacttctatgcccaagaagtagtgtaaatcacctagatcattcaaagcaaaatcagacctcaaatccttgagtaacgcagtacctgcattacttgaggaacttgtgacaataatatcatccacataaatcatcatatatataatcacaccatgcttgttataaataaacaatgatgtgtcagctttggatgcaacaaagcctaactgaattagcttgtgactcaacctggaataccaggctctaggtgcttgttttagaccatagatggctttatcaagtctgcaaaccaaggttgatttaccttcataccctgggggttgcttcatataaacctcttcttctagtataccatgcaaaaaagcattttgcacatctaattgtctaagtgaccatcctctagagactgcaatgccaaggactagtctaactgtagcaatttttactactggactaaatgtatcttcatagtatattccatacctttgcctgaaccccttagctactaaccttgccttgtatctgtctattgttccatctgcttttctcttaattttatatacccacttgcaatctattatattcttaccttgtggcatttccactaaatgccaggacttgtttttaacaagtgcattatactcctcatccatggcttgcttccagcgtgagtttcccaatgcctctttgtcacgcccggaatttctatctaaaattccaaacgcttacatgtgtgtgaaccctcatcaggaatcagccgaggcacacaataacaaattgataatagagtacaattattactctaattaataagcgaataaaatgtcattacagaggtagatagttcct

SEQ ID NO: 69274 - DNA, 8300 bp, Oryza sativa
tgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagaccggcccataaccgcgggcacggctattcgaatagttttactctggccagaggtgtaccactgtatccacaagacacagccccacaacatgtcaccatgtgcctcaataccaccatggtacctcggaaaagagttgtgacagtacccctcgcacaatacaatccaccacagcacacctttcctggatcataatcacccccttataaacaaagcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttatttgtcatgagcacgactctcaaaatcatgtgctcacaacccacctttaccaagttttagttggcaaattaattaattaaccaatcatgattaaccatcatgagctatcattaagccatcattaaataatagagagtcataagttatcccaataatatgctaatgtttctaagcatggctaagcaatcatatctaatatctagctgaaccaatatataaagctcaactagtcaagttataataacccaaggtatcaaggaatatagtaatcaagaacaaaagggctataacaaacaatagattaattccacccaatgacattcgaaaataaatgcaatagttgaatataaacaatagctttaaacggaatcaacatgctcaaagggttgtttgggatctgtgtgacttgccttgctggccttggaactcttcaaattcttctcctgcaaaaacagactctccggaaacgttggaatatagacagaaaggagcaaaatcaccaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaaaggggtttattgcgtcagcggctagggtttgcggtggaccgggtgcacggcggcggctcacagaaacgaacggccgagatctttccatccaaaacgaacggccgagatcgaccggtccatggccggaccacgacggacggcaacgatgacgtcagcggtgacgtcaccaccggcggtggctcgggcgcgcaagctcgccggcgaacgacggcgcgacgacgcgaacggagggcaccagcacgtagagaacacacaagttgattcttcttccgagtgattcttcttccgagtgggacgccatgcaaacacacaatccgtgccatatacaattccgccaactgacttccggaatatgttgtctttactgggatgaaatgagccactttggtaagtctgtcgactatcacccatatagagtcatggcctgatgatgttctgggtagaccagtgatgaaatccataccgatttcctcccacttccattctggtatcttcaaaggctgcagcaaacctgtgggtttctgatgttctgccttgactcgctgacaaacatcacatactgctacgtattcggcgatttcacgcttcatacttgcccaccaaaatctttccttgagatcctggtacatcttggtactaccagggtgaatggagtataaagtatcatgagcttctttcagaattgcatcttttaaatctttgttgtcggggacgcagattctctcgcccaaccatacagttccttgctcatcttccaagaaaccgatagcttttcctcttctcatattcttcttgatttcttgaatatcaggatcaataatttgggcttctctaacttgatcaattagagtgggctttgcttctaaggctgcaacgaaacctctactgacaattcccaaatttaatctttcaaattccttgcataactccaatggcaactgtcgtccttccgtagcattgcaatagcctttcctgctaagagcatctgctacaacattagcctttcccgggtgataatgaattcccatgtcataatccttaattaattacaaccatctctgttgtctcatgttcagatctggctgagtaaagatgtactttaaactcttgtgatcggtgtacacctttgtacgagtaccgaaaagataatgacgccaaatcttcaacgcatgaaccactgcaactaactcaagatcatgagtagggtagttcttctcatgcggacgtaactgacaagatgcataggcaaccaccttcccatcttgcatcagaacacaacctaacccaagcttggatgcatcacaatacacttgaaaacccttttttggatcaggcaaaatcaaaataggagctgatattaagcgattcttcaactcttgaaaactctgctcacattcttctgaccacttgtattttacatccttttgaagtaatcgtgtcatgggcttagcaatcttggaaaaattctctataaacctccgataatatcctacgaggcctaggaaactgtgaatctctgaaactgtctttggttgtttccagttggttacggattccacattactaggatcaacggcatctcctccggctgagatgacgtgaccaaggaacttcacttcagacaaccagaattcacatttgctaaacttggcatacaactgatgttctcgcagcttctctagtgcaagacgaagatgttcttcatgctcttctttggttcgggagtagataagaatgtcatcaataaagaccaccacgaacttgtctaggtattccataaacaccttattcatcaagttcatgaagaaagcgggggcattggtaagtccaaaagacataacagtacattcaaacaacccatacctagtggtaaaagttgtcttaggtatatcttcctctttgattctcaactggtgataccctgatcggagatctatcttggagaaaacggtggcacctttaaactgatcaaacaaatcatcaattctgggcagcgggtacttattcttgatagtcacatcatttagtgcacgatagtccacacacatcctctgggtatgatctttcttttccacaaaaataactggagctccccatggagatgaactcggtctgatgtatcctttctgaagcaaatcatctacttgtctcttgacttctgctaattcattggctgccattctataaggtctcttatggatcggagttgttcctggtaccagatctattctgaactctatatcccttttaggcggcataccaagtaaatcgttcgggaacacatcggggtactcccggactataggaatctcttccaaagtcatttggttcagacttgaccttaaagactcagaagataatgcatgaacagttacaactcgaccatcattgctggtgagaattacttttctgttggcgcagtctatcatacctttatatctggctaaccagtccatccctaggatgatatcaaggtctttggattctaacaggataagattggccagaaatggtacttcttgaatttctattctgatagaggggctacgttgcaaagagagtgcttgattactcggggtactaaccatcaaaggacgtctaagatcttctacttccatcccatgatttcccacaaaactcatagataaaaatgaatgtgtagcaccagaatcgaaaagcactgttgcaggaactgagttaacaaggaacgtacccaaaatcacatctggagcaccttgagcttctgcagcagcaacatgattgacacgagcctttggcgctggtgcggtagagttgctctgggcagggacaaccttcacgcgtcggggcttcggacacttgtcagcgtaatgtcctgggtctccacagttgaagcacaccccgggcttgctgccttgctccctcttggcaggctgttgctgtgttggagctgcaacagggcgtggagcttgattgcggatgttgttgccagcattgttgttgaagaactgtcgctgcggacgaacaacagaccaagaacctccctgtggcatggactggggtcctaaagtaagacgcggcctctgactattcccctgttgtgccttgaagtgagcaatccgacgtttcttctgctccatgcggttgtacttgtcctcctggcgaatagccttatccactaacttctggaaatcatgataatccctagtcatgagtgggtaagaaagctcatcattaagtccttccaagaacctctcatggcgctcttcatcagtgcgcacatcttccggagcataacgagccagacgattgaactcgtgcagatactcggtgaccgtgcgagatccctgggtgagcgacctgaattccttcttcttgagagacaccactcccgatggtatatgcgtcttccggaaagcagcggtgaattcaagccaagtgataggttcagcagtagttctgttaaggcggaagtgatcccaccactcagaggcagggccatgcagttggtgtgatgcaaatgagaccttctcctgatcagtgcactaaagcaaatccaacttcttctctatggcatgcagccaatcaccagcttcaacaggattagtggtgctagagaaagtgggcggcctcacacgaagaaattctgctaacttgttctggggaggtgcatggttatttccctggttctgctggttttggagttgctgcatcatgatgttcataagctgggcctgttgagccaggacttgggcaagcgtgggattctctccattgttgttgttgttattattggggccattcccattgctgcgagtgagcaccatctggcatgggcaggatcacaagaagagaaaccggggaaaactacttaggacagagaattaatttttctactaacttaacttttattgatcttaactgagtttcattattacaaaactgaagactctcacaccactaaactcaccaacttcctaacactcaaaagcaaacaaacgcatgcacttacatcccaccactgatgtaaatcacatgcgagacacacacaaccaaacttaaacaaacaaactaacacaacgatctaagacaacggcttgacaacgcactctaggtcttccgggcatcagagttgattgaaggctcgttcggctcgtctccatcatcttgagtagctccccactcgacctttgaatgggtgcgcttcgattcttctccttcatcatcacttacattgacgaccggaggatccgctagggctggggtaacttctttctccaccacacggacctttggcgccaattggtagcgagggacgaatagagctctcttccttgcggtaagacgaatcctggccttctgcggtggtgcttctcccttcaacgcggctagttccttctctaaacgatccaccttgtcctctagcctgcaaatcttaccacgattctggtcttcacgatcttgagctgctagcacaacctccgcgcgggtttcatccatagcccacagcatctcaaccaaatgccttgtggtagcatcattctcaatcccctcagtctcaaggtagctgccacggtcacttccctggggttggcgaggatggtagcgatactcagtgtcggccaactgatcactgtagcgatcgcggagctctcctatggcgatccttgccacctcctgacatgcatggatgtagtttcctcctccagcttcgaacatcactgatgggatatcttcactattactgttcaaggtgactttgactcggcacttctcttcatcatgatcatgaggaatctgggcatacaaaggggcagtcccaaatcctatggcaaaggacatcgtacgcaactcctggacaaatccctcaacaccaaacaagtactcaggcttgaagcgcggcatctaaagataagtgaaaggagggagttaagacatttatctaattaatagcacaagtttttagattaatttgaataaagttagaaaatcaaagtaaaaggtaagtaaataaagtaaaccaagcttgcaagataagttgaaacagttggaaacaagatcacaaattttgcacttttgaacaacaggttccaaaagaaataaaagaaagttataaaatcaacatgctaaatttatttcattgcagcaagattaaataaaacaatgttgtaaaacttttgctggtaaatgagccattagtacagtaatatatgtacagtactaacaacactggaataaattttgaatgagaaccactaaaagagattatgaagtgcatgtgctattagtttggtttaattaaaagagaaagggaggagaacagttctattttcccaatatttttagagggcttctatgggtaaccatttggcataacctagggtcaaggggctctgataccaacttgtcgcgcccagaatttctatccaaaattccaaacgcttacatgtgtgtgaaccctcgtccaggaatcagccgaggcacacaataacaaattgataatatagtacaattattactctaattaataagcgaataaaatatcattacagaggtagatagttcctctcaatcaataaaaatctaagcagcggaaaaataagataaacggcgcaaacgactccactccacaggcagcttgaccagggctacacctaatcctccacaccatcagcatcactgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcataatttaataaaatatttaaataataattaaacaatattaatccaacgctatacaacataccctgttgcctaggcccaaccattctgaacaaccatcccggctgcacaattctatctccaaaccaggaatattccaaacaaggagctaatcaaattattaccagttatagcatcttttattatggtgagaagtgtgaaactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctatgacagtacccctcgcacaacacaatccaccacagcgcacctttcctgaatcataatcacccccttataaacaaagcatggactccctagcgacccccgtgggcttatctccgccacttctcagtctggtgctccgcaataaaccatgctatacaaaaggtaaagccgttgcccacgctggcttgtggttggcacggttaatgtttcacaaccgaaactcgtgaactggtccttaattgtcatgagcacgactctcaaaaccatgtgctcacaacccaccattaccaagttttagttggcaaattaattaattaaccaatcatgattaaccatcatgagctatcattaagccatcattaaataatagagagtcataagttatcccaataatatgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagtgttgtttgggatctgtgtgacttgccttgctggccttggaactcttcaaattcttctcctacaaaaacggactctccggaaacgttggaatctaaacagaaaggagcaaaatcaccaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacacttatat

SEQ ID NO: 69275 - DNA, 9769 bp, Oryza sativa
gcgacggcgacgcacggctggagcggcggcgacgacggcggcgcgaggtctcacggggctagggcgctacggacgacggcggacaaagatgagggtggcgacgggtagcggcgggcttgggggtccttttataggggttggaaggcggcggcgaaggcccacggcaaccggcgacggcgaaggaaggtctagggtttggggagagagacgaatccgattcgagatcgaatccacggatttccaaacgaaattagccgatgattccaaaagagaaaaggtagaggagatcccgaagatcatttcccctttattgattccaccggaaacggaaaggggcggccggatttggaaggagacggcggcgcggctcggctagggttcgggcggccggcggccggaggtagacgacgacctgacaggcgggccccacctgtcagcggcagcgagcgcgcgcacgcggcggctgcgggcggactgggccggcttgggccggggagagagagagaaggttttgggccgactttcggcccaaagccaaaagagacttttaaaaccttttccaatttaaattattcatgaaatgcaattctatttattaaaaatactttcttagctcaaataaatcccagaaaaaatctaggaattatagaattaagcaaagtatttaatgaaattttatctggccccattttatattggaatttattaattaaaattagatctactcttctaggcttttaaaataaattctaataattctaatttagacaacaatttatatatttgggatttttagggtgtgacactcttgtacattagctggttcacctgtagagcaagccaaagaatacttaattgttccatcaacatctaaccagctggccttagttatcccactctgcaagcgagttcgcggcctgacgggttcagactgctgcacagaagatcctgaaccagccgtgtcatccacagctgatcctgtcgggttcccatgtgtcgatgaagtggtcgcaggcgatcctgacgacaatgctgaattcggtcctgattggccagaccccggggttgaatgctcctgggatccagtacctgtgcttggtgtagactgtgcatgactgtgactgccctcggatccgctgctgctgtcagccatcaaatcatcctcgtgcccagcaccgcttgcttcaggcaccatgattttcatctgagttttgcaccagattttcaccattttgcgccgaattttcgccaacgacctgtgctcctgttgcttgatcaccacaagagggattagtagaacatgttagcatatgatcattagtaatttctcccctttgatcagtgacgggaagcagtcgagtgggaagcaaggagatttcccgtcgcaggcgggcacccgcgttgggatgcaaggcagcaaaagggaaaattgtttcatcaaagacaacgttgcgagagatgtacacacggcctgtagagatctcaagacatttatatcctttgtgaagggggctatagccaaggaaggcgcaatggatggatcggaaagatagcttgcgggcgttgtatggtctcaggttcagccagcaggcacacccgaagatacgaagatgactgaactcaggattttcagaaaaaagttgctcatagggagttttaaaggagataactgaactaggtagcctattgatgtgatacgtagcagtaagaaatgcttcatcccagaacttaaagggaaccgaagcttgggataggagggcaagtcctttctcaacgatatccctatgtttgcgttctgcagatccgttctgctgatgtgcatgaggacatgagacatgatgaactatgcctattttctgaaaaaaggagttcagtttttcgtactcaccaccccaatcagtttggacagtgagtattttggtgttaaattgtcgctctacatactgttggaaattaagaaaggcttgaaacacatcggatttctttttcaatagatagatccatgtgtatttgctaaaatcatctataaagctcacacagtaatcatgttttccaatagaggtaggcgccggacccacacatcagagaatacgagagcaaatggaacattggataaactcatagacttagggtacggcaattgatggctcttggccctttgacaagaatcacaaatgtgttcgacattattggactcactagaacaaggaagcttaaaacttttgacaactcgattaacaatttgaaaagacggatgagctaaacgataatgccacctaatggaagatggcttgacaatgctcaaggcaattttattcagacttgggctttgaccaccgggttctggagccaaaggatagagccatcccttacttctgccgtgatgtagtagcttcttcgttgcctgatcctttatattaaagaatttggggtaaatttcaacaaaagcatcattatcaaaggctaagcgattcgcagagacaagatttttgttcgcagtaggaacgtaaaggatattctttagatgaagatctttatttggggtagaaattactgaatgaccaatatgactaatgttcatacctgagccatttgttgcatgcacctgatccagaccattgtacttctctcgaatggagagtttgtcgagttccccggtgatgtgatctgtggcaccacagtcgacataccagttggtatcgaccccgtaggcggagtttgttgccgcagctgcaaccttctcttcaggctggtaggtttgatcaaacctataccaacacttaatcaccgtgtggccagttttgccacaaagttggcagaccggacgcggtccttgctggccgccaccgcgcccaccgtttccacggccacagcctccattgccgcgaccacggaaattgttgttgttgttgccgcgaccacggaaagcagcatttgcagaagattggatctgccctccgccttgaagatgatccatgcggttgtcgtagctaaccatctaggagtacaaatcactcagagaaattggatcagatctgcctaccacagtagagaccagcgggttgtagtcgatgtcgaggcccgccaggatgtacgagaccagctcgtcgtcgtcaatgggtttgccagctgacgccagatcgtcagctaggcccttcatcttggagaagtaggcggcagttgttgtggatcctttcttggagttggtgaggctgatcctgaggttggtgatgcgtgctcgagattgggaggtgtacatgttggtgatggccgcccaaacttcagcagatgtgtttagtgtcgctacttgctgtagcacatctttggagagcgaattgagtagataggccaggacttgctggtcctgggccatccacatcgcgtactccgagttgttgctgacgatctccttgtcattcttgtcgacagtcgtccttgtcttggccggttcttctgccgtgctgtcgaggtagttggtgaggagcgctccgcgaagcgccgggagaacttgtgcacgccacaggacatagttctccctcgtcagcttcacagtcaccggaggaccaagcgcagcaggcgcggcggatgaggaagatgagcttgccatggggaggaaatgatctagggtttttggaagggtagatgaggcgggctctgataccacgtaaagatggaagcgttctcacctcccagaggaggccgcacctttgtatttatgtgtcaagaagagcccttgacgtggcttacaaacaatgtgataagatttgttacatcgtatgttatccaactcaactaccctattatctagctagatcaactaactagaagataagataagatatacattgttttacacaggtaactaaaatttcctctctcttttcttctaaagctaattcatacgtatcttaggagcataacaagaccaatgaagatatttaagcatgcactgattgtgtacatggaaaagcagaatgatttacatttcactttgacacattttgtttttttttctggggacgattccacaactcattgagaacacaaagggagaatttttgtgaaaaaaatgtcgatgtatgtccaaaatagtttacattaggtgctgtaggcttgtatctagctaggcaaatcaaccaactgcagctatagtctgccaacctcattccatctctcctatattgatgcctcttgagtcctatcctctccaagtagtgtgtaccaccactggataccgcaattaattctagagcattggcgcaacgcagcgaggaattgccgggtgatctccgcgaagcccaaagatttgagagttgacatgaggaactcgatgccaagcgggacctccatcatgctactgaggttgactagatatagttgctgcaggcttgccatggaaccttgctgaatctccaaccgtttcaggcgaggcatgtctcctatgtatagctccttgagggcaggaaaccacccatggtggaagacgagctcatctccaatgtacgctctgttcaacaaaaggtccgtcagattcgaccaccgagacagagatggcagtgggtcatctaccagctgggaccaagatagatgtatcgaatacaagtggttctgaccccctgctgcacccaacagcatgtttgcttgtgccaatctcccgcgcaatcttagcttttcaaggtttggaggcagtgggttcaaactactcaaattgaggatatcattctcatcacttgctgcaatgcttaagtaggatagaaattccatgtgacgcaatgacgcgcagaggcattcgcagcagcttcccttcacgtcccatatctttatgcttctcatctgcctcagctcccccaaccagctcaaaggctcatcctgagcttgcagtgcttgcaatgtctgtagctctctcagattctctagtccactggggatgcatacaccagtgcgacaccggagttgtcgcccagaccgatcgttcgctttctcagcaaacaagtgcctaagcttttttagcttaatgatccctcttggcagctcatgtatttccgatgtacagaggtccagtgttagcaagttggagagcttctcaatagaatttgggaggagcttcacattggaatcccgcaggccaagatgtcggaggttgaatagatcacctatggcatctggaacattgtcgatgggtagcccgcttaactcaagtactgacatatatctacacttctcggatagcagaggtagcagagtggatgatggcatggctttatccaatgcgatgaaagatcgaaggcggcattcacttgaaattacttgattaatatccttgtctaatctgtgtattaccatccgtcgttcatcattctcctcaagaaactcgaaacgcttattctcacaactgtatgaaacaccaaaacattctctccggcacaaatcaactgccaactcgtgtacgatatcatgcattctgaatgcttttatcctgccaaatgagttcctttcaacaagctgtagcatgttcatgtgaaccaattccttgagatacccttctgccacttcctccattgtgcttccacccctcttctctacaaacccttctgctatccaccaccttacaagcttctttcttgtaaaaagatagtcgtctggaaacaagctgcaatagaggaagcaactttttagttgtgttggaaggtagatgtagctcaggtaaagaatattcctaacatgttccatgctcgggttgttgatgagctcccagtcaagttggttatgtatgcgcctgaattcctcttcagtcttgtcacgcacaaagaggagtctgccgacagagacaattgcaagaggtacacctttgcacttgcttgctatttgatatgctagctgtgttacttctgtggggcactcaagtttcttctctcttggaaaagccgccttatagaagagttcccatgagtcgttttgtgatagaggttctagcctaatcctcttgtttgggaaagcaaggtgagttacctcatcaatgcgtgttgtgacaagtactctactccccctgagattagaaacaagtgctccgaacaagttactgatggcttctggtgcccaaacatcatctaatatgaccaaatacttccggtcccttaggaatgccttcaattcatcttgaaggccttcagctttcatgtccccaaggtttaccggaggattttgtttggcatttctgaaaagttcagtgatcagacatttcagaatgttcttgatggaatatgtttgagagatggagacccaggcatggcattcaaacttctctctctcgttcctatacacatttgctgccaaggttgttttgccgagacctcccatcccatgcagcactatcacctcacgttccaattcatcacctgccagccactcgcggagtctttttctgttttcatccacccctacaagatcttcttcactgagggagcatgaaatgctagctagatgacgtgacgcctcaacaatgtaacatgagctttcaccactagtctcatcggcaaccatccgaacccatcgctcttttgcctgaaacaggtgcactagattggcctctgcttccttaacagacggagctatcctgtttaaagagagcagagcatttggtcccttcattctcttgaatcctttctttagataggtagtccatccagtgtcatcatgtttgtccttgtggctaacaagatgcaagtagtcatccacaatgtcctcgatctgatgtgctaacattctcacatcctccacccagatttcatatatcttgttgttgcgattgcggatatccattcgggacagaaactcgtgcatcagcctgagctccctcttgatgcgccccatgctaccttgaagctctgtcagttgtgtgacgtacttctgaaaatatgaagtggcttggttgattgcctcattccctagggcaacaccaatcttcttcacaactagaagaatcacagcctcagacattaggttcttgtcgagtctgattgcacacctgaccagggtggcctgagtatatctctctaccacaaaacctagaaaggaagaagaaaggtaaaatacaataagctgtattgatatgttatatctaaaaaggaaggaaaaaaagatgtagaacatgataagtaccatattgacaggttacatataacaattgggaacttcgccatgataatctgtttatttttgtttttttctctatctgacctctttagtgcttaagaagacatatctcttcccttgttgtagataacatttcctaacatctgttttatggcccatgataattaaatctgaccataagttagctatgaccacttgcatattgaaaattctaaagttttctttaaacaaaaggaaataaatcgacttgcaccatttagggacattatattttggttatcgtagacaagttggttacattcgtatgtgtgataaggtcaatggtgacaacattaaatcaaggagaattctttacagtacaccacttttatgtgagttttgtttcttttgatcttagacaagacaagatgattacagtacaacactttgttattgatgttaatttgatcttctaaagattattgttgtatttgcataatgcataagtgaaaggtgttaattagagttaatatttttcttcatacagaaattgcatgcatgcacagtgaaaaaatattaattttaatctctttatgcatgtgatgcactgaaaaaaattgtaaacataaagctgtcactctgaaaaatatgtgaacatatgtccatttatatttcatattagtccggagtatacttgcctagacaacaaaattaaaggggaacactattgttttgcaaattacatttctactacacaaattttgcaaatggaagaacaatatgcaaggttgaatgtctctttaatttacctgttctgtgtctagttaaaataatgaaatgtatgcaaattgataacaggatcaaacgtggttcagcaagaagttagtacttcatatatcctcgcatgtccacatccgtacgtcatgggtggaggcaaatattatatcagtgtaaaatactgatctcaatcgggcggtaagccccatctcaatcgggcacagcgtccgtcacaggctagaagtcactgatgtgaagagttatctcaatcgggcaaacggccgtcacgaatgaatatatctcaatcgggccctaagttaagcccgtcaccgctagctttgacccagacgaccagtcaaactatagcccgtcacagatgacctatctctatcgggcgacaactagcgcccgtcacagatgacggttatctgtgacgggcgttaactatagcccgtcatagatgagtcatctatgacgggcattaactatagccatagttaatgctagacgagtataatccaaacctacgcaattttataaattaggctagccctgccgtcactcgtgtgcacccacgcaggaaattcaaacttcccggtcgttcacccatcctgaaattgctccagatgagattggtttccggaagagtagttgtaacttattagtatgggtattctattaatcctattaagccctaggctaggatatcaaattggggttattaaatgatttcaaatggaaaagtcaccaaaaccaaagttgtagaactcatcaaggtgcaaaatttttattttggtcatttctccatctgactctatttaaacaatttgaaatttgaaattcaaattttgaaaagttcaaatagaattttagatcagtgaacggcttcaactgaaaaagtcatcaacaacaaagttgtatcactcatcaagatctacagcttttattttggtcatttttctatataacattttttgaaccgtttgaatttgaatttaaaaatataacaacatcaaataacattttaaaatactaaatgatatcaactgaaaaagtcatcaacaacaaagttcaataactcatcaagatctagaacttttattttggtcatttcttcatacgacaaagtgatagtaacattgttcacaaaattgacatctcttatctggttttataaactataacacatatatgtaaaatttgtgaataatattactaacatttcgtcggatgaagaaataacaaaaataaaagttttagatcttgatgagttattcaactttgttgttgatgactttttcaattgaaatcatttagtatttgaaaatattgtttgaagttgtcatattttcaaattcaaattcaaactattcaaaaaaaaatgttatatagaaaaatgaccaaactaaaagttgtaaatcttgataagttatacaactttgttgttgacattttttccatttgaaatcatttactacccgtaaaattgttttgactcaaaaataaattattatactgcacttaattattttgctatagtcaacttacacaacttgaggcctgtttgagatatggaatgttatctcaatcgggcctaaagttggtgcccgtcacagatgatggtcatctgtgacgggccgtaactttaggcccgtttgagatatggaatgttatctcaatcgggcctaaactacggcccgtcactgataggtgtcatccgtgacgggcttaagttttatgcccatctaacatatctgtgcgaccatatctcaatcgggcacttttcggcccgattgagatgactttcttatgacggcccgctatttctaagcatattagagcccatcacagatagaaggat

SEQ ID NO: 69276 - DNA, 22176 bp, Oryza sativa
cgtacatatatcatttgacgcatcaagcactcatggtgggttaacatcacattccactgagtatacaatccttccatcatgcattggttgctatgatggtctcgtgagggcaataactttttttatgcgcatgcatttacttggactgaaaaaatcaattcttttgttagagcaatggatggagttcacgcatatgtgaactatcacatctatgaaaacgagtatggtattgtgataattattattcattggatctcttttggttatatatgtatatgcttgttttattaatgggtataaaatttgtgttctaatttgtactactccgtccaaaaaaaaagagataaactctagctacaaatctggacaggtagagtttgtgtctttttaggacggagggggtaccttttgagattattttctacacttgcataacatatttccttgcaggttgttatcctcaaatatagctgtagcacgttttgggggaacttaggtagatgcacgcacacgaagagccttgggtttttttatttagtttcataagagcatttcctattcttttatttaaacaagtagacttggtcttaagcttttatgcaaataatttataatcattttcttgttattgttttttcattcagtagtggcaatttggatacaacattggcaaaaattagaaaaatcaaaattcatatatggcttgaataaaaaaggtatcgctttttcaaaaacgatacttggttggtcgggaatatcggccgcttttacagaaatgttgggttacctaactttttcctttgatactgaagatttaaggacatcgtcgaacagaattgcattgaatctttatcatgtatcaactgttattttgcaaaagtttaggatagtaatgattgtgtaggtgacatttcggatagtatggagacccaacaagtatgcttatattatttgctaatcttatactcggtaaaagtattaaagtaactccagttaatttgtcttagatctaaaccagctcttcctgcagagttgcaagacaagatggagtaacttaatttaaaagctccaagaacagaggaggtatatattgcaaggatatgtgcaatgtctgatgtatacataccatgcagatctcacgaatcatcatgctggctgctgccttcttccccagtccccaagccaagaccctgttactaaacccccaaaagaacaaagaaaaaattttaaaaaaatctgcaccattggaagatagtagcaaagtgcaccatatttagattcttaattaaaagaaatttgctgattcagaaaagaaaaccggagttaagtgctgtgttaagattcaagtgtgtacatacctgttgtcgatgatcacaaattcacaatggtgaggactcgatggataaaacctcttcttcactcttgcattgcaattccatgttcttttatgggtttctgaaccttgaaccgccgtgtggagtgagtttgctccgtcttcttctgtaagtcttcaatttaggtatgaatggaagagtatattctactactactactacgtaacgtacagtgccaagatatgaatggaagtgaccaggactagtactccctccgtcctaaaaaaaaggcaaaccctggtttccgtgcccaacgtttgaccgtccgtcttatttgaaaaaaatacgaaaaaaattaaaaagacaagtcacgcataaaatattaatcatgttttattatctaacaacaataaaaatacgaatcaaagttggacacgaaaacccaaggtttggcttttttttttgggacggagggagtatgatgtttacgagatcacgaaattacgtttcaggataaatttagatatacaatttctacattatcaaactggtgtctgatagttgttaatcattaagatctcaaaagtttgaccggactgtatactcccttcgtccaaaacatagcaacacatagcaacctagtgcttaaatttataatattagattatgtcttatcctatcctagttgctatattttagcacgtttccatccgtaatccaattttactaagactataagtatttctatactactatgtacttaattatgacatgaatcacctctcaaccttaaatacgctaaacaactacaaaatgcttaaattgtttggacgggttgaacatacagtattacatgttatgatcagagagcgaatattacttgctaatatctaaatgctactctcaccgtctcaaaatacccaaaataccaaaaatataagaatgtagaattggatgggacattttctagtaaatctagacagatctgtttagattcgttatactataaaatatttcattcgattttagattcttatatctcgggacggtggtcgaataaagagtgtgaggaacggcacggcactgacttggagtcaaccaagactcgctccttgtgggccaagatgagccttttttttttgttttctggaccagcgatggaactccggtcaaatttttggtaagaaaggttgactataaggtacagtggcataagaacaaatttattgacgcaacgcaacagccgtaagctaggtttttttttttttgaaacttaaacacatatattagagcaacagatcaagagggcaagcccccgaacatcgtcaacagagacagcaagatgcacataatagaaaactggaccaagaacacaaacaacctcttgaaactaggcagcgcaaaagggagcagcggcgaggccgcgacgattgcaaccttaggtctcctttagcatgcagaccgcttgacgaaccgttaatccccgtcggtcgcctccacagaaactgcacaaattggagatttgctgttgagccatagattttggtgtaagcttcaccggactcaaccaaactttaccacggagttcaccattgaatctgaggagcttgaactcaacccgaatggcacacccagcgtggatgccactgcccggagacaaagagaaagaagggtcccagatccagccaccctgatgcagtgaaaagcacaaccatcgacgaatgaactgttctctatagcacaacgttggggaagagtggacttgcacaaggttgttagcggcaaaacgataaactgtagcttgtctggcaaaacagaaacagagcaacacagagtattttggcgctgcattaactggcagcttttctggattaaagcttaaccttaaatagcaaattacaagaaagttaaacgtggccatagtggcctcctaattgtgtgtgccacactccttgccacttcgcgccatcccacaaactggagcacaccacgcacgacaccacggactccgcacgaacgcagcgtgtgtcaagcccactatgcacacaaacaggatgaacagatcatgtgcaagactcaacgtaaaaacagagggaaactaactactctgagcagctagacttattactaacaaatcacccccttaagtctgactgctcttgtcaagagaacagacactgatctttgaacgaagctcctgaaacctggttctgcccagagatttggtgaatatatcaccgagctgctccgcagttcccacgaacatcatttcgatcagtttcttttctgcacactcccggatataatgatatttgacatcgatatgcttactccggtcatgatgcactggattttttatcaatgatattgtggactggttgtccaccttcagcagcggtgcggtgatctcgtcgcccagcacctccgctaacagccgcgcgagccatactccttgacatgttgcggcggctgcggcgatgtactcggcctcacaggaggacaatgccaccaccttctgcttggaggactgccaagtgacaggcccgccattgatgaagaaaatctggccggacgtgctctttcgctcatctggatcgccagccagatcactgtcagagtaaccaaccagcattggcaaagcgcaccgtgcacctgggccaaatcgaattccccagcagcgagtgcctgccacatagcgcagtatgcgccgaacggcagcgagatgatcttccctgggtgactccatgaagcgactgacatacccaacagagaatgccaggtcgggtcgcgtgttgacgagatagcgcagactcccaaccaagctgcgatacagtgtagcatccacaagtggaaaatttgaaccctttctcaatttcaaacgtacctccatgggagtctgacagggattgcagtcgttgagtcctgccttctcaagaatcttgccggcatatgcggcttgccccagcgtgatcccatcactatcctgggtaacctcgatgccgaggtagtatctgagtgcccccaaatcactcatcttgaagagcttcatcatctctcccttgaagctgcggatctcgtcgtcgtgttcgccggtgatgatgaggtcatcgacgtagacgcccaccgtcagtcgtcttcctcccctggtgcgtgtgtacacaccatgctcggagctgctgcggtgaaagccgagtgacagcaaggagctatcaagtttggcattccacgcgcgaggcgcctggtgcaagccgtaaagagctttgtgcaggcgatacaccttgttcttgtggttgtcgtcgacaaaacccagcggcagcgagacataaacttcctcgagcagctcgccgttgaggaatgccgacttgacgtccatgtggtggacttgccacccttggtgcgcggcgacggcgagaaggaggcgcaccgattccagccgggcgacaggtacgaagacctcgtcgaagtccaccccctgtcactggacgtaccgcttagcgacgaggcacgccttgtagcgcacgatcgccccctgttcatcacgtttcagcttgtagacccattttagcccaattgcacagtggccatggggtaggtcagtgagcgaccaagtgtcgttgtcgacgatcgcgttaagctcgtcttgcatggcgccacgccagtttggatccgcctcagcctcagccagtgaagcaggttcgtcggcgctcacaacatggagctcgagctgttccagcacccgcggagcgtgtccgggcggtgaggcattccccagcaggttatccaccaggcggtagcgaggcacgacgtcgtcatctgtgtcggcgtccaggatggaatcctgggtaggcggcgtgacaaactcaaccgcctccggcgacggaggcgacggaggtgccggcgtcgtgggggctgacggagccggcgatggtggcgagggcggagtaagcgaagaagcaggtgccgtcccgatggtggtcgtcaccacctgttcgacggtgaacggctcgagctggggagcaccatcgggcgtcactggtccccagtcccaggcggcgtcttcatcaaacaccacgtccctggacacatggacgcgctcgctgactggatcatagagccggtaggccttcgagccttgctcgtagccgaggagcaccattggcgcactccggtcatcgagtttcttcagcccgggcttggtgatcttgacgtgccccacgcacccgaaagtgcgcaggaaatgcacagcgggctgttggccataccatgcttcatagggcgtctggttgtccaagctttacgtcggcgaacgattcaagagaaagaccgctgtagacatggcctctccccagaaccgcccaggaacacccttcgccttcatcatgctgcgggcagtggtgacgatggtttggtttcgacgctccactactccgttctgctgcggggagtagggcgccgtcaactgccgaccaactccgagattggcgcagtattccccaaattcgattgaggtgaattcgccgccacgatccgtgcgtagtgcacggagtttgcgcccggactccacctctgcacgggcctgaaaatgcttcatggcgttcgcggcctcatccttgctcctgatcaaggttagccacatatagcggctcatgtcatcgacaagcaacaaaaaataccgattaccagccggcgttgcaggttcgatcggcccacagagatcgccgtggacgagctccaggtgttcgtcagcgcggtacttggattgcgtcgggaacgccgctcgccgctgcttcccgagcaaacagccatcgcagacttgagtgacttgttgcagcagcggcagcccacgaaccatttcctgttgcacgagcttgcggagagcaggaaagttgaggtggccgtacctggcgtgccaccgccacgccggctcggcgctccttgccgcgaggcagaccggacggtcgatgtccagcttgatggtgtagaggcagtcgtcggagcatcggagacggacgagtaggtgccctcgaggatcccacacgcgcaggacaccgtgatgaatcagtaccttgctgccggaacgatccagctgtccaaggctgacgatgttcgccgtgagccgcgggatgtagtagaccccggcgatgccgcggtgttccccgaacctgcaggagaacaggacggtgccgcggccctcgatgcgaaccaccgagccgtcgccaaacctaacagtgccggtgaccgccgtgtcgagctcggcgaaagcggagcgggacccggtcatatggttggttgcgctagtatccaggatccacatcgccggatcatgttcgccaccgtcgtctagctgcacgaagaccttggcctcgaccacggcgagttcgcccatcggctacggcgccctcggcgcgctcggtggcgagacgacgtttgtcggtgcagcgacgcgaggacgcggcggatccagctgcaccttggccaggagcagagcaggctcttcgtcctcctcctgggctacgtaagcttgctgggccttgggctcgctgcgatagtctttggcccaatgtcccctcttgccgcaattcttgcaatttcccgggttacggcctcccgggttggctggcttgggctgggcctccttcggggctccatcgtccttcttcccatgccctcgaccccggcggtcgccgttgctgccggaggagtgagcggcgtcttgcagagaggccgccttgcggaatttcgccagccattcttcctcggtgaagaggagacggccattggcgtcgacccgactcgatgccgccgcagtcttgcgctgcttgcgttgctcgacggagcgcagacgcccagtaacctcctcgagagacagctcattgacgtcgagcaaggtctcaatcgagatggctatttgctggagatgttctgggacaacctgcaacaatttctgaacgacctcagcttcagtgatattatcacctaaggtgcgaaggttgttggcgaggccgccgatccgcatcgagaagttgtcgacggtttcaccgtcctcgaagaggatatcaccgaattctcggcgcagctgctgtgcattcgcctcacgcacgcactgcacaccgatacggcgagtcttgatcgcttcccacgcctcctgcgccgtctccttgacagcgagcgtggcgagcatctcggcgggcacggcgcgaagtatcgcggcgagcgcctgccggtcctgccggtagtcgacgagatcatcgccctccggctccaccgcgccccacagaccttgggcctgcatgttcacccgcattaccagcgcccagtcttggtaatttgtgcgggtgagtgtcgggtagacgacgctgctcatggtcgcctcgcggacgacgcgttccaccacgacttggccgcggccgccatgacggccacggcgcggagacggcgagcgccagcgacgacgcggtggtgtgtgggagacgtgcggcgttggtagcgacatcaggaatcccggcgatcaccgaaggctctgataccaattgttagcggcaaaacgaaaaactgtagcttgtctggcaaaacagaaacagagcaacacagagtattttggcgctgcattaactggcagcttttctggattagagcttaaccttaaatagcaaattacaagaaagttaaacgtggccatagtggcctcctaattgtgcgtgccacactccttgccacttcgcgccatcccacgaactggagcacaccacgcacgacaccacggactccgcacgaacgcagcgtgcgtcaagcccactatgcacacaaacaggatgaacagatcatgtgcaagactcaacgtaaaaacagagggaaactaactactctgagcagctagacttattactaacaaaggtggagcagaagcaccagactaacaccaccgatgctgacgtaggccacaacagcgcagtcatcgccgccagagacagcaacagcgcagccgtgggcagcatcagagcagccaccaccgccgcgggccgcattcgagccgccgccgccaccttgggccgcatccgagcagccgccgccgccacgggccgcatccgagcagccgccgccgtcgtgggccgcatccgagccgccgccgccgccacggaccgcatccgagcagccgccgccgccgtgggccgcaaccgagccgccgccaccgccgccatggaccgcatccgaacagccgccgccgccgtgggccgtatccgagccgccgccgccgccacggaccgcatccgagcagccgccgccgccgtggaccgcttccgagccgccgccgccgccgtcatcttcggtcgtaatcgcgtcgccatcaccgagtatggctacatccgcaaccccgccgccgactccaacctccataccacaccaacgagaagcaaaacgggaagaacccgacctaacgagactagcccggctactaaactatactaggggaggggggacgacccctctccctccctccgccggcgacgaggccgccggaatcgaggaggaagaggggtcgggagaagggaaaaagaatgtagtaggcgagggttcgagagagagggttcgagagaggaaggaagctgccgtaagctaggtggctcagctgttttcagtttacttaccggatggttaaaacggattgttgctccaagcttcaagaaacatattttatcacaaagttttcttctgttgtacatctcttgctttaatttatttgttaagttttgtttattagaatattttagacgaatatttaattagatcatactttaatcaagtagataatccacaacaacaatttgtttaatatttttttcagctagtcaagttccctattccttttttggaaacagtccctattcctcaatagctcccaaatgcgtcgtcagcgacagtggcacggaggtggttaattaattttcaccctcaaggggacaccccctccccttgttttatgcacataatctgaaaggtaataaatatatttgtaagatcgattcacaaataaatagaaacaaatataactataaccattgtacaatgttggtatatctattttcataacttgcataggtcgaatgtgaatttgtgtatttacatagtgatagatattaatattgatctatcttattatttttttatgattttttaatgacactagtattataagtagagtaaattacattttggaccataaattcttgccaaagttttactttgggtcaccttacaatgtctttttcactttgaaatatatattattgtcaaatattgcactttggaccgggtggcccacatttaagtgacacatgaacaatagaggtggttagtctgattgatatgtggaccacccaatctaaagtgcaacattggaaaaaaatacatggtccaaagtaaaaaaaaaacatggttcaaaatgaaactttggtaataatttgtgacccaaaatgtaatttattcttataagcatatgttttttaaagtaaaccaacacatatatgtgatatgaattttttttaagaaaaacaacacttttagtatggaaccgagtcaatgacaagagagcccacaccaaattgtctgcgttcggcaccaggtgagagagaagatttatttagttttccgcatatacgcttctagaactactaaacggtgtgttttttgaaaaaaaaaatatataggaaacttaccttaaaaaatcatgttaatctatttttaaaatataaaattattaatatttaattaattatacactaatggctcaccttgttttatcgcttatcaaccttctcttttccttgacactctctcaccctcagtgacgccacgcgtccgtctccctctccatcgcagcagctgcctgtcatcctcctcacctgcaatgtctcctcgtctccgccgccgctgccgccgggttagatatcctctcatgagcaaccagaataggccctatatatactccctttctccctaaatatttgacgctgttgactttttaaatatatttgaccgttcgtcttattcaaaaacttttgtgaaataggtaaaactatatatatacataaaagtatatttaacaatgaatcaaatgataggaaaaaaagtaataattactttaattattaagttactaataattacatgaagaagaataaattacttaaattaggcgagagagaggtggagggggaggaggagcagcggagggggagaggcgtcgccgccattgttttgagagagagagagggggggaggggaaatgattttagagttacagtttggactgttatataggtcgggatcaggtcgggatcaatcaggattgtccatcagatcagacggccccaacttctcccgcgtcgcgctgggcgccgttctgtaacaccctgaaaatttgaccaacgaaatcaaaacaccaaaaatacggattttcaaaaacttttcaagaaataaattgcatcatgccgattatattcgcctgtttcattggattttgatctgggaatttattaatcgcgaataatgaataactaactaggaataaaccctaaaaatcaagttggctaaataaataattaaaatataaattaaaataaagattaggtgggattggaaataaataaaatattatcgcaaccatattagcaataattaaattttagtacgatggaatgagaattaaccctaattaaaaattcaaataaattatataaacaaaatatgagtgatattaaattagggtgaatttttagttaggataacacaaatatggagtaaacttcatttatgtaaaaattaggaattgtggaatcaaatttataaaagaaatagactaaaatgagaaaaataggaaagtgcactgttcattgcactctaggtgctcgacgtggttcccctagccctagcccctcctctgccacgctgcctcgcgcaccgcgcgccgcgcgccgctccgcctcccctctgccgtcgccgctgtcgccgtcgcggtcgacgtcctgtcgccgctcgcgcgtcccatcgccgcctcgcgccccgagccgccgcgcgccgtcgccatcgtcgcttgccgccgtgcgccgccgtcccattgccgctgccgcaccgcgtcgccgtcgtgtcgccgtcgccctcgagccccgcgccgccccgtcgccatcacgtcgcccgtcgccgtcgtgtcgtcgtcgccgcgcgccaagccccgcgccgcgccgcgccgtcccgtcgtcgccccgcctgtcacgccgctcccacgccacccgtcgcgtcgcccgtctcccgtcgcgtcgcccgtctcgagccccgcaccgcagcccgtcgcatcgccgttccgagccccgcgccgccatagcgtcgccgcccgcgtgtcgccgtcgtcccgccccgagcgccgccgtcgcgtcgccattacgccgccgcccctcctcctctcctttccccctctctacaaatacccccccctctctccattttcccccaccccatctcacccttcctcccctcttccctctccactgcgccgccgctctcgtgccaccgcgccgccgttcctgtgccgccgcgccgtcgctctcgtgccgccgcgccgccgttcccgtgctgccgcgttgtcgttcccgtgccgccgcgccgccgttcccgcgccgccgttcccgtgccgccgtgtcgccgctcctgcgtcgccgtgcgccaccgtcgccgccatcgtcgtcgccgctgccgccgctggtgagccgccctccttcccccttgcgtccaccgccgccgctcgtgtgggagagagccgagagagagagggagaggaaaagagaggccggcagagaaaaaaaaggagtgaggagagaaaaaggagagaaaaagaaagagagggagagaaaagagagaaaaagaaagagaggagagaaaaagagggaaaatagaaaagaagaaaaggagaaaatagaagggaaattgggggagaaattaggaggatttaggaaataaaaatggtcggggttaatcatagattatttttggaaattcctcgagcgtaatagtatttcgatcaaaattccgagttaattataaaaatatgtttcttgatcagattagattaaaattggtagtaatttagatataattaataactaaacaattagatgaattcttatagattattatagattatttttggtaatctctataagtcatcggttcacggtagaaattcggatttaattactaggaatcttagccgtgtattatatttaatcgtttagtcatagactaaattaaatcgtataatatttctaggatttcgtccgatatttagctcgtaatagaaatttctaacctattatatggatataatgctcgggatgagtaaattaaaaacttatgacaacaaaatatttatacccgcaaaatagtttaaatcgaaattgggtttgccgtagttcgcagatagtaaagttaataaaaaggaatcgactttcgcattcgactttcatttagatttatttggatttttatttgaattctaaccgaattcaaatcaattttcgcacgtaactatagagcccgagggagttgcagatccaagcgaaggccaagacccgcaagactttgagcaaggcaagtcatcactattccttgaacatgttgatcctaattgcgtaattgttttgtttacaaataagatgaacatcctacttgtgattatgccatgccttgattattgtttacccttaaaatccttgtaaccatgattacgtatgagtccctagtcaattatgacaattgcttagaaatgccattctagaatcatgcatactcatatttatcaaatgctatatgcttgggcaattacctttgggaaggtaattgagatgcggcatgtggagacatgagcgccacattgccatgatgttgatgacatgatttgtgagaggagaaataaaatttaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaaattcatggagcgggtactgccaatgcaaggttatcgaaaagctttgccgtgacgcgtctcatgtgttgggacgaggctcatgtgttgggcagtcgcagagtgcgggtaaagtgtacatccactgcagtgtgagtaaaccaaatctatttgaatagccgtgctcgcggttattgagcaccgggacatgtattacacttggttagactctaaattctttaacttgtgtgggatgagatattgcatgatgatttttatgctgatggagccacttcctgagaggcgggaatgtggacgtcctcagaaaaccataacgactcaatggcgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttacaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttcttcttttggatgtattccggaccgctcggtccgatgatttaagactgtgcctgcgggcttatgatgtaataattcgtactagactctcgtgtatgtgcacttgatatttcagctatgagttcgtgtgtaccagactacttgatccagggaaatggtactgtttacacaattgattcctgttataaaaacgggggtccacacgttcccatgccacccacactattgggccgcgtgtaatcttctcacagaataagttcactttatgtccctaaagttatccccccactattggccgcctcatgggcctgtatgctccgcatggaataagtacacttgtggtcccttaagttgaacttttttttatttcattaggaatatattttcttaaagagctcatatcatgtgaaactaaaccctaatcatctaatatttttatatttagtatataactaaaaaaaatgcccgtgcgttgcaacatgtgaaggctattttaattatattattgttatgctagaaaaatgcgcgtgcttcgttacaggtaaaaacagttaaatgctataaagtctagagttaacatgtatatagtaatgtttcaagatagataaattattcattaggctaatgataatcacgacggataaaaaaatacgctcattctctccctcaacccttgtgtgacaaactgtgatatcatttccaaaatcgaacacatactcacgtagagatggatcgtgtcaggactcacgcgtggacgacagaataaaatacctgtgcattacattgggtaacattgggtaatggttaggtggatgaaatttgacctcaatgatttactgaagcacctaagtatgatcataaataccggcgataattcatagttgtcacaaatgtcacaaatgcatatttgtgcttcgacaattaatccgctctacgcgtgcagaatatgaatgatgtccctaacacatggtcctgatgattgtagcattggagaaacggatgtccgagcaacgcatcttcacgtataagtcaataatgaattttttgggaggtcattaattattttaaactacatttttatgacacttttataatcttttttcataattgatgattgctataacattgcattgattataagcacaatggaacagtacagtactaagctctaaccgactaaacctaaacagtgccagccgtatcataccattcctttttcttttgtagaaaacctcgtagcgcatgattaattgagttttattgttacaaaattaagaaaagttatctcgtattttatattaacttgtatatagaaagttttaaaaacgcgctaacaaaaatcgagataaaaggaacggagccatggtgtgaagtttcatgccatgcacatattcaattttcatgttttaaaaaaataccggttggttcacgtatttatactgatttttttatataatataattatctttaattttcgaattaaaaactagtgcattataagatttcagaatcactaaaagtctgttgaagaaagcggtgcaaaacttttgatttttcagccattggatgtgtatggtccgtgctagtggttgagagaaaaaaagtttacgcgcaaatatgatttgagaggagggagggaaagtagacttattctaggacctaggtaaacaatatatttatattgatttttgtgtatataatttaattatatttaatttttgaattaaaaaccaattcattataaaatttcataatcaataaaaatttgttgaaaaaagaggtgcaaaacttctgattttccagccatcgcacatgcatggtctgtgcaagtggtggagagaaaatttgaaggcaaatatgatttgacacgagggagacaaagtagacttatgttaagagaggcctatagacttgatcaataaaaatctgttgaaaaaaacggtgcaaaacttctgatttttcagccattgcacatgcatggtctgtgcaagtggtggagggagagaaaatttgaaggcaaatatgatttgacacgagggaggcaaagtagacttattttaagagaggcttatagccttttttttaacaaattggtccttttcaaaaacttatttcgaaactagtccctacaaaaaacttcaactaaaaataggccgtgaactcagcgccattgacattggcgctgagctataacgtctcagcgccaacaacgttggcgctaagctcgaatccgaggtagcatgaatttgctgagtcatcatagcttagcgctaaggtatttggcgctgaggtcctgatgatttaaattgttgcggaggcattcatcttcaacaacgcactaatagcatagtggtagcaggcatctactctatccctatggagcagggttagatcccccttctctcccatttttcttctctctctctttattttttttcttctttttcttctctctcttactctttattttttttctttttcttctttttcttctctctctcactctttttttttcctttttttgttcttctttcgatcccccatctctcccatttttttttctttttcttctctctcactcttttttttttctgtttgtctcatgatactatcttcaaaagatatgtttaaattgcaaatttttttgaatttggaaaaaaatattaaagtggtatattatgtgccaattgagaacttaaactattttgtaaacaaaaataaaaaattaattttgaaagaatgctatgaggaagagaaaaggaaaaaaacattttaaaagaatgctacgaggaagagaaaagaaaaaaaaacctaaaatacaaaaaagaaaaaggaagagaaaaggaaaaaaaacattttaaaagaatgctatgaggaagagaaaataaaaaaaaacctaaaatacaaaacaaaaagaaaaaaataattttgaaataatgctatgaggaagagaaaaggaaaaaaagaaaaaaaaagggaaaaacattttaaaagaatgatatgaggaagagaaaaaaaaaacctaaaatacaaaaaagaaaaaggtgaggaagagaaaaggaaaaaaaaagaaaaaaaagggaaaaaacattttaaaagaatgatatgaggaagagaaaagaaaaaaaacctaaaattcaaaagagaaataggtgaggtgggatacaggattcgaacctggaaccctacggctcacagcttgagccatcaaccactgggctatcactattttgctatactagagtgcttgcgcttctattaaaatcgtctgggcttcagtgccaaacaccttggcgctgagttatagtgactcaacaaattcataccacctcggattagatgttagcgccaacgttgttggcgctgagacgttatagctcagcgccaggatctatggcgctgagtcaacggactattgaagttttttatagggactagtttcaaaataagtttttaaaaaggaccaatttgttaaaaaaaacagggcttatagatacagtgcaagtaataataggttggaagaggaaactgggagtggagcccaggtggctgaaatgaaaactttcacccttaaccaagtaggcagacacctacaggtgacaggaggttacatagaagatacatacttgtatcatatcaaacgcggttttggagtggataaaaaaagggccgattggactgtttaccggattaaatccggattttagcgaagcgctggtgtgacagacgaaaataaaacacccggaaaccttacgtattttttaattaggtatatagatatagattttagtttacccgttacaacgtaccggtattttttttagagcatgaaaaaagaagaagcaaatagtaaaaatataatgtacatattatttggggacaattgcttatttgaccctatttcagagcctaactaccaatctgaccctactttttttagtttgctcatttgaccctgcttttaaaaaatgaagctgccgtctgaccctatttctattataccgttagggtttcatttaggaaaagaaaaaaattcaaattattattcaaacggacaaaaatacccttgaggactcaaccctatccattcgcactcaaccccatctctctcggcgccggtgagcagagggcagcggcagcagctgctccgcacggaagaagggaggcgcaggagctcgccgccgccgggcgcgaagggaggcgtgcggcgcgggagctcgctgccgccgaccgcggaaggaggcgcgcggcgcgggtcgaggatggcgcgggagctcgccagcaggtgtttggctgctgctttgtttttgctgttgctgctgctctccgtttctctctggcctctctttgttcttgcctggctggaggtagacggagccggtcaggaggactgcatgctgttggtgctggagggattaagtgaaatctaagtgaattttgtcaaaaaaaaaagttaaatctattaaaaactcgtcaaatccctcaaacctaatttaaatttgtcacttatcgtaataaaaaaaaatatcacatttttagataaaaatacacgaaattagacaagcaaaaactttgaaaaagttgagtcaaatgagtgagggcataaaagccatttttctctaaattaacaccgttatgttggcttaacaaaaaagagggtcaaaagagcaaacttaagaaagtaaggtcaaattagtagttagaccttaaaatagggtcaaaaacgcaattgcccctattatttgaatatcatgttgcaaaatgcacgggctgacgggcatcgtgttagttttagaaaaagaaaactctgatactatttttcttataaaagataaggggaaaaaaaacgaaccgactcgagcctgtcgatcgatctgcaacaatggcagctgagacgtgcgtttcggtgtcgcctgcagaggtggccgaggcggcggcgatcctcgacgtcgccggcgacggcgacggcgaggcgaaagggcagatcgtcgtcgtcgacgacgactccgactccgaacccaacccgtacgagtaccgcgtattcttcgagtggttgtgggacgactactgcaagatcgacgacgtcagtaagtagtattaatttttctgttaattcctgaaatcttagcaccaacaatattaattcgatctggatcataatcgaatatatatatatatatatccaggagaagaagatcaaaacacgacagatataggtggtgtttggatccagagactaactttgagtccctgtcacatcgaatgtttgcacattaattagaattattaaatatagactaataataaaactaattgcataaatgagagctaattcatgagataaattttttaagcctaattaatccataattagcatatgtttactatagatcacataggctaattatggactaattaggctcagtagattcgtctagcgaattagtccaggcttatggaatgtgttttatcattagtctatgtttaatatttttaattagtgtccaaatatccgatataacacgtactaaaatttaatccctagatcccaacatgaccataataatctctctaatttgatcttttttgcaatttgctgcagctaggggccccacgttccgaacgcccggggcgcggatattcccctgcgtggaggtgtactcgtgcagggtgattgacctcacaggcggattggagtggccgatcaatgtcttcggcttcgtcgcggtgcgtgatgggctcgaccgcaagcgcaactacatcttcaatcgcccgaggggcgacgcccagacactcaccacggaggtatattatataaacttataaattgtgaaaatgtaggttcagtatatctcggactaaaatttcaggatttttagttccccgtgttagggaatattttttcagatgtggttgaaatatgttaaaatttggaactattcagaaaggaacttctttcaaaatttgggtcgatctatgggccggtcaacccatccgatactttttagtaatataaaatttgcgatattgaaccccgacttgtttgtggtgaatttaattatatgttagcttagaaggattaccagttaataactaccgcaatgttctagcttattatgcattgacatcacattgctatgattatattttttttagacaagtcaattggaggggagagatttctcacctgaatttcactattcaaaagatgtaggcagcacatgtttgagattggattgaattgagatttcgaagtggggaggaaaacaatcttttccagaccgaaacattgacagttggtacggatttcaacaacataaataagatgttataatctaactgaactgatgaaactccatatatgtccagctgttgatcttgcataagctatttgcaagtgtggttcattgtagctaaatatttcatgccattgttgctgaaaaataaaattttaaaaaagacctatttgatcactttttttatggatacttgattaattcagatatctatagatgaaatttcacctagattttaaccatcgatgctacattctctataacatcgattgcttgggttactgatcaaagttctaaatggtttacttcagcgaatatatcatgtcaatattgcttgtgaatgaaacatatttggtacaataatatatgtttgctacttgtttttactcgggagtttttttagtatggttctatcaactttataaaaaaaactagtttttacccaaataacttggatatgtttgcaggacccatctttcatcttgacagggcctatccgtgcaatcaactgctctcagcgtatcgaattcgaaatcgatctcaaggttagggggaaaacacaatccgataaggataaggtgttgagtgccagatacattgtgtatgaaactatggggccaaatagtatagttgggcaggttagatcaaaggcaaggccaggcaagcgttgctcggtagaggtcacctttgcccatctcgcggggcggtggaggcggcgatcgaggttagagttgttcaaggatcaataagcggttttcgtggaagattcgtcgcgagaaccgatggttacgatgacgatgtggtgcttgttgattccagtaaagatggttctgtactagctgttgctgatgatggtgtgatcaagcttgctcggagtgtcgccgtcgtcgaaagtacaggggtgctgaaccttcatgcgatcatcactcgaaatgatggtagtagtagtggggatgatggggttggtgttgctgctgaagatcatgccgagttcgctgctcaaagatttgaaagttcttgtagaacacttgatcttgggttctgtaagatgctggcaactgtctcctggtcaatgattcctttgatttagtgtctccctaaagaatgatctcatgaacgatgacaatgtcaatgtgcatatgtcaagagttcatccttttatctgacttgagtgcagttaattgtaagctatacgttatcttccgtttccagcctaaattgatcaactcatggtcttcagagaattaattctgaccagcctgactgagaatgtacaatctcacttaggttcaatgcgagtacatgatgatttgtcgttcgatttatcagacgatgtacatgatggatctctctttggccagataagtccttcctttctctccttgcatcatctgaagcaccttgacctcgcatggaaccagctccaggggcccgattgaagtcttgtgatttt

SEQ ID NO: 69277 - DNA, 22018 bp, Oryza sativa
tcaatagatgggccagcacacaagacacacatacataactagtctatttacagcccaacactccccctcaagatgggtgatagatatctatacatcgcctccatatgaccacttcttggatcatgcatatatcgactcaccatactgacagcatatgttatgtcaggtcgtgtatgacatagatatatcaatcttcccaccaatctttggtatctttccctattcactggatctccagactccgcacataacttatgattttgatcaattggtgtagagactgggcgacatccaagcctacctgtttcactaagcaagtccaatacatattttcgctgtgaaataactatccctctaggagatcttgcaatttcaatacctagaaaatatctcaactggcctaggtccttgacctcaaattctttgcttagattccgtttcaacctagttatctccaagcaatcatttccagtgataatcatatcatcaacatagacagcaagaatggttatatgatctccacaatgatgatagaaaactgtatgatctccattacattgcttatagtccatagcacacattgcacgcctaaaccgatcaaaccatgctcttggtgactgtttaagaccatacaaagatttcttcaatctcaacacctttcctttagtttgtgaagtggcaaatccaggtgggacatccatatacacctcttcttgaagatctccatgtaagaatgcattcttgacatctaactgatgcaatggccaatcaaaattagctgcacaagatataagagttcttaccgtgctcatctttgctactggtgcaaatgtttcatcataatcaattccatatgtttgactatatcccttagccaccaaccttgctttgtatctttccacctttccatcaggattttgctttactgtataaacccacttatagttgacaattttcttccctttaggaaatggtacaagatcccatgttttgttcttttcaagagcctctagttcatctagcatagcttgatgccaccttggatcttgctttgcttctctccaatcctttgggatttgcactgaatctagtgatgctacaaaggccttatatgtggatgacaaggagtcataggaaacaagttggatatattattttcatcatcactctcatcttgagcttcaaaaccataccttagtggaggtttacctgcattgcttctcacactctttctaatggcaattggtaagtcagattcttctctaacttcctcttcttctccccctgactccaaagatccttgctcacggcttacatcttcctctacctgattatcctcttcaacttgttggattactggacaccttgttctccttgtgtatacttgaagatttttctcttcatgtggcttcctccattcttgctcctgtgcaacaggaccacccatgggacatggaattgaaccaaccacaagcttttccttctttggttgttcatctccctttggacccaatatttcatctttcatttggtgaccatcatgaccattagttgaatcatcaagatcaatgaataaagaacttaaatctgtcttctcaccatagaatgggacagattatctaaaagtaacatccatacttacaaaggttcgtctttctgatggactccaacacttataccccttctggccagatgaatagcctacaaagatgcatttgacagcccgaggatcaagttttccaatggaaggtctatgatctctaacaaaacaagtgcaaccaaacacttttggtggaacaacaaattcattctttccaaatatcatctcacatggtgtcttcattccaagtattcttgatggtgtgcggttgataagataagttgctgtcattactgcctcactccataagaatttaggtatattcatagtatacatcaatgagcgggctgtttctaagagatgacggtttttcctctcagccaccccattttgtggaggagtatcaggacaagaagtttgatgcaatattccttctgatgaaagaaagatactaaattcattgtttatatactcccctccattatcagttctaataaactggacccgagcattaaaatgatttttaatgtatgcatagaaatttagaaaacatttaagcacctcatccttatgtctcataagatataaccatgtcatgcgagagtagcaatcaataaaggtaacaaaatacttcattccactcatagagaccacaggtaaagtccaaacatctgagtgaattagcataaatggtaacatactccggagtcctctactcacatatgatgttcttgtatgttttccatactcacatgcatcacatactaacttatgtttatccactctacttagttctgctgggaacatcttactcatagtttcaaaaaatatgtgccccagtcgacaatgcaaaagtaataccttagcctcttcttcgcttgtagaagccatcaatgcaagacatacatcttcacttgtctcctttcgatccaaataccaaagtccatcacgcctgacgccaatcccaagtttcttccctgtttccctctcctgaattaaacaattctcacgatcaagggagacccgacaattcatatgatcaacaagagaacttatcgaaaccaaattcactggaaaagaagggacatataacactgatgataaagtgattgaaggagtacactgtactgtaccctctcccttaactgggcatgatgtcccatcagcagtttgaattgtttcttttcgtgtaaatgggtatggtttatatgatgcaaattctccacacatacccgtgacatgtctagatgtacccgagtcaagtatccaatttgaatgagaactattgatagacataaatgcttggtttgagttacctcaggaagaatgaacaagattggcaacatcaacatttgtagatctagaacaaccctcttcaagagtgaccacattagctctgtgatcacttctatactcatagcctctacctctgttacctctacctgcataacctcttccacctcttgctccacccctatcaccaaatcttcctctcccataactaggcttgcgaggagcgcggcaatcacgtataaggtgccccattttaccacaattgaagcactccctagtctctttactttgtgcaactacataggtggggcttggtgaagatggtgtggcactaggcaatactttcttcttaagcttctcctgtgccatagctgcaatagcctcatccaaggtaggaagggtggtttgatgaaacattgcattccttcttccttcaaactccgaatttaagcccttcaagaactcaatgacccttctacgctcaatccattttctcatttttgctatacaatcagggtgctctaacccaagaggattataatgatccaaatcagaccataaatgcttcaattcagcaacatattctgcaacagaacgctccccctgtctcaaaacacttatcttctcctgtgtctccaccattaacatcacatttccttctcttgagtagagattagtaagagttttccacatctcacttgcactagagatggtctcaacagttgtagcaatagcagggataagtgaggttaacaaccatgctactactaacgagttggtagtactccaagtcttccattcaacacttgatatgttctcaggctcctttatctccccggtaacatatccttctaacccctttgtcttcaaaatcaataaagctcttcttgaccaactcaaataattttttacaccctccaacttaatgtcattttgcatcaactcaattttttgcaccgattcagtatgaggaaccactgcactactcgtagttggagcctcattaaacttctttgcaagcatctctaccaatttacccattacttgttccagtccctgattttcccccattttaatcaagcaatacttgcagtagaaagttccttattctcaccttctataagttgtagctagggctgtcaacgagccgagctcgagcgagcttgtctgcccaagctcgagctcgacacaagctcgagccgagctcgagccgagcctattccaccttcgagcttttaggcaagctcggttcgagctcattcgagctcgagcttggctaccgagctcggccataagtagtataatatatattttaatgataatcttttgataagtataattattttctagttaatcacactaagaaaagagtagaaaatgattaaaataaatatattgtgctaacacatgctaatttattgtgtaaatagatactaatatatgtatttatctattagtttattatattaataaggtgaacatgcaatatgaattatacacagtcaagctcggccaggctcggtagaagctcgcgagcttttgctcaggctcgggttcggctcgtttgaagctcgagccgagctcgaatcgagcctaggacgagccaagctcgagctactcgcgagccttgagcttttttaaccgccctagttgtagctactctaaccagcagcagctacacaggcaccaaatcctcccttttcctttcaacagcaacagcacaagcacctcacctcctctctgtctcctccctttttttttcctttcaacagcacaagcaactcgtcgcacagctcttctctgtctcctctcacagcacaagtaccaaatccaagcagcagcaacagcgccaagcacactaccaacgcacagctcttctctgtctcctctcacagaacaagtaccaaatccaaacagcagcaacagcacaagtacactaccaaatccaagcagcagcaacagcacaagcacacttactcactccttccttcacaagcacaagcacacctagcactgcagccctgctccctccgtcacaccggccgcgctgcagcagccgtcgccgtcgctccgcctcagcagtcgacgggtgcagcactcctccgctcacagcgccgccgccacacgtcctccccaacaccagcgtctccctcctcgacgagctctggcgaggctagggtttagccgtcgccagccactagccggttggctctgataccatgaagtcttgtgattttttctctggaagcttcactttctctattgccattctcacttacatatacatgggatgggccctcttcaatagatgggccagcacacaagacacacacacataactagtctatttacagcccaacaccgatggccgtgtcccggagttcttgggttctttcaagaagttgagagatatctcaacctctccgggattctgttctccggtgaggttcctcctcagcttggtaatttctcgaagctgcactaccttgatctctcactgtctgacaatctgtattccactgatctctcatggttagcacatctaccaacatctctgagaataacatcactgggcatctgccaacatctatttaccatctctcatagtttgctaatgaagaaaaattgctgacatggatgtgagagatgataggagagagaaacaccgttgttttgcatgacatcggctagacaacgactctagaaaaacacgaggatactgaaaaacaccaagcgtagtatactgctgtcttcaacaagagaccgtccatgggcccgattaattcagatccgatacacaaatatatgcatggctgaaatttatatttgatctagtatatatgatgaatttattagtcatttattagatgtattaatggagagttagctaagagacagtcctttgtagatatcagttttttcgctaacatggagtgtagagagagcctatgctggtctctacctttgaacatgccctaaggcatcttaaaagtttatggttccttgacctctccgacaaccaccttataggacatgtgcctctggaaatcagtacactcactaagttggcttggttggatctaagctacaatgacttggatggtctgatcacagaagaactttttgatggattgaaaagcttgaagaatattggcttatctgacaatcgattgaagattgttgtaggttcagactggattcctccctttcgactgaaagtagctaatttagcatcttgccacataggtcctttgtttccttcatggtttaagtggccgatgggcatttcacacattaatatttcacgcggtaatataattgataggcttccagactggttcagtaattcattgtcaaatgtctaagtgttggacatttcgggtaatcaaatcattggagcattgccaacaaacatggagaccatgtctttgagtaaactcctcctgagttcaaacaatataacaggtcaaatacctttattgccaagagaactatattacttggatatctcaagaaactttttatcaggacctcttccattgaatcttggagctccaagaattgaatgcctcattctacgttccaataatttcaccggtcaaattccagtgtcattttgtgaatttgatgagttgtatatattggatttatccaacaataattttgaaggggagcttcctagatgtttcaaaatggaacacctgagctttcttttgtagtaaaaatggtttatctggcaaattcccaccttctctacagagctgcacaagtataacttttctagatctttcatggaatagattatcccggaaattgccaatgtggatcagtaacttggttagactgcgatttctaaaattgagctacaataagtttgatggtcatattccaaccaatatcactgatctttcacaactttaccatttgaatcttgcagccaacagcctatccggtgttataccttggcagctatcaaatcttgaagctatgacaaaaaggaagtctatgctacgtaagctcccaaacaattattcacggggagttgaccgttatctttcgaggttcaaacatatggttggtgaactatcagtcactaccaagaggcaagatcttaaatatcaaggctttgcacttttgggaatagtgactattgacttatcatccaactacttgactggtgaaattccagaggagataacatatcttgatgcattaactgaacttgaacttatctttgaatcacttgagcggacatattcctgacaagattggcgccttgatttcattagagtcgcttgatctctcagagaacaagctttcaggtgaaatcccttcaagcatatcaaaattaacatacttaagtacattgaacttgtcctacaacaatcttataggaagaataccatcaggaggtcaacttgacacactctacaacaataatccgtctatgtacgatggcaacgccggtctctgtggggatattcttaagaagaaatgccctgggaacgacgcatcaaatgactacgggagttacaaagaccactatgagttattgtatctctgctttggacttgtcataggatttgtacttggcctctgggtggtgttttcgacccttctattcaagaaatcttggaggattgcttattttcgtcttttcgacaaggtatatgacaaagcatatgtgtttctggttgttacctggaacagtctagcaagcaaggaggccaccaaataatcagtgctggcgatgctgcctccatgactgagtgattatagatttgtagtgtactatctgtgttagattgtgtgtgtttttttttgtcattcttaagttgaaaataatgttgactgttgtcttgttcagataatgtactgattgttgtcttctgttttgtgattctttactgtctctgttgtcatgataaatacaacaatttggtcattttcggttaaatccagttccactcatggcagtgcctgacaaccacaaagatatcaaacggaatctggttcagatattcctattgtccaaccaagatattattatgtgaaagaaactaccccattaccatcatctctctgcagctctaagctttgaagggtggataggggacacagccttgagccaatatcctgccagtccagcctattttggcctattgaacttagtatgcatggtgaaaattaatttgagttatagacctttaggcccatggagatccgcacttgtcaagatgcgtcactagtatagaagaccaattcaatgccagtttcaaaacaaccatcagtgctggacttagaaccgacacctctataccagtactgatgaggtaagcttatcgatgtcgaattgagaggcagcactgattgggaatgaacaactaaaaataaaagcacagagatcggctcaattcatcgagccgatgtttcgagccatgatcaatatcacaaattcagaaattaaatctcaaaatcatcacaaatccaacaaaatgaagcagaatatatcatcacataaacattacagactgataacattcatcacaaatctgaattacaaataaaatacattaagccaccactgtcatcggaggccaaagccactgccgccgtcgctcaccgaaggcccaggctcaccgtcaacggagatggcagcagatcttgtggtccggacaaacaggtggagcatgtcaccaccagcgactggtcgaaagtgcttataaggagcactccggtgatgggtggagcgtcgccctagaaagatccaaggaacaataggcaccatgccgacacagctcctcttccaccccttcttgcctcggtggagtttgaagctaagggcttaggttgctgacttgtcctacgggctccctctcaggcaggtcgatccagctgcgggcgcacaaaatcgaacgcctgagagctgcacctgagtcaggtgagatttccaggacatgaagtaaacaggccctaagtcccaccactaggccacatgcggaagggttagcataaaccatgtactgtctataggctgcgttcgttcgctctccttcccaatacgaacagtgcgcacggaaaatggtgcggtccattagcacgtaattaattaagtattagctatttttttaaaaaaatagatcaatatgattttttaaggtaactttcgtatataaacttttttttaaaacaaacatactccatccgtcctaaaatataagcatttttagcatagggacaagtcaaatatttctaactttggcaattaatagcaaaaaaaaaagatcaatcatgttaaattgatgttactagatttattattaaacaaactatcataatatttattattaaacaaactattataatatgcaactatttttatttaaaatattttagtttgatagatattgttggtcaaagtaacatatcggagaccgtgtcagagtaaaaaaatgtttatattttgagacaggagagtactatttagcagcttgaaaagcgtgcgcgcggaaaacgagagggggagctgaactgcctggaacgagaacgcacctaagtttcaggactggagtaaaaaaaaaactattttgctccatgtaggacaaatatatggtgtcgtgtcaagttacaatcaagactgaggtggtgtttggatccataagtcctagggacttattttagtcttaggactaatcaattaagttcatggctgtttggttatagggactaaaagggacttaagttcattaaatgcactgcacaatgaccatattaccccctaaaaccatgcaaagtggactgcaccatgcccttgctgcagcatgctgtttgctgccgctgctagcattttacaagcaaaccattgttgctgcatgacagcacaaccaaatgcaagccaaatcaatgtttgaccccaacatcacatgatttaatccatcataatttggacaaacacacaccttcagcaagccgaatcacaagcaataacccccacatcaatttcattatcaatatcacagcccaatcacagaaattcaaagaagctcatatacatctcaagttgttgaaatacatcacagaagtttcaatgttacaaattacaagcactcatggttcaattgacaagttaaaccaaatacaattcacaagaaaaattgaaccattcattacattcctttcaaataccacaatccatcggcaatccagtcccgaaattggttcatgacacgcgagtccaattcgtttgttggttcgctagatggagaagaggttccacccaatggatcataattttcatcatggtcacaattgtcgaactctgtatcagccatttgactgtctctaatgaaattatgaagtgctatgcatgcatggataattctgctttgcttttcctgcgagtagcttggtaaactaaacaaaatcctccacttgttcttcaagaccccaaatgacctctctatgacattccgacacgaagaatggcagtaattaaagtgctcccttcttccccttggcaatgtgctttcgttgtactcttggaaatatatgttatacccttgtatggtgctagataacccggcctatttgggtatcccgagtctacgagataaaactttcctggaggtggctttggaaacttggcactaaatctagtttgtgcatcattgaataccctcatgtcatgaaccgaaccaggccacccagcaagcacgaaagtaaatctcatatcgaagtcacagacacacataacattctgactcttctccttatatctattcctatgttgaacagcagctgaatttggcaccacaacttggatgtgagtaccatctattgctccaatgcaattatccaaatatggtgtgtactgaggagaaagcaatttcttatggactgttgtgaataagggatcttttggcctaatgatatcttggcaagtttcagtagagcggtcaaaactgctttgaacttactatgtactgttttaagagacctaacaaatatgtcttgggcttgcctaactgattggggagcacctactatccataaaaaaagacccaaacactccatggaatccatgttgtttttggacttcaactcatatgattccacaagcacagaatgtaacctctcaaaaactggcctgtgcatcctaaacatgttgtaataagcagttctattagctaatgttctcataacccaatcatgtccagactcaggtgctacccttcttggagccttattagagtaaagttccaagtaatacgtaccaatcatggcggcaagcatacatcctcttctcctgtccatttctcttttcttcaaaatataaatgataagatcaatctcagcatcactgctatcttcatcagagatatcttcatcaccactgccttcaccatcctgcaagagtgacatatgcatagaaagaaagcacatcataaatataatatgaacaaacttcaagaagaaaagaagggaaggtttaaataggtccacacatcacatgttcattacgtcacatcacatcaaacaagttgatagttcaacacaaaagtagatcataactaatgcagctaagacacaactaatgcagaccagacccatgatatgcagctaaagaaagggaccatctaatacaaattcttctgctggcaccatctcctcagccacataaatcttgcttctttagtgctaatgttcttaaacataactctgttatgattggaagcaaacaactgtgtggcacaaaagtattccacactgtcttctgctgcaccacactctactgccaacctctgacagtttgtcaatgactcagcaatttcttctttcttctgctcctttaacttcttgctgttaacaagttcagtaattagggtatttgacttatcacaatcagagttgaaagaattgagcagccccttcatgagcttcaccactgggctcttgctttttttcccaggactagaagctgtggacacatcacagctgctactccctctcttcctgctgttagtgctcatggggctgttctcataaccatcccctacagctctttcccctctagctgcctcccctgcatcccctgcttcttcttctccttcctcttcatcttcatcttcaaaacaagggatgtatgctgtggaaccatcaactgcaactccttgaaatatctctataagaaaatctaagtactcagggttgccatggagaaatttcttggcgtcccccttctcctgtattgacactaaatcaatatcacagaaaactctaaaatcatgtaaactagctaaatttttgacaactgcataccttaattttttttcccaccaagcatttgatgcaattatttctccactagcacttctaccagctccagtttgttggttcagccacacccaagcaatgtaataattctttagatgggtgaatctattctttatctgtttggttgaatgccttaggttagccctttggaaatatttggccttcaaattctggtaccctctagttgtccatgctccattaggacaatgcccatcccttatttcctcacatgctatttcacacaatgtgtaagttttttcttctgtccaatttgccttgtcatacgtattctaggaaagaaaaacatgatttaaccctaaattaaccaatgaacaacatatactgtaatacaaatgcttagatcacggcatgcatagcagtatcaatatcatgagcaacaattggcatatttcgcaatagaacaaatcaaacataacagaaagtaaccatggggggtttaccatgtgctgaccatcaggaccaaagtcctcttcgtcttcttcgttgccatcgtcctcggacacatttgtcccttgagacgacgaggcaccggctcgccgtcctcctccgaagactccaaagttgaaggcgggtggcccgctgtgcgacatggatgccccatgacctcggacgcctccttggccagacaatgagccaggaggaacaaatcctcgcattcccctgccagatccagcgccattggtcaacgacctgccacggcctcgtcctcctcctctccctccacgacttctgccacgtccccctcccgccgctggaggaggacgtgacggggggactgtggatctgctccctgcccgaatcggaggtaacacaaggctacccggttcaaggatctgttggtaggaggcgaaatcggggaaggcgtcggcctgggagttcagatcgaggccccccgatccccctcccccaaaatggatgccggtgccagatccaccatatcctgaagacccctgcgagaagccgtagtcggagccgtccatgtggcccgttggagcttcattgaacgactgggagaagaaatcgtgaggatttccacccgccattgctgatgcgcgattcgtgaggcttgcgcgagcggcgtcggcttgcacgacaccggcgaaccaagcggcgggcagaggactagttagcgcgtagttgcggtgggggctaacgcaggacggcggcgagggcgcggggttgtgagaagcgagagagagacggcggcgagggtgcggtgttgtgaggagcgggagagagacgacgcgaggaagagatgaggcgaggaaagagagtgggcgaggaaatggatagggatggctggcgtgaaggggcagtggctggaatagagccactttttcccaataagcacctccattcgggacttctggaaaatgcactattagggactttttagtccctcctgtttgtttctctagggacttaagtggggggacttcttcttaaagtccctcaaagaaacaggacctgagtaaacgaaacaatgtactcatcattcgaggtacatcgatctctcagctacaagtcttttgtcaaagcgacttatcaactgaacgcaagtgatacccccaaagagaagtcgtcgttgatctcgtctgctatatgacactagaataaagtgctatactaggtgaagtgagttggtgactcaagaatcaagataccctttaggagatttttccttcaaaattaaagtagaacacggaaaactcattgctgcgtttaaaatggaatggaaggaaggagtacataagttggtcactgttggagaggtacagtgactttgacctagctttcttgaaatggctttttaaccaccatggagagtcacttttgctgatggataataacacaagcatccatcaagccacttgctataccaaaacacacagtgaaccagcatctcacactgcagctaatcaatcacttagccatgctcatgcgtcatccgaccatcgccgccgccgccgcctcctccttcctcctcctcatgatcgccgccgatggccaggcggcgacgccgccaccacctgcagccatcggcaactactgcgaaccgcgcgagagagacgcgctgctggcgttcaaggaaggcgtcaccgacgaccctgcaggcctccacgcctcatggcgacgaggtggcggtcagctgcaggaggattgctgccaatggcgaggcgtccggtgcagcaacctcaccggccatgtcgtcaagctccgcctccgcaacgaccacgccggaacagcgctggccggcgagataggccagtctctgatctcgctggagcatctcaggtaccttgatctcagcatgaacaaccttgcaggttccactggacatgtccctgagttcttgggctctttcaaaagcctgagatatctgaatctatctgggatagtgttctccggcatggtgccgcctcagctcggtaacctttcgaacttgcgatatctcgatctttctgggataagattatctggcatggtttcatttctgtacattaatgatggttcatggttaggacacttgtccaatttgcaatatctgaaccttgatggggtaaaccttagcacagtagttgattggtcacatgttctgaacatgatcccttctctgaagattgttagcctttcttcttgctcacttcagagtgcaaaccagtctctcccagagcttagtttcaaggaactcgagaagcttgatctttccaacaatgactttaaccacccagctgaatctagttggatttggaacttgacatctctcaagtatctcaatcttagctcgactagtttgtacggtgatattccgcgagcgctaggaaacatgctgtccctccaagttcttgatttctcatttgatgatcataaagatagcatgcgcatgagcgtgtcgaaaaatggcaatatgggcaccatgaaagcaaacttgaagaatctatgcaatttggaagttctagaccttgattgtaggctagaatatggaaacattacggatatatttcagagtttaccacagtgttcacccagcaaactgaaggaagttcatttggctggcaacactttaaccgggatgctaccaaattggattggaaggctaacaagcttagtcactcttgacctcttcaataatagcattactggacaggtgccttctgaaataggtatgcaaacaaatctgaggaatttgtacctacatttcaataacatgaatggtaccatcacagagaagcactttgcgcacctgacgagcttgaagtcgatatatttgtgttacaatcatttgaacattgtgatggatcctcaatggttacctcccttcaaattagagaagtcttactttgcatctattacgatgggtccctcattttctagatggcttcaatcacaggttgatattgtcgcacttgctatgaatgatgctggcataaatgacacattcccagactggttctctacaacattttcaaaggccaagttgttggaatttcccggtaatcaaatcagtggtggattgccaacaaatatggaaaacatgtcattggaaaaattatatctgaaatcgaaccaaatagcgggtctgattcctcgcatgccgagaaatctcactatattagatttatcaaacaactcattgtcaggacctctgccattaaatattggatctccaaaactagctgagttgaatctgttatccaaccgtatcaccgggaatgttccacaatctatttgtgaactgcagaatttacatggcctagacttatccaacaatctgcttcatggagagtttcctcaatgttctgggatgagcatgatgtcgttttttcgtctgagtaacaatagcttctctggcaacttcccatcttttcttcagggttggacagagttaagcttccttgatctatcatggaataaattctctgggaatttgcctacatggattggaaatttcagcaagctagaaattctgcggcttaagcataacatgttctctggaaatattcctgccagcatcaccaaacttggaaatctttctcatttggatcttgctagcaatagtatatcaggtcccctgcctcagtatttggcaaatttgacaggaatggttccgaagcaatattatacgaacgagcatgaagagagactatctggatgtgactacaaatctcttgtgaccatgaaggggctggaacttgagtatgatgagaaaatgtaactgtggtgaccattgatttgtcctcaaatctattgaccggtgtgattcctgaagacattacttatcttcatagattgataaatctgaatctatcgagtaactatttgagtggaaaaattccatattcgatcagggacatgcagtcattggaatcgctcgacctctcgaagaacatgctctatggtgaaatcccacaaagtttgtctgatttatcgtctttaagttttctgaacctatcttataacaatctcatgggaagaataccattagggacacaacttggcaccctctatgaccaaaaccatcatctgtatgatggcaatgatggtctttgtgggcctcctctcccaaaaagctgttataaaagcgatgcatcagagcaaggtcacctgatgagaagtaaacaaggttttgacatagggccattttccattggagttgcaatgggatttatggcaggtctctggattgtcttctatgcccttttgttcatgaaaacttggagggttgcttacttctgtctcttggacaaggtgtatgacgaggtttgtgtgattgcggtttttggttgggcaagattgacaggaagaacagatgcgagactgctgatgtcacaggtcgcatggtcatccatcgactccgacgaatcctatgaatagtaatgaagatgaaaaggctgaagcaggtgaacgacactatttgttgggttgtatatttgtcatgtatggaacttattagagcaagtgccataaatgcatatgatgcatagatctacaatgatgtatatatatctgtttgtactggtacagttgtgtagtgtgtcagaaatcatccttcagactaaatcctgaactcactctttctatcagagctctgttctgaatgttgtcgaacagctacagtacctgaagaaaaatgaaaacagagcatgcagagctgggacagaggttttgcgctgcaaacttcatcagcttttctgggcttatattctcccctaatatgcgtgcaaaataagcaactacgattggctgaaaaaaattctaaatcagctagtccatgaaagactaaacattctaattacttcctgttgaactgggcttacaaactaaataaatagtaactgaaatgagactaaatcagagggaaaatgcaatgaagtccactggcatatcgaggattatagatatgggtgatccaacttacataaatttttttaaataccacaaatataacaagacgatattcaatagaaatataaaattgatcaaacgcacatcaggatatattaatgatgttttttccccttttcccaagagttttattcttttttttacttacatgggcttttggctatgtatttttttccgtttcatgttataagaagctttgacttttttttctagtcaaacttattaagtttatagaaaaatgtagcaacgttgtcaacacaaaagaaacatactatcaaaatataatcaatgtatttaatgaaactaatttggtgttgtggatatttctaaattttatacaaacttggtcaaacctaaaaaacttttattatgaaagaaaatcaaaatatcttatagatgggagtagtttgtaaaattttaagaagactggttgtctcccggagctaattttttatattttaatcctttttaaagaacttattttacaaatagaccattggaaaagagtctattcctaaaataagtttttccaaaggactatttgtaaaacaagtttatttgtaaaaacttatttggtctatttggtcggcaccgacaccctcgccctcctgtagaagccaagtcactgatgtgaaggggtccggtgccaatgacactggtgtcgagtacccatttgtaaatagaaatctaaaaagggttaaaatgtaatttttttaaaaaaataagccctcaggactagtatcattggctcctaaaaaagtttcattcctgagataatttttttagacaagttttttaaaaggattaaaatgtaaaaaaaaaatccagcctgtcgcaggataccgtgctgcagcccattggaccaacgttactgaactacaggccactagcctttccggccgccatctaggatttttaatggaaaaggcagtaacccgcacttgtatatgtcgacgttttagatcacgactacggtatttgcatggtatggggatcgttggtaccaaagtatatgcgagattgaagtaaaaagagatagagaaaatgatttttatacaggttcggccccttattcatcagaatcaggtaataaccctactcctgttggccgaagccggtgttgctcttattcatcaatatcacacaggtacaatgattgggataacctatctagtcatcgttgacttggtggcaaggaaaaccaacacgtagtcgacaacaggggtagtcttcctcctcgaatacgtactcggcgagataagagatagcgctagatccctcttgatggcctccgatggtaccagattaggtatgtctaggctaatctccgatctcctagggggtcttgtatttatatccatagatgtttcccgtccaagtataactagggatataaatatggatacgattcgagtagtccttgttgtttccaacttgaactctatttgtccttctttatctggaactccttatatatacgaggtatgatttcgtataagacttggtatatcgtgggccttgccgagcttagtcgattactattgggtatgtgttatttataaccctgatagtatgtatctgataaaatagtaatagcatagcccacttgatacttccggctactccggcaaatgcctaggcttgtaggcaaacacacaataaaattttgttgctagtgcagcgttttgaagataattctttaaagcaaatattcaaggtaggtagttttaggcaaaatttgctactgaatatccaaactttacgctattttctgccggatgttgcaagaatgtttatctcctagagggcaccggaaaaaaaatgataattggctgctggacaccaatggcattattttattatacgtgctacaaatggaaagagaaacaatgccaaactcctaatctgcccctgtctccattggttttgatgccatggcggaaggtgaggacgaggtcaaagtccaatgtgatgtgcgtgtatgggtgccacgcctgctcctccaccgcctctgccacaaacctctctagcttgaactcctccagctccaggaactgcagagcataccctaggtgccaaccacagggcggcggcgaggtggtggtacctttgggaggaggtggacaggaagctcgtggctcgttagcttgctcagctcatttaaattttgtaacgagccgagctggctttaaagctcgttagagataacgagctcgctcgcgagccttaacgaggtagcactctaaggcctaagcccaacagacagcacaagttacacaacgggccaagcccaactggctgcgctggctgagaggaaaaccctagagtcctactcccggtcaacccgtctccagcaccctgctgtccttgcgctgcatctctcattctctctcactcgatcccctttcacaccgccgcgtgctgccgcaatgcgccgccccaccgccgccagccgccgcgccgcaatgcgtcgcgctaccgccgccagcccgccactgctgctcgctctcctctcctcacgcgttagtgacgccggcgtcacctctcgccgccagtcaccgcccgcatccgaccgtcttaactccttagccaccaaaggagcgccgcgccgccgcctaccccggccccgccggccacccagaagcccactgacggccgtgtggtgagtgcgatggaggaagaataagaggtgcaatagcctcaggttgcaagtgttgctgagctgaggggctgagtgctggccgcctagctgcctggatggtttggctcgtgagcctaacaagctagctcgagctttcaaacgaggcgagccgagctgggtttctagctcgttacgataatgagccgagccgagctagcttgttatcctaacgagcttgaccgagccgagctggcttgctatccaccccttgcagcccatcttcgccgtgacgtctttgcggtcctgccgccggccagcgatgatggcgtcgatgcagcgacacagcaggcgctcgttctggtccatcttgtagtccgccttgctgatcacatggcgcaacagccgcttgcacagcatctgcacgcacgagaggaagagccccaggatggtggacagcgagcttgacaggtccatcttgagagaagggcaaattcgtactttcatcattgcttctctctccatttatagcagaaataataaaataatatcaccgatgtccaacagtcaattactactttttacagtgtcctttaacaaatacgcgtttatttggtgccatgtagcaaattttgcctttgctatatgcatgcaaatatagggtagatggaacacataaacagataaaaacaaaagtgttttatgagagccaaaaccgaaccgaattttgaactgcaagagttcttagtttagattagaagatattaaatcatgagtagttacgagaaaagaccagccgctagtatggccgataggtttcctccccgaatagttatcaacctaatattttcagttattttctttttcatttttatcaacaccgatcaaacaccgatcatttatatccttgggcctgcaggttcacgcgcatcgacaccgatcaaatggagtaattggagcgtgtaagggtggggtaggagacggcgccgctctccttgaccaggcactgcacgacgagttatcggccgcgttgccgtggaggcaacggctagtgctgccgcccggtgcgccgaggggtatgcgattgcccgccggcgggagccgacatcacgctctgatacccattgtcagccgcgctcgcaatttcccaactcaaccaagaactcacaaacgcgaaaatcagtagaacataggaagttttggtgctgcgcaaagcttgcagctttcctgaccttatctctgaaacttaaatagcagtatttacatgcagactcaaaaactgaaactcggagatcctgttgggtttagtcccacatcggtaattgatgatggaggaacatgatttaaaaggtgggggcggtcctcattcatcagactagtcttttgggttgtgtaggctcagggcctaaagttgtggctctggttgggcctgtggtggagcaggccaaatgtgacctgtgtggcccacggttagtgggccgggctgcgcactctaacaagtggtatcagagcccaaggtttgaaacccggaataatttccatgggtcacatggtggggaggccgagtaacaagtcttcagggtcacatgccaaacccggaacaattttcatgggtcacatggtggggaagccgagtaacaagtcttcggggtcacatgccaaacccggaacaattttcatgggtcacatggtggggaagccgagtaacaagtcttcggggtcacatg

SEQ ID NO: 69278 - DNA, 1846 bp, Oryza sativa
tggtcctcacccatcagactagtcttctggattgtgtaggcccagcatctaaagttgtggctctggttgggcttgtggtggagcaggcccaatttgacctgggtggtccacggttggtgggccaggctgcgcactctaacaagtagttcgtttgtttactttgcatatttacacgcttgattcgtcccatgcatctcatgtgcgtgtgtagcacgtactccatatgtgctgtccgtacccacgtatgcaccgtagtcgcagcactcgtgttcaccgtccacgaccccgtcgtcatcggccctgcacgtcagccgcgccgcgccacgctcgtcggcttcgcccttccgccgctagcctccctgccaccacggatccacgataaccgcgtgcgtcgggcggccatccatggcgctattcctctgatctctccggtcgccttcggccacgcccggcctcgatttccggtcacgttccgccatcgccggtttgatcgtgagtgaggccgtcgcctccgcaacgtcctcgttgtacaccgatcttatcgccacgactgacgatcttctatcgatgcacgatctccacctcgtgtttcctcctccacatgtcttcttgatccaatgctgaaaccttctactatgatatcacttgttataaaagttagtcgatatagcggaacgacgactaaccttctcgatcgcttcagtcattgatcacccaagacatgctagatgacgacacaggaacacacgatatttgttaacaaggttcagccgaagcctacatccccggggctctgattatgggcgctcctccccaaccaatatagctcctagccactacgagtccatggcctcgccgccatcctctccctgcgtgtctacgctacattgtagtcgccatggttacattgtgatgcccccctctctatttgagagagttgccgggttacagagttcgactctaactctatcccctaacacctattacaactccaagtccaaccgtaactaaatagaactagtatattcaacacctattctaacactacaggctgcatgcaaattaattggtgtattgggcatgtgcttggtcaaaagtattgcacctctggattggcttgggtgcagtacgcatgcaagcacaagctgatactgtcacaccctgaaaatcctaaatatataaattgttgtttaattggaatttttagaattgattttaaaagcctagaagtgaagatctaattttaattaataaattccaatataaaatgggaccagataaaatttcattaaatactttgcttaattctataattcctagatttttctgggatttatttgagctaaggaagtatttttaataaatggaattgcatttaagaaataatttaaactgaaaaaggttttaaaaagtctcttttggctttgggccgaaagtcggcccaaaaccgctctctctctcctcggcccaagtcggcccagtccgccgccgcgcgcgcgcgcgtccgcccgctgacaggtggggcccacctgtcaggcccgtcgtctacctccggccgccgccgcccgaaaccctagtttcgcgccgccgccgttcccttccaaatccggccgttcctttccttctccggccgaatcaaaagaggggaaatgatctccgggatctcctctaccttttctcttttggaatcatcggccaaatcagcttggaaagtgtttgattcgaggtcgaatcggatcggcttttctctctccgagcccgacctttccttctcgtcgccggtcgtcgtgggccttcgccgccgcctccgagcccctttaaaagcttgagtattctatagtgtcac

SEQ ID NO: 69279 - DNA, 1096 bp, Oryza sativa
cctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggg

SEQ ID NO: 69280 - DNA, 1179 bp, Oryza sativa
tgatttcggcatgattttgtgtcaagatgaacaccctaacttccaacctgataagaatcgatagatagataataagacacgcaaaaatacaacatcaatcaatccatccatcacaaccgagagaggaacagtcaatccaaatccgaatcaaatctaccactactacgctaaccgctgtgacatacgcaatcggacgcgggaaacggagacggaggaggcttaccggagatctgcgccgccgtcgccggaggggaagcaggaggaggagtacggacgaattcggtggtgggtttcctgcttcgagtagcgtctggaagcgcatataaaggccttccagggaaatccagccgtcggttgtcgtatggacggtccagatgcgctggacgggagaatactagaaggttcctgctgttgtgggctttttgggttaagctcgtgggctgggccggttctgaaagattcggggtagaagttttgggctttgacatgttcaggctttgtagcccattaaagccaaagtagttatacttcttgtgagtattattcggagagagctacaaatcggacgcccgatgatataaaaaaaataggacggtcaaatgtttcagttgaccgttggtgcaacattacgttatacatggtgaaacaaaaaaatcaacctctgaaacatataaaaattttgtgaaacacaattagaatacatggtgaaacatattgctatcacgtatgaaacattaagttcttattgtttgaaacatatgtttttctttcatcaaaatatagtcatgtgatatcttattgtaaagatttaattataacaaattcaacggtatgatcaaatcactcatcgcataaatagtttggaagaaaaagtatttttaagatcactaaatacatgcatacatgtatggtgtggggagaaagccaatcgaatggcatgagagagtagtggcgtaaacatcccatactttttctcggtcatttatgaaacattaggttataatggtgaaataaaaaattcagttatcaaaacatttaaaatttttttatgaaacataatgaaaacatgtgttgaaacatattgctatcgtgtctgaaacattaaattttaacggattgaaacatatacttttctttcatcggaatgtaatgatgtgatatcttgttgtaaagatttaa

SEQ ID NO: 69281 - DNA, 9109 bp, Oryza sativa
  unsure (1)..(9109): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagcggcatgcatggaggaagaggaagacgatgacggaggcggatgatgatggtgctgctgctgatgctgtccgtagtgatggtggccatggttcatcatcatcccaaaggagatgttcatctcctgctgctgacgatgctccctctcctgctggctctcgctcccgctcatcatcgatcgatcaaatcaaagctaacctcttcagaatcgagaggaggaagaagagaagaagaagaacacacgccgaaacatacacagagaaggcaaggtagcaagctatatacgtatgcgtatgtgcctctatctatctatagccatagctgcaaggtcctaaatactctttgactctatgaggctagcagccaaggcgccacctctctctctctcactcactttctctcttcctcttccacaccagcaactaccccatgcatgacctctagctctatctaggactctagttcgtgatggcgccttggacactagcaccacttgcaaactaccctctcttactgctttgatgatgctgttcctgggctgctactgctttgatttcctcttaattcactaatatggttgctgatgatgatgatcttggctatgtgtttctagagagagaggtgagtgggagagccattaatggcgaaacagactttctgtttggctccatgctccctctgcatctaatggtatactgctacaaacagccgacttcttctcttctctcctctcctctcaattttctctctctagattgagagagaagtagagagagagatggaggggcaggtgaagcagaagacgtcgccacctttaatttttctgccacttttgcaccgaagcactcgtggtttctcttattctcgtttcaattcaaaccccggccggtgacaaattgcattagccattaatttagccactgtattttgttaactaaaaactgaactgttattacgatttgagatgccggtagagttgtgcagttgtgcatgcatgcaccaattaacgatttgagatgtgatcctttcaacttgtctttgtctctgttttgactttcggtagaaaccgatattgatgtgttcactcccaacagcaaagtcagtagtacgtactaccatgaaaaaagttggtcagagccacccaaagattgcgagagagaatttttctatgagagtgagctagaaaaagtaagcaatgccttgtgccaaaaagcccaggcctcttctaaaagtaaagtgagttcaaactgcccgtttgtctcacggcctcgatcgtgtcgatatgatgttgtagagattaattgatactatctttgatttttaaatataagtcgttttagccttatgataagaattgagaaaacaatacaaacgactttattgtgcttcatttatactgcggggaaaaaatagcgtgtttatttgtgagcgaggtaggtagcatttatttagcaatgacgggtagggaagaaagaccgaaaaagtgtcttgaagttccaaaaggacttgtatttaataatacattgagaagtttaaaatgatttagaatcagagagagtattaacttgaaaatttgcaaaatgtcatgtgaatcagtttaattcccatagaactccatgaaactttgtacccatgatttcaaagaggagaagaactagataggtgtggtgtaaaaaggtaacgtaggtagcatgatcgaacagaagcatgcgacgaacaaagaaccacccgccttcctagccatggtccccaaaaaaatatacatatagtttaattctaaacggaagaaagatctaagaaaacaacacaaatgattttatcgtgcttcatttatacatggaaaatgattcatttacttacgagtgaggtagcatttatttagcaatgacaaccagggaagaaataccaaaatagtgactataaattccaaaataactcatatttaagaaaacattgagaagtctagaatgatttagaatatgagggaatattgacgtaaaaattttacaaaactaagtgtgtgaatcagttcaattctcgttgaattccactacccataattccaaagaggagaagatcagctagacagctagacaggtgtggtgtaaaaaggtaatgtaggtagcacgatcaaactagagtaggagaggacaaataaccgtccacatgcctagctatggaaaaaaatatttctagtttaattctgaacggaagaagtgaatcgttttagccttgtgcggaacaagtaaaaaaacaacatgaatgacattattgcacttcatttatactacatggaggaaataactcaattatttacagttaggtagtaagcgtttgtttagcaatatcaaacaggaaaaaagaagaccgcaaaaatgactagaggttttaggacgacttagatttaggaaaatattaaaaatgctataaaataacttgaaaatctgacaaaagcctataacattaaagaaagtacaaaatgtcacgtggatcagctcaactcccgtaaaacttcctacatatgacaaattgggaaggaaaacgttgagcaagcatgctataacttgaaatcagagggagtataacataaaaactttacaggatatctaggttttaattctcctgaaaattctgcaaaattatactttccgcctatgattagtgtggtgtaaaaaggtaagagtttggtttggtagtataggtaggttggtcgagcgaagtggaggatcgcgcgggcgacgacaaaagaaccgcccgctcgctcgcgctggctgtgggcatggtccaagattgagagccgcgcctgggatcagacgcacaagagacgcagaagaattattcgccgagtatgtgaatgctcctgttgctgccctcgaggcacgtataccgtccccaactcccaaaatcatcagtctgttgaatgaatgaaaatgaatgaatggccatcgccttacgtggccgctatctccccatcctccgatccaatgcatctttgcttaatttgcgttgcattatcccccgaattctcggcaaatttctcttcatcatctccagtttctgtttgttttattatctcgatcatcataatacaggtagtagtagtttgttatagtacatctatcatcttgaaatcacaacacttgtagtcctactagcaattatttttacgtgaaaaacataattaaaaaaaaccacctgcgccgataaacaatgatcattgagttgtctggcttaacaaaaatatataaagagacaagatagaatcctaaagtcctactagcaaactaacctgaatatattgcatgttaaaattcaaatcacatttatatttaacagtacgtttgttgaaattggttcaattctcgttgaattcctttgttgcaacggacccaattgaattggtgcacacgttacaaaaaaactggcctgaattcttggaggaacaggggagaaaagtttcgactgaccgacttaaattgttcgttcactggacgcattaactttgaagtgaatgtgctagcgagtgactggcaggaggatcgtcgatcggaccaggaggaccggaccgagggagttctgacatcttggaaattgcagtctcgagatggtaactcgatcagttcagcagcctcatggcttgtaaaaattcttcgtcttctcgtgtactagaaaaaaaagattgttccttttgagactttgaaaatacagttgctgctgctcatgtcatctggagacttgcagcctgtggtaggacgctcctggaaattgcagcatgagttgtgacccagtttagcgaagccgtcaacctttgcctgatgacgacgaaacaggaactccgtcagctcctagctaaagaaaacacagggtcagattatctcacgagattattaatttattatcattcgtttatgacaattcatattctaggaaaaaactcagcatatattattatgtacaaacggccggaagcagattcttttctattatataacgctcgtttcagctacaaaatatggtcaagacgacagtgaaaataaatgaaaatgcaaacgtccatgagttatttctttacctaatgtgctagaagagaaaaggtagagcaattgctaaaagactcaccttgacagcataggtgaagaggagtaagagcaggtacgatagcaggctataagccagctataaatatattttaaagagataaaggaagagagagaaaagcggcgggctacagatctgtagccagctgcagcacgaattctaagatgtaatgtgtgtatgatagatgggactaggtattaatagtatagtaagcaactattgtatgaattgactattacattagttatagataatttggagctagtagtgggctatactattaaacttgccctaataaaagattagtactctaggggtagtagaaaggacttacggagtacacttctctccatgcgtaaagagtacttgcatccaaaaggagaatctccggtagaagtcaaaactgttactgcctgacatcccgtttcgcaagtcgatattctactcaacagagcttttcactgatccagtcgttctgaattctgaacatatgctccagcgggtagcaggtctgccatgtgatgggaggcatggagctgcagctgctgctgcaaaaggattaggatcagaggacccacaatagttggcccctgctattttgtgcacaagaacagcaatcaaataagggaacaagaagtcaagaacaacattgtctctccaagccaagaggtatgaatcttgtgtctttaacgcaaaaggaatcaaacaaaatcatcctaaaaacacacgaacagaaaagaacaacaaacgagaggcagcaacaacattccagcatggactgaacagcaatggcaaaggctcaaacaaccaaccaaacaatgcaaatcactgcgatgtcaaaacaaaaatgcagatgacagataacagcaatgggaaatgattatgcaaaaacagaacccgctccatgatgagatgaatgtgttacatgaagctctgcacaattagaagtcatatggcaaactttgtaaaagtactgctgacattgacagtaacaaaaattagtatttcacgaacataactgccccaatgcgatcaaagaaaaatcccttcactttgacctttccctaattcatgcattacaaacatgtcgcaagtcaatgacaatctcaatccattatcaattcgaattttttgaaaataaaaatagcagcagccattcattgcttggattgatctctacttttatcattgaaaagaaaatagtatgtcaacttttaacatttgaaactatgttggctgttatgcatacaaagcttttcttcgtgaaatatttatcaagaccatttcaagttcacatgctactcccaactcacatgcttctcaaggatacataagctacagctcgcagatcttggatgcatgcatagtcacatagatgcactgtggtgagaaaacttacggatagcctctagataagaataatcaagcatagaagatacatggtgcaagggatccaagatgcatggtttaggaaaagaaaattgtactggaagcaatttctactttccaagaaattgtgctgggtcataagtaagcagctcccaaaattaaagcatctcataaaaataagcaatcatgatgatatagttactatcaatgctgcaagaacctagtaacattctacatgctcatggcatttgggcagaacaggttctttcatataatagtcaaaactcaaagattatactttcataataagagcatcagttcaggaccaactctagccatagattgatgggtttcttcgcccaattaaacatcatgtaaccacatgcagcactgtgcttagctgaagttattagtattaataaaattaagataaaacttatgcttcccagtgtttagccataagcaccagaacatttccttaacattagttgtttttagttttttaggtaagagaactacagaagacactccatggctcttattcagcgtataaacgctttcttggacttctttttttttttaaaaaaaaagcaagcaggattgcaaacagattctacaaattggaaaatgtaccagtcatacaaaatgtccagcaggacaagctatcatagtatcatacagatttaagggttattttcttttagggaatgcacaaagacttgtctatcatcacatcaagcctgggtactgatgttcaattacatcgatctaacttcacagctgcatgagaccaccaaaagtaactatgccatattgccatgtatgatgtatcgttgcatcaagggttcttttctctcagctatctccaaaaataactatgccaattgccaagtagcacaaggggacagaggaggatagtgttggtgtgatttagtagcagcccccattgccacctggtagatagtgccattacattagagtatcctaaaattttatatgcacttatagaattgcttcacttttgtaactattagaaaatggcactggcaaagagcttttgatctgctacaacagttctctacttcattgtaattgaacatatggacagatcggatacaggaggttcctatcaactgatgatttttcatttattagtcgcatataaaatgttgaggtgaattctcaatgtttctgtagaatgcataaggggagagagtgagagaaagcaggagaccaaaactttcatttctcgcaggctaaaaaaattacaaaaactatgttcattcttcactagatatctttcttcagaaaaggccatatttcaaacttaaatcatatacacctttcccatttacaattcggtcatcatttgatatatcatttccaaagaatgcaagtcaggtataatttgccatgctagaaacggtatcaactaacaagattgatatttgatggcaanataagaagtatagccttccatactcaagttacgatggtaatcctactgacaaaatgggcgacagaaacaaatgcaaggaggcattggagcctaacctgaaaaggagaaatgaaaaaaatggtcaaagaggaagcaacatcgaataaatggatatgtttaatgaatttacctatgttatgttcccaagtattccattagatcatcatcatgcagcagcaaatcatcaatatctgggattgggctactgatactgatatagtctaaaggtaatcccgcaaaggaactgccagcaaacttatcttgttcgccatagaaagggtaatcaatgagctgcatatctccaggaacagaagtagaattcccactaccaattatttgatcactataaggactgttgtcagctggtgttctgatacccaagggaaccacatgatgctccatgatagatagtggaagtggttgcttaggaggtatggtctggtaactactaggcatattgttaaagcctgaatcagaatcctgtgggaagatatttccagtttttggcctggaattgtcactgctttcataaggtacagcctggcctctcatgcatatgcttacaggagtagcaattgttgcctgcgcattgccatagtgattaaaatcggcaggaagatgggccagttcttgagtatttcctctgtgttgcaaagcttcactcgtattagcttcctcattgaagcttgtaatctggttagccatgccttggatttctacctggtccagtcggttcatatctggaatcatattccttgaatgttctgatgcgtcatcagctctttgtacctcctgctcaattacggtgacactgtggcgtggtctttttctctttggtggttcttttgttcctgccttcttaggaacaacctgattagggcgtttgactttagctctttctctccttgttggggcatgctcctcgctcaactgtgcagccggagaaagatcttgttcatcatctccagatgatgttgaaaggggagcctcctcaaaaccatcaacatcatactcattactgctgctgtgtgtgtccccatttctgtactccagagcaccgtggtgagtaacctctgacatgccattgtcaatgctgagaacaagcctttcctctctctgtagaacacccaaccaaatcaggctctcttttgcagtcatcttatcctgcaagcattttgatttcctaacatggtttctgatcttatcgaagtttggggacatgtgcttgatcacacctgtaagcaccccaaccttccagaccttcttaagatcatgtggctttttatacggaggaatttgccccctcggaaggcccaacgcaatccaccaatcctcgttccctgaaggccaccacgggggtggagtgcccctctccaatgggtacttgcgctgcggtggatcacagtgctgcatcaatgacgaaagcagtgaaccgagagtggcgtcttggagatccatcaagctgtgctggctcttgatcccgctgctcggagcatcagccgacgccaagttctccgactcatactttgcgattgccgccggcccgttcttatcaaacttcaccttctccttccaccaagctctaatattgtcggaagcgccgctcacgggcttccctttatcagggatgatcccgtaaacgaacccgcgcgcgttgcacacctccatcagcttgagcatgtacttgaggatcccgtcctgcgccctcgacatcttcttgcgcatggcctgatcggatatcggcttccccttggacttgtccagctcagcctgctgcagcgcaagggcgagcctgtcctgcctctccttgatcctcctcagcttgatcctgtctttccacatccgccgggccagatcctcggcctcaatctcctcgtcgctgacatcattctccgtcagattctggatgccctccacctcgaagtccgacgaatcccccaactccgtcgcaatgatagccagatgatccatcacaacaccacaaactagggatttcccacaacccgatcacatccaactccactccccccca

SEQ ID NO: 69282 - DNA, 1184 bp, Oryza sativa
aaccaaaaccccatccatccaccccgactcatccaggaacaccgaaacaacgaacagaaatcggaggaatcagcagggcgggcgcgtacttgggcagcagcggatgggattgtgcgcggcgcggcgcgaggcgaatgcgacggcgaaagagagagaagaaatcgctgtgctcccctcctccctcgaatcgaagcgaatcaatctgttcgggggaatggggaattttatttatttttttaattttttttgcccagtggaggtggaaaagattcgcttctcttccgtgtttccctttttttagaaaaaataaaaggggaaagggaaaggaaacacgagggaggctagcgctgaggaggaagggagcaggggtagggaaggaaagaaagaaaggctcgcagatcccatttgctccggtccactctgtgcacagccctgtgttgtctaggactacctccgtctcaaaataagtgcggtcatggaaatctgttttcaacatttgaccgttcgtcttatttgaaaaatttatgaaatttttttaaaaaaatagtcacacataaagtattattcatgttttattatctaatagcaataaaaatagtaatcataaaaaaaattcaaataagacaaacgatcaaacgttggagatgaatagtgtaaaactgcacttattttaggacggagggagtaagttggagttgggaactctcctccaaacatgtaaaacggagctatccattagtaagaattaattatttttttaaaaaaataaatcaatatgatttttaaagaaacttttgtatatttttttatgcaaaatcatgctatttagcaatttggtaagcatgtgtacggaaaacgaggaaagtgagttgggaaagctaattctatataccactttaaatgatgttacacgtaaatgatccagaattactaattttagaaattgtaaagggttacgtacaaaaccttcaaattcaccttctaccaacaaatgaattataagagtctccaatcttgtatgatccgaccgtatgactcgtgaacatagtcggagaggataaaacgaggtgatctagaagcattttttcagtgtggctgcccttggagatgacattatatgcttaatcatctaaccatgctataaacttgttttttttttgcttttgcttttatttctcaaaata

SEQ ID NO: 69283 - DNA, 9881 bp, Oryza sativa
ggatggcgatgcattgagtttgttgctagagtaaatatagtatgagagagttattagcttttcttggtcttggtatacctatgaaatatgcagatagggagtatgttgcaacacacaggttttagctagttttttgaaaaaaaaaatgttggagtgtgtgtcatttcacataaatttcatttatcaagttaatttataatagatgatagctgggttagaatatgtattttttaccaactacttgtcgtaagttacagttaaaatagttaagctgtttagaaagatgcgaagatttgttcgtgattttcaaatatagtggttttctcattgttgttagaatataatatactccctctgtgtcaagataaatcaacttttgtcctaaatctagacattaacgtagagagttaatttatttttttatgggagtatcattttttattacacaaaagacgcacactactcccacatccacgagtgtgtctcctaaaacacgctcaaatttagccgcggccgtagcaccactataacccatttgttgcttcattttgcgtgtaaagggagggttcccaacccttccaaaacaacacagcccgtataactcagccaacccaacagtcacagaaatgtgaaacctcttcctctccacaaaggatcccgatctcaaggggtcagccatgatgcatcaatgttcactggacacccccaagcttgtgtttgtgtacgttccttccttgagtgacttttcctgcttccgtagagccgttttccagcgtcaacccatgctcggaatctcggattctcgctcggctacgaccactccccatcccggagaccgcccgtctcaaccaccccaccctctcatcgattccatcctttctacggcggtggcggcggcggcggcgcgcggcgctgcgaacggtgagcgtcaggcattcgtcgtcttgaccatgaaacttgaaagacctcgtggttgtactctggcagaggcgtcgtcagacgtgtcatcgtcaagtggctataaaaactaacactacttaagtttgaggtcaaatagattcagagccacacgtttcttaaggatcaaggagtttgatttagcaaaacaaaaaataagattaagcaaagttatacaagtaacacaaacttgcagggtatggataagatagtagccctactggtagtattctaggagtactgctggtagcagcttgtttgttcgtgcatggcacctttggtggtttttttttggccatttgctaaggttcactgaaagggcagattcattgaacgtggaccccctcgttaggtgccgaggaagccgtccagattcactgtacccagcagcgggcctctcatgggccttgtccatcaatctgggccgagagccaattcaggccggaacacaacaagagcagtagtagaaaagtaataagttcaggttaggtcccttgaattatcaccgagttcgactttggtcctcgaaccacaataccacgtacaacaacgagggggcagtccctcaacttgcaaaacctgtacccgagattctaaacagtatagtgtccagttttaactaacatgactaggtgggtctcacatgtcaggcatatttctcgtcctctccaacctcctgccattgctaactaaaattataaatctctcctttttagttttagtagagttgttggtattttttggatgtatccatcctaatcaacaagcaggaggtctcttctctgatttaatttgctagcccatcagatatggggtgcttcgcgttcaagagcggcaacaggagcaaaggccaagaacgcgcggacgccggtggcggcggccgcgtcgtcctcgcgcgccgtcaagcgccttaaccagcgcagcctgcaggtcagtatggttttgcatttactcctctcaaaaaattgccatggtgcttttgatttgagctagatttgtcaaaaccataccgaatttgttcatcagaatgatcgaattacaggcgatacttcggcaaaaaatgaacttgcagattttgtcttttgagcctgtgcactgaccacatgtctgcatattttcagagtaccaaaaagaaataggcctaatatgtggggctcactcgtcacataagctaaaaccaagcattatactgtttgggatctcggctacaacagttttataagttgagagacacgttatatctggcattgtgtttgggggatgaaattcgaactcaacaactagataaaggacgtaaagtgaacttattccagtggaaaacgagatgaaacaaagagacgagaatttgttttattttcctccagatcgacgaacaaacaaccgaaacgaattccaattggtaaatcaaatagctcaagcaacaatgagctttatcccctccccctcactcaacaatggcaacggtggtcaagcatgtacagtacatcaattcaccaatcactctgaaactgaaaatcgcacagagagctagcttagcttagctagaaccattagctcactcagtacttcttccgcttgaggaagttggcgatccagtagctggactgcttgtggtagcgcttgagattgttgaggcggtcgatgtagatgaggccgaatcggtcgaggtatccgtcgccccactcgaagcagtccatgaacgtccaggtgaagtagcccttcacgttcaccccgttcttgatggcgtggttgacgaactgcaggtgtttcgagtggaactcgatcctatgcccgtccttgagcgcctccgtgattggcaagctcttgttgttcccctcggcgattcctgcaatcacacatgaaagtcatcttgcaggatgtcgatcccctcgttttttttttcatttccatgttatccaaatagttgtgaaaaagttttggagaaaaaaaatgagaatgtagttcaaatgtatcagcccacaaaacatgcaacttcaagttcaaattaatctatataaagagtgtactacttatctatactcctttaaaagaccctaatgataatggtgagtggtgaatctgccaccacccaccaccactaccatatgggtcccctaaatactgagataggtggacttttatcccttccttggccagaagccatcaaacaaggaaaacttattttaaagtgagatacaaaattatgaaaaacataatgtggaatgatttataatggggataattttattttaatatttgtggttttaaagccgtatattaattcctgttgcaatgcacaagcattcagctagtatatcaaaaagaagttaaagccattacaatgagaaagttatttaattgggaagtgcggcggtataaatcctaatgctcatgaatattatgcatacatgagtacattttcaataggaatttagtggagcttaggataagctattagtccctgtctatttgagcgtatgctagaagtgtgcgtactcgtgggtgagtgtagtgcacgtatttatctcgtgtgtaatgaaaacaaagatggttatttaattaccattttctgtgacgtagatgatcgggttgttgtacctcctcttggtgtagaggagtagctcgcggagacccggagggtagttgaagaagatcggggtgaactcctgccaaaatgttggaagaaattaatcagccgtggattgatggattgatcgatcggtctcaagaaaatcaagaacatgatgttgtgttcatgcgttggtgttgaggaggagtcgatctatgtacgtacctgcggaccaatgggtttgccgttgcggaagccagtggtgttggcgcggatgtcggtgtcgtaggagagcctgtttgagctgggcagcggcacgctcttggcgtagtaggtggtgtagtagttgacgccgatgaagtcataggatcccctcaccgctgccgcctgctccgccgtgaacgccggcagccgcgccccgagccaccccctcatcgtgcctgggtagtcgccgtgcacgatggggtccaggaaccatccgtacatgaagtcgaggctgcgttgcacaacgcggcggtcagcggccgtgtcattatacggcacgaaccagtgcgacaccgccgtgatgccgatctgcccgtgctgcgtgggttggtacttggtgcggtagaggtggacggcggtggcatgggcgaggatgacgtggtgcgctgctaggtaaggctcgcggctggagtcgccgccggcacaggaggtggagacgtagggggagcaccggcccaaggcgtggatgccggtgccgtagccctgggagcagtaggtccatggctcgttgaaggtggcccagaacttgacacggtcgccgaactcccggaagcacacttcggcgaagtccacataatccttgctgaaaatattgacaatccaaatctctaatatgagtatttttttaagataatggtaatggtttacatctccggtgtctttcgacaggcacacagccaaatttgcataatcgacaaattttaatgtgagtcattgatgaattctagccaaatttgcagaaccgacaagcaatttattttgattcagatgaccaaattacctaccctgttctatctaactggtttttcttttgaaacttaggtgaatggcctaactttaatcaacctcatcatcagcttaacaagttgagtgattttaacaggtttatggattttctttgtctctatctaaaaaacttacatgatattctcactcaggaatcctccgtatttgctctcaagggcctgtggtgtgtcccagtggaagattgtgacaaatggcttcatccctgttatgaaaattttgtaattaattcaaagtttactacttaaaaataccaaaaaaatatttataattttgtagtaacagtaacacatgattgtaaataggacataactgaaaaaatttactcacctttggctatgatttcattgatcaggttgttatagaaagctactccttccttgttcacccctccactcaatgttccatctgcattcaacaggcatttacaaaggaaaatttcacggtcaaaaaactgaaatgcaactgaatgcgctgatacgatctaggaaatataatgcccattctcaaatacttcctctgatcataattatttgacgttctggacagccatatactaagttcaagtcatcttaactgtctaaaacgtcaactaattcagtccggagatggtagaattaacttcactcacttggcaggatccggctccaagaaatggaaaaccggaaggcgtccatgttcatgtctttgagaaggtttacatcctcctgcattttcaaggttcaacaaaagaaatgaatgatcagttcaagaagattcctgtccaagataaactttttattcggtccatcaagtcatgaaaacatttattttttgacatacaacaagtcaaagattaaaaccttgagttaatatctttttaaataattagactgacacatggaaatcatatgggtaaaatctcatagtaaaatcaggtttttataatgtgctcacttcggtcaaatttatttgacgttgggagaactgagtttagttcttccaatgtcaaatattttttttactagaggctggagtatactataacaaaaattagtcattaaaattgcattccaaagactgcgattttttggggaaattactgtagaaaaggcttctacagtgtgtaaatatatattccaaagactgcgttaataccgaacaatgtgtttccttgaatgcatttcaagagcaagaactcctgctttacttaaaagaaaaactagaatctaccttgtagcgatgatagaagtcatctgccacatcgccggtgtcaccatttaagatttttcctgcaggcatgaaaatagtttcccttaatcacctattttaaattttacatgccagctatatatataatagtgggaggttaacacttaataataataataacctgggatgtgcgagaaagtgtcccacacgctaggacgctaggacccctacctccttccttagcagctccctcatactgcaagtaattaagcaatgcaaggatacatctctgaatttgttcaggaactaaccaagaaccatgtgcattgcacttgattcaaaccattcttgcagatgtaagagttttggacaaatttatctctgtatggatcacctgatacgctgcagagccggtgccgaagatgaaatccttggggaagctgtacctgttgaacgatgcatcaacaccgctgcagagtacagcaacgaaaacaagaacaggaacaatctgccttcccattccgattccgagccaggccatctcgaaactggaactgatcaagccaagcagcttagctgggcagtggctctgcaggaagcataattcagaagggtatttatagagaagagttggcgatgcagataaacggatcagatcataggccagcagatgtgttggcgttgcttccctgattggcaattctcactattccgagatcgagttcctcaagactttcgagaagagatatcgtattatatttgattttaaccggttgaatttgtcatctacagtagcaagaagacgttgaaattgatttgtttagttcagcatgaggggcacgagagggcaactgctcaaggcttgagacatgtaagtacagtttttttttatatatatagaatgtatatatgatagcggctgatttcgttctcattcttctgaagaggacgcaccacctataatttttagttaaagtattttgtgattggtacgaatggtgtataaatatataatgtacgttgcaataaaaggaatagttgctataacgacttacgcacgacgatcgcctagttgctataactggaaatgtattttcaacaccgcaattaattctcttcacatgtaatggcgtgccgctggttacaactgacctctgtacttgtaaacctcttcaaatggcaatggaaatttagttgggaaacctctcccctctggtctctggtgattattaaaaaaaaatagttgtattgattataatataagtacacactatacttatattataatcaatacaactattcctttttttatatctcacttggatactaataatatacctcctatgtggattaagggagagacatttgatccttacacgtaaggtaatgatataaaaccgacatcacagtcgtcatctatatacaaacatggaaaacactataagatcaagattcattctagataagtcatttaaaggcacgatatttttgataaattttcatgaggtggatttattgcgcgcatgttcgcgctcgaaatcgctaatagacgatcagtcgcgcggggcgtgcgactggacacgtgtcatgcgtggagaggggggcgtgggcggcgtgcagtttctttccttttttttttgtttttttcgcacggtttctaggcggcacgcggtttcttttttttttctctttttatacgcgcggtttctttttttttttttcttttcttctttcagtatcgttactttttttttggcgcatggctttttttctgtttttttttctttccgtatttttttgtttttcggtttttttaatacaaacatatacaaattttgtatatgcgtatataaattttgtatacgtatacaaaatttgtatacgtgtatataaacttcgtatatgtgtacttttttatatatagatgtacaaactttgtatatatatacgtatataaagttggtatattttgtatgcatacatatataaactttatatacatcgtatacaaactttgtatatgccatatacatacattatacatgtgtatatacatattagaatatctacttatatatactacttaaaaagtttaagatgtttccttcctctgttaataaattttttttaaaaaagtccgattgtaattaaaaaaagcccggggcgaaaaaaaaagtgcggcaaaaaaaaactgaccgattcctatccttacttaaaaaagcggaacaaaaaggtgcggcaaaaaacgattgtaaaaaggaagcccggcacggccaaaaaaaaaatttgtccgtttcctttttttttccttttccaattttattttattttcaccgcttttttctttcaccgtttttccgggctttttcgtccgttttctttttttttcgttttattttctttgcgccgttttttctttcaccgtttttctggtttcgctattttttttctgtttttccattgggccgaatcctagcgccgccaccatatcgatttgcatttttatgtgtttcctcatccaattgattgcaaaaaccgattctccactactctcttatcattttccccttgaatttctcttccagttcgtcattttttttccaagttttacggattgctttgattttggtaaaaaacgaaaaagggaatcgagtggatcaaaatctctcaacaattttggagatcgagaaagattcgaccgcatttgacggagaggatcgactccaccatcgtacagacacggtactatgcgagctcgaccagattaccggatttgatgggtggatcggctccgtcatggtacgggcacgagttgacggagaggatcgaatccaccatcgtacggacacggtactatgcgagctgaccagattactggatttgatgggtggattggctccgtcatggcacgggcatgagactgttcgagctaggcctacagttgcacttgtgggctaagccgaagagaggtaggccaggcacaggactgttcgagctagggctacagctccacttgtgggctgagccgaagagagataggccgagcatatagatgtagtggactactctaggactagagctgaaaaggaaggaaggaatgaatgtccggtccaaaaacaaagaagcatccggtccaaaaccaagggagtataatgtatcggcttgtttggtaactcaagggaaggggattgggagtttacacgagggaattgatgatgagattaagatgggaatttgatttttaatctcaatatcttgtttggtagaggtgatggaaattgatagggagtttagttggagattagttcattaataaaaacggatggctgagattcgcttagacaaactaaaggaggaattcccttccaattaccttcccctacccaggtattgaaaaggagggagttccttactcaattccccatcccaccaaaattctcatatctcccaaccaaataaaacacttaatagcctcatccctctaaactctcaatccctcataaaaactccttccaactaaacgagccatataggataaaaaaatgtttttacccgtagcaacgcacggatattttttcgtgtgtgtgtctatatatatatatatatatacacacacacatatgtataaactttatatataaagtttaggaaaaagtacgatttaccccccaaactattgcgacagtacgaattatccccccgaaccacaaaaccggttatattacacctcaaaactattgataccggctgaattaccccctgactcaatactgagcggttttgctcctacatggcatacacgtggcgtcgacgtggaaatccaatcagtaaaaaaaaagaaaatatagggcccacctatcattactctcactgtctctccctcttctcctttggacggcgacggccgaggcagcaagcgcacgcggagtcagcagcggcgaggcgaggcaaggcggcggcggtggagagcggcgggggcggaggagaggctagcgcggtgggggcggtggagaggcgagcgcggcggtggcgaggcagggcgggcgcggcggagaggcgagccgagcggcaggggcggaggaggcgaggcggcgga

SEQ ID NO: 69284 - DNA, 4539 bp, Oryza sativa
aaacaagaccacacatggataaattccgacgaaaaaatagcttattattgaattatttttaaatgttgcatgatgttccaccaggtatatcggaattgtttcactaactagatcgaaatgtttcactcgtttaaattgagtgttgtttcaccttatataaaaataatgtttcaacaaatagcgaaagaatatttcagttcactgcaacattaaatctatacatagtgaaacattgtgagtacattaggtgaaatattttttggtggaacaaaaaataaaccaaattcccttaatagggggtttccaaaatatgtgggttttttgttgcaatggaatgtctcgttcactgcaacattagatctatacatagtgaaacattgtgagtacactaggtgaaacatctttcggtggaacaacaaataaaccaaattcccttgatagagggtttacaaaatatgtggattttttgttacaatagattatttcagttcactgcaacattagatctatacatagtgaaacattataagtacacttggtgaaacatcttttgtgtaacaaagggagggataagtgggtgggtccagatggggagaagggagcgcgcgcatgggggagggggagcgaccgatttttcccacctcccccggtcgcccgattttaatcaatttccctttttctttagcttgcatatcttttcaaattcacttatgtgcccgctgcaactcacgtggtatcacctactatccaaagcaaactctaaccgaatgaggaatcgaatcaatcctaacctagtcacgacaggaacaaccaacgtacgtaggctggagtttctcagatctatcaagaacactgtacgttgcgtggcattggtacgataaagcagcgattctaacaacaattgactgttctgcaataatcgattcatgattatactagatcgcaatatcttcctcctgttttgttttcaattatccggcccccagcttgtaagatatcagcagacagcaagttcagcacactgcacaccgacgccgacaccacattagggaatgcaggaacacatgggtttactggcgtgcagcaaactgaaacgcggctcatcgctcaccccttccatcgatctgtcggcgcaaacccacattaaacttacccagttacattgctggggaagagagctttactcccggttagtaatctttcagggaaccggaacatctaatcatggactaaagatgcatagcaagtcagaaaaatctgtgggtgtgggatttaaactcaagatttctcacctcattccttacgcacgttaccatcccacctactacacatatttgactttgatagagatgatttttttaaactaaccttggaaacgtttttagtctagattggtgacaccaattgggactaaaaatatatttagtccgactaaatattaatttttaaactaaccctggagacatcttcagtctgggttggtaacaccaattgggactaaaaatatctttagtttgacaccaaccagaactaaagatcaatatttagtccgtgttaatgcatctttagtccggaatagtaacaccaaccgggattaaagatcattaggggcctgacaaggcctaacagctattgatctgtggctaaaagtgatttttagtcccaattggtattgccattgggcttttgaattggggctaaagatattctttagtacggatccaattagaaccgggacaaatgtggtttttgccatccgagtaaagatcagtttttcattaatgttagttcttccctccatttcatattataagttattttaacttttttaaagctaaattttaggtttatcaaacttataggaaaatctgacatctacaatataatatgaaattattttattaaaaataattaaatatattttaataatatgtttgtttagtgttagaaatgttgctatatttttctatatatttaattatttcttttaaaaaaataataattttttcctgaatttttcattgataggtgaaaatatgggagttacagagcctgaggaacggtagcatcgtgcctttacattgatttagagttagtagggctagagaaagcttgtttgcaagcagagatcacaaagcgttccgagttcttaattctttccgcctagatggttgcttcatccatgcagcggcgaagcagtcggtgaaggcacgggggttcattcctgaagacaatatcgtgtcggtgatcagaacaaattcaaagaaacttataatacaaaatagatagtaacacgttatgtactttccccatcccataaaaataaacatgattcatagtacaaactacaaagagtactccactccctccatactcgtaaaggaagtcgtttaggacaatgtttaagtcaaatcttgaaaatataaatcatgaataactctctagttgttgggtttaaaaatatttgttgggtttaaaaatataaaaattatatgaatagatttgtcttgaaaaatactttcataaaacaagaagtcaaaattgtattttgaagactgtgtcgccgtgctaaacgacttcctttatgagtacggagggagtatatcgttatctcgttctcgatttaagcctgtttagttggcaaaagaatttatccctacatgtcacatcagatatacggacacacatttaaagtattaaacgtagtctaataacaaaataaaattacagattccgacaggaaaccgcgagacgaatttattaagcctaattaatctaccattagcaaatgtttactgtagcaccataatatcaaatcatggtgtaattaggcttaaaaaatttgtctcgtaatttcctggcgaattgtgtaattaatctttttttctacatttaatactttatttatgtgtccaaacattcaatgtgacggcgtaaaataatttggtttaagaactaaacagacccttattttttaggcaaaatttgctataggacatccaaaaaaacgtgtaattagccagtggacaccgtaagatcacgaatttactgtagggcaccaccaaaaagtgataattagctagtagacactcaagacattattttattatttttaaaggaaaagaggtgagagaatttttgaattgccgagaatgccctggtggcgcatcacgttatcccgactaggtccggtcgagccgacccggctgcaatacagctgcgcccacgccctccttgccgccggcgcgtcgtgaacaccatcacccgctcctcgtctcagcgcgcggaggtcgtcgctgccggcgtgggagagatcgatgtcgtagcccaagaaccgcgccgacgcccacctcggcatcccggtgctcccgtccatatggccggcctcggaacaggctaccatgctccagttgcacgggccgccgtcactgacgccgaaaccagcgttccagtcagcgaggacgttggccgtgtcatgcggtgctgccttgacggccagcaacgcctccgctgcaaggcgcacgcgaatgcagcaagaaaaaccgggtgagtgcagcaagaagtgaaaattttcatttgcaaatttgaaatatatcaagaaaagattgatatatttggaagaacttttatcatcatgattcaagcaagaaagaatggtatgagctaagaaaccaatcaaagatgaaacaagatgagaagacacggcttgcgatcaaagaatttttttattttctttttttcgtgttcagcaccttcgccggcggcggctggggaagaaagaacctccggcggcgtgggcgccacaccggcagaggacaagtcggacaccacgaggctcaaaaccagcacggcgagcaagtaagcagcagaagcagcaactctctgctcgtccatggcgtcagcgtcggcgtcatgcgtgctctcgttcgtcggtgactcggtgtcgtcgcgtccacgccgagagagcgctatagcccaaagcgaaccgctcgtgcgatgcgaggagaaaaaggagacgagacgctcgcgatcgaacactacccgctactggacgcgacatgaagcggaagcgagagctacaaccgcagtgacgatggcgagacgcggttgacgccatcgcgggctggccacttgtcgcgccgccgctctggccacgccgctcggcaagaccgactgggtctggttcgaccggaccgatcgggataacgtggtgcgccaccgggggcattctcggcaattcaaaaattctctcatctcttttcctctaaaaataataaaataatggtctaagtgtctaccagctaattaccactttttgatggtgccctatagcaaattcgcaatcttacggtgtccaacatgctaattacacgttttttagatgctctgtagtaaattttgcctattttttacgtcactgataaagttggttgtaggtacgcaggaggcaggccgaccaacgccgagggacgtgacccgatcgacggggcccgggggctcacgggcgacgcgcgtgatgccacgcgccgaggccgcccc

SEQ ID NO: 69285 - DNA, 17220 bp, Oryza sativa
  unsure (1)..(17220): unsure at all n locations
cccccccccggggcgcccccgcggtctctttccacgcgcgagcatgtcacggcccacgcgccgcgcgcttccttttccccaccacgcggaacacgcggccgggccggcgcgtctcgtcggtctcgatcggtgtccgatggaggtggagcccctgcaggctgcacagcgcgcgcgagaggcgaagcgatcgagcatggacgcggcgcacaacgcctcgccgcctcgcgccgcgtcgcgcgtttccgtatacggtacacgcatgcgcgaggtgcgcgcggcggtgtagttggtgccgtaggcgaaggcgattggcacgggcccggccggtggtgcacttgtcgccgcgcgcgcgagagcgaacaacttgttggcgcgcagagccaaaaccgccggaccggagaacgtctgcaactttccgttggcacacatggcatgcagcaaaggcaagcagcgcggcactcatcggtcatcgctcgtcagtggcttttttttccctcgattgagatatagattttacatcggtttttggtttaacacgtttttttaaatggttaaacggtgtgtttcgtgcaaaaactttttatataaaaattacttagaatatcaaataaatttattttttaagtttataataattaaaaaccaaaattggataagacacatttaaatccaacgaatctagatagacatacttatgatcagattctttgaaataggatgtatgtcctgtgcagtgctagattgctatattttaaaatggatggagtaattaactatggatgtgtttggagtatggatgtgtttggaggagatagttgtggctgcacagcgcaacagctacaaattgtgcagtaaattttatgctacttgtattgttaatacagctggctcagcccaacatctgtaatatacagcacaaacgaacacacctatatgttaaatggttttttctattttacttgctctaaccttattatcttttatcttcgttaggaaaaaaaaaaacatcaccgtagttgtgtgagatatcgagtattctgtttagctagcagagtatatagcatcaattattcaaagatgattggaggagggttcagttgatctcatcaatgacgatattaattaagcctgaaccagcccaacactgctcgacagggagcattattgtttcttcttattattgtccggctcaatgggatcagccagcaatgatgcacaggtactgaggtacacattcaatagtaatgcagcataattcatcacgccatcatatcggtcatcaccactgatgcacaaatcacaaattaaccagctgaaagctagactgacgaaacacaaatctggtggccagccgatcgatctcgtgatcaatccgaaattttgtggggctggatcagtgcctcttgaggaagtcttcgatccagtagctggactccttgcggtagcgcttgagcgtcttgcggtcgacgtagatgaggccgaacctgtcaaggtagccgtcaccccactcaaagcagtccatgaatgtccacgtgaagtagcccttcacgttcaccccattcttgatggcgtggttgacgaactgcaggtgctttgagtggaactcgatcctgtgtccatccttgagcgcctctggcagtgtgctgttgttaccctcatcgatgcctgtacacattgcacacaaattttacgcctttcgatgttcgcgaacgatttagtatatatacatgttaattgagttaattgaggatatggttcttttcgatcaacctatatttaagtttaattttggatgaattttgtaggaccagtgttgaaagattatatgttcttaccgttttctgtaacatagatggtcgggttgttgtatctcctcttggtgtagaggaggagctcacggagacctggagggtagttgaagaagatcggtgtaaattcctagacatgacaaggattcgcgtacgttgaattcctcagtaaaatggatggatcgatgtgggtatatgtgtacacgtagtcacgtacgcacctgtggaccgatgggtttgccattacggaagccggtggtgttggcgcggttgtcgaggtcgtaggatagctcgttggagttaggcggcggtatactcttagcgtagtaggtggtgtagtaattaactccgatgaagtcgtaggagcccttcaccatcgccgactgttcaggcgtgaactctggcagccgattgccgagccaacctctcatggtgcctgggtagtcaccatgcacgatagggtccatgaaccacccatagatgaagtctaggctccgttgcacagcgccacggtcagcgtcggagttgtcgtacggcacgaaccagtgggtgaccaccaccatgccgatctgtcccttctgtgttggctggtacttggtgcggtaaagctggacagcggcagcgtgggagaggtggatgtggtgtgccacgaggtagggctcgcgactggagtcaccgacgccgcatgacttggaaacatatgaagagcatcgtcccggcgcaaacacgcccttgccgtagccgtaggcgctatatgtgaatggctcattaaatgtggtccagtacttgacacggtcgccgaactcgcgaaagcacacctccgcgaagtccacgtattctttcctgcacatgttgagcaagggtgttttaaagtggtattttctaatattaaaatcaattgaaagatagtttatatttttctaatataatgggtcatatctatttataatattatctctaatgatggtataataataatattacctatttataatatcatctcaactattgatatataataataatattttctattagtattagaactaaatgaaaatcaacggttgagatcacttgtattggtggtgataatactgatagtaagaatagtaaaatactatcagtagatactatcatccttgagaatgtatcgtgaggtgctatattttctagcgtaaaatttggtatctcaaggtattttcttaaggaccataaaatttctctaaatagtattgtaaaatcactcgggaattaaaggttttttctcgagagattgcaagaatgtttgtgaaagtacagtaagcaagaaagaacttacactatgtcttcactgaggaatcctccgtatttgctttccagagccaagggggtgtcccagtggaagatagtgacaaatgggatcatccctatgtgatacagaaatgttgtcaaaattagttcatatttttttgcgtttttggaataaaagttagtgatcaccttttgctatgacatcattgatcaagctgttgtagaaagcaaccccttctttgtttattcctccactcaaggatccatctgcagtaattacaatttgcacgcagtggctatgtgattaacatcaagctttggaactcacatgtctgcgtttatattgtgtttcgcaaaacaaaaaaaaaaaggggagaaaattttgagactcacttggcaggatcctggtccacgcaatggagaaccggaaagcatccatgttcatgtccttcaggaggctcacatcctcctgaaatttgatcggatttgtcaaaacatgacccgtttcagagaattcagacactcgatgttaatcatcgtcagtcagtcaaaatggaaggtcaccttgtatcggtgatagaagtcatttgccacatcgccgttatcattgtttaaaattttacctgcagtcatatggattgttaatttctgtctgtcagataaaccggaagaattaattacaagctttgtgatgcacttcctcacgaattaacctggaatgtgagtgaagttgtcccagacgctaggacctttgcccccttctttgtaggcgccctcatactgcaagtaatcaaaaccaatcccaggataaactgatgagtatccagctacaaattacatcactatataacataaacatggctagttgagcagtgacacaactgatattgagcttcagaattccaacatgtcatatgtacctgataagctgctgaacctgtgccgaagatgaagtccttggggaagctgtaccgggtaaacttggcgtaaacgccattgcagaacagagctcccaagaacaaggtgaagaggagtcgccttcccattctgatccccattccagcgagagatggggttcagaatgagctagctgaattgcctccagtagctgcagctctaacgggtatttatagagtgatgaacgggaggggtagtagtggagtactcccgatgtttaggacagcgacacggtcttcaaaacacaactttaactctttatttctataaaaatatttattgaaaagtgatatatgtatacttttatgaaagtatttttcaagacaaatacattcatataatttttacattttcaaactcaagaaattaagagctatttatgatttatattttcaaggtttgacttaaacattatactaaacgactcctttagtatggagggagtactaaggaccatactgcgtgctggcaggagacactccatcaattcagtgtagtgttttctctgcagacatggtaagctggcgtaattaggatctcacttcatcacaatagcgatcgatgaggaagaagatggaacaggcgctgccgaaatccacacgaggaattgtttattaaacacatgaggcgcgtgctaacatgtctctatctaatataaattctactgaataatgcaataagggcatgaacttacaaaatgctccctttttttctcaaaacacaattcaaacatagaagcatatacatcagaccgacatgtattgagattgacgaaatcaccatggtcatatcattatcgatgtgtgtgtcgcctaccactatgacttgaacccgagttgactggttccaaaaaaaaaagtctaataagttaaactacacttaatttgtggtgcgtgtaaaccaagaccatacaacacatctaggatgggaatggggcttgtttcccgattctccacgggaaattctccattagagatgaggatgaaagaatggagatggttacgagtaatcaaatggaggaaaacacgtccgtgttgggtctggcggtggcgggacggggatgatcctccatccccccgttcctgtggagatacaattaacaggcataggagtctaaatccaatgcaaatcctatatatctataaagttcatcccactaaatatagttaatgatatttctcttttctctcgttaagtcacatggtctcaattatttctaattcttaaatgattgatctacggtttaaattatctctatttttttaaaaaacaaaaacaatgaaattgttgacggcaatgctctagagttagtacataggtgatgtataggtgatgtattgtacatgctaagtaggtggataaattaaatggtagaatattgtaattgtttaatatgacgagataagttgagcagctatattttaaggcaaagttaaatactagaagtagttatattttcaaacacggaaagagtagtactatatatatttcctacttactcggttttaaatataactagaattcaaaaattattttacaatataatgatttattcatctattctcacattttagttgatcagaaccatattttatttaatttcttcttatactttgttttgaattttttcccatttaattctacatattctcttaatatctatgactaatttcgaaggttgttatattttaaaacagaataagtaggattgtagtataatttgattcagtattactttgttacaattctcaatacctttgcaccagaaaaacactttaatttattttatcgattactgaaaatacctcaaatcaaacgatacatttttttctttcaattaaacggtagcatagccgtgcacaatcacgtggaaattagcacttaagaggagccaacgtttgctctcaaggactaaaaactaccacgtgaattgggaaagaaaaaaaaagatagaaaatttctgcactgttatctgaaatttaagcttagcacctagcagaagacatgatattcgtatttatctattacatcactaaaacaaaggctaaaatgagccccatgtttatactcaggaagctgtcaattacgaccttatttaaatggttcctatatatttgcgctgctgactttatccagttagtttgtaattttgaccactatttgctttactaggatataatgataatatcttaaaaagtaatatacctaaacgatttttatgctttcaaactaaatatattattagaaagcttcaaagttttaagagtttaaccgaataaaaataaattatatatttaacaacggagggagtgctgtagtcaccaaaaatctaaactgttaattgtgtatagcagtataagttgtattagagtattgttataaccgtattataaacccaaatgtgttttaataataaaaaatataggactgtctatcaaacataattgtattgatctctattgctcgataaacatcgtggtcgaaaatttattatctattgccagataaacatcaagtcggatttgtattgatctcttaattgtcccctggaagaatgccctctacctaatccggttgtccatcagaaactgatactctgaactcatatttgtcgaaaccatcgatcgttagcgtattttcggcaataattaattggctagctcattgcaacgtggaaactgtaaagtaccaatgcagtaactgttgcactgaaatataagggatatttgatttggatatcatagaggtggaggttcagatgtgcacttcagagaccgactgatgtatatatgcaactacggaattacttttttttttaagagaagggttttttttttacccggtctttatatccaaccggatatatgcagtatttttttagcatttttttaaaatatgaacttagcctatagaacagggaactagccctcaaataacccaatctaaaattcgctcctatggagatttgaactcaggaccttagggtgctactcaggtcactgcaaccactaggctacatgcactttcacactacgaaattacttaagggttaaggcaccactaggctacatgcactttcacactacgaaattacttaagggttaagctgtgtttgttccaagtacaagcatgagaaaaacccgtcgtttttaacacgtgtgttgagttgtgatttgaattcatttacacataataaaagacagcttctgccggagcaaagcggaggcccgtagatgcccgatgtgttctttacaaaaaaaatcctatataaaaattgttttaaaaatcatattgattatttttaaatttaaaataattcatactaagttattaatcatatgttaattatccacctcattttacctatcttaatcttcttctttcccctccgttcaaactaatctatctaaaatatatcgaatgttgtataactacacactacatgcaaaggaccacaaattgcatttctgttcaacatactacgtttttttccctaaaaaagagaaggggaccaaattgttttgcttttagagcctgctggttttgtaagttgcattaatcctgatttttggagttcattttataattgttgcatgtttttttagtcgttttcatcgctcggtcttgacttttggatcactattaacgaccaaatttggcaatatcagcatcggaaaaggagattagatcaaggtggagtcgaaggcgaagattgatccgagaatagagcaagaatcggctgaagtccagatcggctacgattaagatcggctgggtctaagtcggactaagtgagccgatgtagccgattctaacagtataatttggtgtttgacattgggttgaattgaggtgcttcaagatgattgccgcacatggatagagtcttgagaaggcaattgtatctattaattaggatgttttatgtaacttccttagagatatgtttgggcaaaagtctgccgcaaagacttatggtatcttagagtttgttagagatagtggtcgtgtccggtatggacatatcttataattctcgggtataaatagaccccgagccctatgtaattttgaacacacacgttcaatacaatctcggcgcatcgccacctttttgctttagttttgtttcgacgagttcttgctttcgggttgagctgcatcggtttcgatcttcaacaagaggtaaaacttgttatgacgacttgtgttctcgtgattagcgcttccatctttatgacactctaatcttgtctatataattcgtcaagttatcatatatcttacataatccttggcaatatcgtcatctaatctataatcggctaacatctgttaatagaaggcagccgattaggttaaatagcgacgttgtcctagatcatataagatatctaccactttatgaaacgcccaacggcttgattgtctaaatattgttcttcttttcatacttaatgctgcatcagttgagtttgatctattaagtcgtgcttagaatatcaatctctagcctgttctctggttgccgattagggtagtatcggagtttcagccgatcttatctgatttaaccatattcgatctatatgcttcaatgacatgttaaatccgccctttatgtcaggatcttattgcatttaagtatattaagcttttgtttggtatattatatttgttttgatatctttatataaagtagtatcggagtattagccgatacatgctagatctatctgatcggctatgctataaacatatataatcctgttattaatatatatttcgatctaagtgatttatactgtctcggcatggtgaccgatccatcccaatcacttgatttaagtatatattaatataagaactatatatcgttaatatctacagccgatcgaatagatttagctccttactatctatttataaccgccgatcgattcatatatgacatcggcttaaagataaatgatatgccatcagcacctagccgatcggctatcatttatagatttaaccacgaattctttgtctctatttcttgttgattacaggatcaaatcaactggcacgctcgtacatttgaaggcgagctttggacctacactggagttaagcagatctcccaggcctcatgttttctgtcaacaatcacctataatataagtgtactagtactaacccaaaattaattnttattgcatcgatcatgtatcttccgtgtataagcaatggtcatgaggaattcctatcaaatgggcctaatttctcccttccaaaagtcaactcaagtacagaatattttttgaatagctaagtactactacatcacttatatttaatgaatcacttatattaatttgatggtctctaccatgattatattcctttgatcattctttaaccttgctctgattgctttgatgccttgacttcagattctaagaacctaaccaaatccagccattgactaatttaggagcaaaacagcataaactctagtgatcaaagatgactagatgaggacctcaaatgacgtataaactctagtgcctggatggttgattttcggcccgaaaccaatgtaatcttccgggtttattgagcccaactacgaaaattctactgccttctttttaaagtatatatgacgctatttttcgtataacatttaaccatttattttatgtaaaaatttaatataaatatataaaagaataagttaaaattatattttatttaaagataaaacaaatcacaacaaaataaatgatgcttattttcttgtaagatgcatgataaaacgttatgtcaaaaaatcaacgataccgcacatttaaaatggaaggagtaatacagtattttctccgcacgagtactatctcgatcctgcctcccagtccctagcattgatccgctcaaccagtctctgttcatcgtcaatgtccttggctagtgctctttcggcgtcgatccgcgcggccagtcaatggcgagcaagagccagcaaacaattcatcttcctcaaggaggtcaagaattccctctttcccctccgattatctccctctgttaccgttcaaacaaccttgcaagcagataggaaaacatgtgtaatggttttacaggggaaaagaaatacaaatttcccaagcaaggctcttagtattaagcagtaaccatgcgctgtcacaccatcctattacctccatcccataattaaaaggattttgtgtgtgtatctcacacatggaccctatgatttttattatttttcagattgaattgccacataagcatcacattaatgacacgtgggataaagactttcaaaggagccacttcaaccaaaaccagagaaaatattataaatctcgtttgcactgattttataagtttgaggatacgttgtatctggttatgtggtctcgggatgcatttcggactcaacaaaaaatgggggacctagtgaacttgttcttattgagtaggaataagttcatctgaggtcccttaattttacgcaaatccgattttcatccttaaaccctaaaaccagatataaccggtccctaaactatcaaaaccggtgtaaatgagatccctcggcggttttgaaggcggttttggctgacgtggcgtctacgtggctggtggctggtttgactaggtctccgtcccacatgatattgacgtggcgcttacgtggcaattatatctaaaaaaataataaaaaccatgggcccacctgtcagctaaaaataataattttaaaatagcgtggcccacgtgggccccacatgtcattccctctcccctctcagctctccctcttcctcatcaagccatctcctcgcgccgcggcaccgcctcacagccggcaggagcatgccgacgaagcggagaagcggcggcggcggcggcggcaggccgcggggtcggtgcctactcccgcgccgccacatcatgttagatgctgcacagcggtgaggaggagaggcggagttcgagctcagtacagcgaggattagtgtacagatcgagctaaacagccaacaggattagtggcaggcaccaacaagcagttgctgctgctgctgctcgagacatgcatgagctcgtgttcactacagtgaggccggccatctgcaagactgcaaccatgtcagatttggcacggagacgaaaaacacacatgttagtgacccaagttgttgtcgtcgtccatgctcgccaaggccgccgccattgccgccggtgtcaatgactgcccgactgaccgtctgtcttcaactcgttcttctcgttggcagagagagaagctgggagagagggggacagaggaggaggtacagccgcatcacctcgctgatggtcgcgtgcagccgtgcaggtagtgcatccgcttcagctcgtcgtatccgtcgcagtcgccgtcttctccggcgtcggcgcggcgagcgtccgcgtgccgcgacacctcctcgtgcacgcgacgctcgcagcgcgggttcgcggcgaggagccacaagagccacgtcagcgcgggtgctcgtgctcgtcctccccgcgacggaggcgctcctccgacgccacgtcggcgggagaggagggagcggcgcgcggagatgtcggcggtagaggagggagcggcccctcctcacctgcttcctctccaacctcctcatcatccccggccgccgcctcctcccttcctagttcctccgggctccggccccctcatcttgagcctcgtcctcctgctcttcccttcgccggacgccgtcgacctcgcttcctggtgccgatacacgcctccgcccgcgcgagccaacccgacgctgctactcctcgatgggacatggaagcatgccaaggagatgcaggccgccagcctcccgttttgtcctccttcgtctcgtccggtcattgctcgtctactgcgatgtcggcgccggcggggtcgaggtggtggaggatgacgacggtggtggaggcgggttgcggcggagggcgtgcgctgcgccctctctgttgcgcctgagagaggagatggggagagaggaggaagaaggggaggggagtgagattgacatgtggggcccacgtaggccccaccattttattaattcatgtgtgaaactgacatgtgggtctcacgggtttattatttttcttagatcgaattgccacataagcgccacgtcaaatgaagaacgagtcaaattagccacgtaggcgccatgtcagtcaaaaccaccatccaaaccgctaagggacctcatacgtgctggttttgacagctgagggagtcgttgtatctggtttttcggttggaggatgaaaatcggattcgttgacaagttaagggacctatgataaacttattcctattgagtatgacaagcttaccaccaatcgcattgtcgattccctacagcccactaacctggcccaaggtgatggaggaattgaggcctaactttgccggcccacccaacacatgcctctagttgaacacggcctacaaataatctagcccaaccaaaacgtagatccaagcccagatccacctgcagtacaatgcctgccacaatgtacaaactattgtacaaagcaaacagtcagctacttgtattcctagttggcacattgccgtaggtttttcacctcaactaaaccatcttaaaacaagcaatgcaattcacagtaacaaaataattacacttcaacgcaacatgtcgatagatcaatgaacaatggtcagctcacgctgtgcacgtaaaactccaccgcaaaaccatcaacgagacttctctgacgcagatcgctgaaatgtattccctccgttctattaaaaactactaactactccagtaacatacatctgtacagattcatattactataatgtgttacattttattctagattcgttttttatgaaacggagggattatgtccgtcagtagtatggtttatacgtcagtaagtcagagaatcgctgctacatgttgtagccttggtgacacggttgccacccttgctgccgcctcgtcgccgcggggggagccatcaccagcgccgccgccgccgccaaatccacgcgctcgccgcagcagccgcagcgaacgcactgttcgcccgagacgttggtggattccaccacgggcacgacgcagaagttggacccgcaccgcgcgcacgcgccgcgcacctgcgcggccagcgccgactgcacccggcggcaccgcgcgtcgtcgtggtggcaacccccgcgcgcgcgcagttccacgtactccgcggcgcggcgcaggtgctcccccgcgcgtcggcggcgcgccatggcggccgacacgggcgccagccccagcgcctcgcggatctcatccacggtggcgtcgatgccgtgccggagcggcgtcgcgtccaccccggtccacggcgcccacgacgagccctcgccgcccgcgtcttcgttgccaccgcgccggggcggcgtcgcgtccaccccggacaacggcgtccacgtcgagccctcgccggccgtgtcgccgttgccaccgcgccggggcggcgtcgggtccgccccggaccacggcgtccacgtcgagccctcgctgcccctgtcgccgttgccaccgcgccggggcggcgccgcgtccactccggaccacggcgtccacgtcgagccctcgccgcccgtgtcgccgttgccaccgccaccgccaccgccaccgccggaatccatcgtcgtgtgatggcgagttgcgtctcacacggagtaaacggagactcacgatggtacatatcgcgccgcgccacgaggtgttcgacacgggaccgaggcgtgtgtccgtgtcggagaaggattctcaaccagaggaaggagaccaagagtcccaagacaggccccgattacctttctcgtaatgttttccagtacgtaccgatttcaaaaaccaatttaagatgaatccgagattaaaataggtcaagtaaaacacatcaattctcccagtttatggagttctacaggtagtggatctcttcgggtgttttgaattcatggacacatcaggctcaacgagaggaaattactggcctaatcagttacgaattccctctccatcctgaaaacctaaatggcaatgttaaggagcacaaaactaggctgcccaatgttccatgtctcttggcatgaaggcgcagtgacggtggggaagaagatgatcaatggtctctacagagaccagttcatggcattggtggagtggctgaaggcgccgctgccggagccatgctcggcttccggccggttggacggggcacctccctgcagtgcgagctcgagctcgccggagaaatggccgtggtggacagagcccggagggacctcgttcagcacaaccccgtgcggtggcggcaggtgcacgttcctggcgccgtcatggccccggctggagctgttccagccggggctcgccgccatgtagttgcttgccatgaccgagggcgacaccgggttgttgccgcctccgaaggcgctggccgttgacgacattggcggggaccggttgtggctgctggtgctttgggtagtatcccatggctgagttgacagaagagagagagcacagctggagtcggtggcgactcccgcgagacatccacctgaggtgagctcaaaggctgggtggtggagcattggtgccccagccgctgagccaccatggctgctgaacgcatggtgatcactgtatcccgcaactgcgctgcggtgaggatggagttcatggcccccttgccactggattgaaccggacatgcgatcgctgggctgaatagcaggccacgcatccctcacactgcttggaacccttgggtatgagaaatctaccacaaagcttctggacctgcctggctcttctgaaacaaaagttgcaggggcaacaagtcaatacactcatctgaagttcagagtaacaggacaaacatgagccacattttaccatgaaaggatgcagcaagccggccatagcgagaagaaagaggtccaggtgtcggcttcctccggcgttcattgtgacctgcaaggcgtctgcggcagctttttttttcttgatcaaattcaggtaattggtggaacctgtgatttgaagtggccaaaatattagtgaattaccacaagcgtagtgacactgcaggatataattgaatacaaggagttttcctaatgaagaatgtcatgctataaaaaatactctacactgacaatgaaaagcaataatcaatttaactcaataaaaaaaaagcacgctgaagagcatttttggtggggctattgcttattgtagtgaccttactttagaaaattgcaagcacatgaaaagtaggagtgccaactctgtaatcaagaatcagctacccctgctgcttatcttaatacggagcgtgcatcagataaataaatcaaaccacatgccatgtgaaaagctgcgtcgatgcaagcataacaacttttttttaatcctagactaatgtgtatttgttctaagtagcaacactaaccaaagacacgcctttcatgattagatacacatacaccacgaccgggaaaataaaaaggttacctaaccatgtggacagagcacctgcaatcattcccatagtactttagcacaaacaaaggctttagttagtacatcaaatagtcaagagatgttttatctacggcagagcagatttataaataacacaacagtcagaaccttctattttccggtaatgcatatgtccacaactccacaagccaccaactatgaaatagtatgcattttttccaaacaaattgttggatgcaatatagcagatgatgttatttcattttgatattttagattatgtagcataagcataagtgtttgtgttctagtatctactatacaaaatgaaaacatataggacaaaattagagtaagtatatgggatttctgatgaaccaaatgagaattattggttagcatgattgaccaacttcgttattgctgggcatgttcaaaggtagaacccatatagtcttttaaataatacatgtttattcagagactatgtccttacaactgttgagatcgacaacaaagactttatttaaacaatgcattcataaaaacaaaattattactattatttccttgttaaaaccctcatgcagaaaagtttccattctatagaggttaagagtcgttgctaagcggttgtttaatcgaagctaccatgtttgcatctccttgcttctctctcatccatgtcagcaaacattcctaattagcaaggttttgtagttactatttcatccgatttgttttccacctcaatttctctgctgccctacttccattttagggcattaaatagtgcatagtagtacagtgtagtaccttactactaccccatatatacttcatatcctaccacattccacatactactagaatagaaaaaaaggagatctagacttactatatgtgtgctcctcagacaagatattctggatggacacttttatgtcccttactattctagtcaggttccacatgtcctaaatttcacattgatcgctactactatcaaacccagcagcagtacactacacacagggcatgaaaatctctcaatctggccagggacaaaacggcaaaatttaatttgcctgaaatccaacgttgctgctacgtttttgcaagttgcagaggttgtttcttttttcttgtcctaaaatcagagcttgctgaggtagccaaatctagtggggagtttttttgaattttggcaggaaccgtttgaaagttgggcgaatcacacggtggattggtgagtgtctgtcacactcacgcgctcacaggtggaacagtagagcagcagaggaagcaggggcaatggctggacgacggcgacgaggaggaggaagaagaagaagattttggttttggtttttggttttttacctgctgcactgttggcagaagcgctgctcgaggccggcgacgacgacgatgggctccttggcgtgcatgtagcacaccttgtggcggcagtagtacggcttgacgccgctcagatccacgccgcaaccctccacctggcacctcggcggcagcggcgg

SEQ ID NO: 69286 - DNA, 4672 bp, Oryza sativa
aatattaaacatacactaattacaaaacccatttcataatattggactaattcgcgagacgaatctattgagcctaattaatccatgattagcctatgtgatactacagtaaacattctctaattatggattaattaggcttaaaaaatttgtctcgtaaattagttttcatttatataattagttttgtaagtagtatatatttaatactctaaattagtgtctaaataaagagactaaagttaagtccctggatccaaacaccaccacagtcgtacgctccgaaggcaaggggacgtataaacaacaaagacatgtgtaaaatgctctaaaacacaatgcaaggacaccactaataacaaaagttggcagttttaatttagttttgtgatgatgtgtatattattaaagttccgatgcaaaccctcttgtcgctacccagatgttccgtttcaggacaacacattctagtaagggtcaaaggttgtacgcattttgatgatggctagttgctttagggctcgttattttaatgtaaaataaatcttaccaacttttatcaacaccaaaatttagttaatttgctacttttgtcaaatattattgtattatgtgaagaagtttctagtaatcactaaatatttgtacagtaggtatggtacagtatttggaatttagttggattgctgccttattaaaatttacaaatgctaaaatttgacatagttgaaaatggtagcaaacggataaacgcccttacctcccacttgattgaaaatggtcgatcccgtcgaccgccagcacagacgacatcacccataaacccacttgactgtgtgttcggcgaccccattcttgttccactggggaatggatttgtgtcgggtcggtttggaagttggaaaacagatgaaaaattgtgtgtggtaaactccgggtacatggacgaagggacgatgatgacagaaaccgaaaagcttttgcatccccacggccgccgcaaggtcgttggctgggccggcaggagcagatcggttagttgacgagggagagcggtagcgaatgcagccgctgcacaggtccgcccgcaattggcctcgcgatggcgcatagctgattgcgcaagatctccccactgcgaacaatctgaaaacgaaacagattctagtgcacaaattatttggcccgaacgacagacagaacgacgcgcgtgcttcggactcgtagggggtgtttagatcaggtgtaaagttttgacgtgttacattgagtattatataaggtgtcgtctgaggtgttcgacactaataaaaaaaattaattacagaatccatcagtaaaccgcgagacgaatttattaagcttaattaatccgttattactaaatgtttactatggcaccacattatcaaatcatgaagcaattaagccgaaaagtttcatctcgcaaattagtcgcaatctatgcgattagttattttttagcctaaatttaatagttcatgtatgtgttcaaacgtttgatgtgacatggtaaacaaggccgaagatgacggacgagggtgagtacgtatacgacagaccaaatatttttggatgacgaaagtaagagtatcaatgtttcaattaggtagagatagaagagttgcggcaggtgggaaaataaggttgagtccatgatataggccattcacttgtgagaatactgtattagtcatagtctgtagtacatattaatggaaacatcatatccagtttcctcacaacaaatatagtgtttgggtttacgtgtgtgtgagtgagacatcctggtggtgggcaaaattaaaatcaatgtaaaaattatctactctctctaaaaaaaactcaaatctctaggatttatttatttttttgatacagaaagattgtggccgtgttaagattcaaaattttttcttcaaacttttaattttttcgtcacatcaaatatttggacacatgcatggaacattaaatgtggacgaaaaaaaaatcaattacatagtttgcatgtaaatcacgagacaaatctttttgagcctaattaattagacttaataaattcatctcgcagtttacaagcggaatctgtaatttgttttattattaatctacgtttaatactttgaatgtgtgttcatataattaaaaaaattgacatacgaaataaacacaacctgtgagagtgagtaaagagcagccaaaagaggaagtatgtgcgagtgagtaaggagcagccagcagtaagctactgaccaaggtttgaagccaggtgctcaccgtctcaaaaataagctcttcctcggaattcttatacatattttaagtttacttgctgctcgtatatagtgtcggggtgtgcattttaatctagtgctcgattttttacacactcattttttttagttattcaatattccgtactaagtttttccgttggtcgttagagttctttctagaacggtgcatagcttagccgatagagagctactagcgtagtcacttacatgggttagaattcatatgagctcaccacctactaaaattaaattctagacaggattagtgttgcttattttttgataaaacaatgcttagggtctgtttgaagtagtttctagttgatacaactcctccaaacaatccctccaaacaatcctttttttttacagattctgagaaactatagttgtagaatccagacaataaactactccctccatccaaaagaaacttaatctagaaagggatgtgacccctcctaagattatgaatctggactaccctttgtccagattcgttgttctaggaggggtcacgtcccctcttagattgaggttttttgtagaaggagggagtagaagtcagaagcaggaaaacttaattttttttccagattctcagaagttgttaccaaccagctgtttctcagaaatttaaactcccctaaataagccctaagcttcttagctggtagggagccgctgggaggaaggcaccgatctcggttcaaacctagccaataactttttttttacttagttctggatgtaacacaacaacattttaggacagatgtgtgcacagtacgcccttccgagaacatcacccacgcccttctaaaaaacgcatatgctcctgttacaacagaaaactagcagaactatcgccccgacgtactacacagctacccgactcacgacgactcccaaacagaagccccccactgatcgacttgacggactgactgagggtctgtttagttactaaaaagtttttcctaaaaatatcacattaaatctttgaagatatgtatgaagcattaaatgtagataaaaaaactaattgcataattatgatggaaatcgcgagacgaatcttttgagtctaattagtctataattagccacaagtgctacagtaacttatatatgctaatggcggattaattaggctcaaaagtttcgtctcgcggttttcaggcaagttatgaaattaattttttgattcgtgtccgaaaaacctttccgacatccgatcaaacgtctgatatgacaactaaaaatttttatttcaccaaactaaactggcccagactaatcctatttgcagggacgatcgacatgtcgtgaactcgtgatcctccggtttcccggccgtatacatgctaccgctagcaagcatcaaaactttctctccacagtggtgccatggcaggtgtacgtgcgatccctactttgattggctactcaccgtgacgtcgtctacaccgacgtaatacggcgcgggggagtgcagtgccggggacagcaccatgcacacgaatcttggccgggtcgccggccgtcggcatcggccggatcgcgaagtcgcggctacaggagaacgtgacggatcgccgagagagcgagagcgagtactccactactactcgagacaggccgacgagacgagaggaggaggccgtgggctctcgttggacgctggtgctcccccgaactgttgctgatgctaccggtgacacgtactgtgtgtgagcagctgctgctgctgctgcgtgtgtagctgtgtatgctggcgacggacggggtgagtggctgtgagactggagtatgcctgtgagcagtgtctcccactgtgtgcctgtgactgtgcttgctttgcttcttgcttgttgggccgagaagctgtgacatggctcctgcagtgactgtatccctcacgagtactgtagctctgtgacttcgggttggtttggattttgataggccgagagttttccactgataaatgcaagagttttttttttgtttgatcaggataatcttgtgtaacgtttcacaggctgagaattcagcgtacaacagtagttgccgcgaccacgaacatttaaggacagaccatgtgtgtgagaggtacttttgggatttccatcgtccttcacgttagcctcggcgctcgctttctccaactcacgaacgatgtttacgtgccagatagagataggtctaacacaagtagcactctcttaacccctgttcgtgatgcgtacatccacatgtgtagccagatgatcccactcctcccaatctcaatcgtcgtgctgagcccggcggcgcccacgacgcggacacgtacgccacccacccac

SEQ ID NO: 69287 - DNA, 19909 bp, Oryza sativa
  unsure (1)..(19909): unsure at all n locations
cccccccccccccccccccccccccgcgctagctgtcccggctggctggctggttggttgggcttcccatttgcagtgatgctactgcgtgcgtgcgtgcgtgcggccggcccagcggagggcggctggccggggtccccatccactactgcggagtactacggggattggatggcacacggaagtgaaggggttaccggttcggtcgcatttacagttgggctagggggtacgtgcacgtactacgtgtgttgttgtttgtgtacgttttctgggctgcgtgttttcttttcggtctgttactcctgttgggcctgtaccttgtgggaggacggggaacagtaatagtagcagtgacgggagcgagaaggactccgtcgtccatccatcatcatgctcggcctctcctgaacttatgagtttcactgttttttttaatggaaaatcgtttaaagttggttttgtgatgttgagtttggtgccaaaattttgtcaacagggagagaatgtataaggcgataccattattccgatagggcgccatgttttcaaaggacggataccgaacctttgctggatcaccgttggatcacagattaccatggatgagtcgaagcaatcattgaataactgaatctctgggcaaggcggaacggcacaagactagttctcacaatcaacgagatgctttgctatggagatcgatgcctgttgcgtcagggtcggcatacatacaaattaagcactgttcataggatcaaagactttccggctatgccaatctgagagaaagcctacttgactagcgcctcacgctgcaggttcacttgggctagttgcacgccgatgatctgtgacaaacgataggatgagaaggagaggattacctaatctcagtaattgcatactctatgatcaacaaaagaaaaccatccgccacattcttatagcatgctcgaaatccctctaactttggtggatcatactaggatctatttggggagtgtttaggaactacaacaacttctaccagaatctccacgtacttcaaacagttcatattctcgcccatattatgagaatatatagttataaaattttaatctaaaaaatctaacttatttagattttcaccaataagctagcttcctttggtgcgacaaaatgaaaagaaaatattgccaaacatatatggcatcggctcccgacatagtggccatcctcgcaacttggtcgatttctctctgtgtttttttagcgtgaatatggtgctctttactggtagtagaaagtaatctgaaccgttgatcttatttaatcaaagatttggatctacttttactaccaccccagttagcggtagtagaaatatgaaggggcattattgttttaaaaaatatgtgtgaaaagggtataatcgttattttgcattgactaaaccttattcttcttatttttagctttttcgatggtaaattagcgatgccagcggaatggatgaccacgatagacagaagaaaaacgtaaatgacaaagctactccaaatcactgttaaaagttattttaataatgaaccggttcggatcattaacagagagcactacagcaccggagcatatcgatctcaaaggaaaaagggacaacagattgttcaatcggcaacaacgatcctggcgcgaagaagcgagcacggctgctgaagcgcgtggaggccaccatcacggtgctatagtacattgttggtttgctgccctaatgtatgtagtagcttggtcgtgcggtaattagccatatgttgtaatctttgtgtgtcctttttttctttctttgatctgtcgttcctgtacaaaactccatgtccatcgaatgaagtagcccatgtctggacaagcccaatagcctcattgtttgttaatgtctttttgaaagaaaaagcttattgggtctctgaactgttgatctcaggctttttaagctcgcaccagcatgaagcggcttggtgcattggcccaattggtaaaggccactagatcagattgcccaaatgtaacgtttttccatttgctcctcttttttttttctctgaacttactgccgtgtaaatgcctactctatgatctctatcacttatatacctacatgaatgtgaatggtagtatcaagttgtatgcaccgaccagttcaatccaaaagcttaagatgatgaagaaatccgggcaattcactttatattccagcacttctcatgcgaggccgtctcaagcctctagcgtggaatagaagtgggttgcaacttttatttaattatgcattagccatgattctaacttgagtcctttggctctgataccatattgagttgtatgcaccgatcagtttcaacacaaaagcttaaactgataagaaaatgtgggcaattcattttgtattgcaatagatagaaaacaaagtaaacaaacggagaaaggcagtttaagaagtgagatgtggtggtttttcttaagagactaacagaaaatttcggtcaactctcctaattatcaacatatttcttctctctttttgcatggtttccaatactttgattattaatttcttttataatatattatcaacaattacaaaattactagatatgaaaatattttcaaatacgagcataatgatactacattttataatatgtttttagtttaattattagtcaaaatgttcaaatattgactttgtggaaaaccaggatgtttttttagattatattttataatagagagagtactatgcatagacctatggatttacgaaacatcagccctagctgaactttacgatttgtgaactattaatatttgatcaatttaggatgttttggaagtcgtatgaaccgacatttaaaagaaaaccgctagcgaaagctaacttgtaatgtagtcatcgataaaagctcttatgtccatggtacgcacaatttacctattttcactagatctgattaaaacattctctccacaaacaacatcaagaatgatatatctggtagggacttttctcctgtgttagacgacgcaacatgcaacctggagtgaggcgatgcaacatcctgtgaccatggagaaagggatgttacgccctttctcgacctcaacgacggtggtgatgatgggtggttagatttggatttggcacctatatctacagaacgcacgacagggcatagacctcgacgatagtggtgatgatgggtggatggatttggatttagcgtccaaccctccacagcacgcgaaggaggagagaggtgggccatcgaaggcggtgtgagccaaatccttgctaggcaaggacgggtgtgcctggcccctaagatgatatggttgatggcggtttaggtggcggcggtctacaatgtcaaaggtgatggaccaaatgcacgcgtgaggagagcgatgtgctcggctctaccacgatttggcccgccatagagcgatatgatggttcctgttggcaatgttgatgttggcatgacacaccaacactggggaagggtgcttgtggtcgaccctcgtgacggttcaagctgcgatatgacggtggtggcatgtagggggtgcttggcatgcaaagataggcgaaggctagctagcggatgagtgttggtgtatcggtgtcttcacgccaacagtagtggatgctagtggagcaatgtggcagtgtctatagagggtggctaggcgacagctgacaaacaaaagcctagctcaaaggacttcttggctagcaatggcaacgagtgccatgatcactctttagagcgttgttgacggacctcactatcttcttagcaggacattcacagtgaaaaaccttgttaaattttcaagtcggacgacatcgtatcctttcgggaggcgttgcataggaagtctcatatctacctcttctgtcaattgagccagcactttttcacagcggtgggttatacaaagaataagtggatcttttttccaatggcgctctctctcgcacctcttcttgcaagtggtgtttggaaggctagtttttcagctttttggaggtttattttttaaaaaactgaagtccggtggaaaaccatctttgactaactgcagttgtggttttcttttgaattaaaaaacacagtcacacagatgccgtgcataacaacgaacatggaagcaaccaatctctcaaggtgaagtcccttcacaaaattaatgggggatgctatataccggaatcccgttcaaaaacgggacgattctaataccgatatgacatcgctctgagcaactgtcatccgccacctgcgtgcattgcagcaaaatgagaatgacgaccagcgcttgccaaacgccggcttccctgcatcttggagaaacctcctcggaagcgctcgcctccgcgcgcgattactcgcttcctcccgccagcgcgcgcgccatccaccggcttctccccatcatggcgaatcctcctagaaagcgcgcgattcctcgcttccttccaccgccgcgagcatcgtccatcagctcctctgcatcccggtgaaacctcatcggaatcgcgcgccattccttgcttctttccagcggcaccctcgccgtccgtcggctcttctgcttcctggtgaaacatcctcagaatcgtgttttgcaaggatatgatcttacaatcaaaatagtacaaggtttgacagagaaagcttgcatcaatgaacttgacaccagtgggaggacaacatgctgagaaggcccggtttaagaatcgaggtgataggcagtaaaaatctgtgaatgagagtaacaccatcaagacagtgagtatcttgactgctatcatggtgcctgcgggtttcattgatgatacattagtagaatcatgtgatacttgggaggtttcacgatccttctcggtatcatgaaacctgaaggtttcacgcatgatccctcgctaggtatatatcatcttgtgtgatacctgaaggtttcatacatgatacatcaaaagtatcattatgtgtgatacttatgatgtatcacatgatcctacttagatatcatgcatggtatcatggttcctacgggtttcacgtatgatacttgaggatgatcatgtgatacctaggaggtatcacatgatcatgtatcatgtatggtatcatgtatcatgatcctcctcagtatcatgtatggtattatcaggtttcactgatgataccttaggaggatcatatgatacgtgggaggtatcatgattctgctcagatatcatgtctggtatcatcaggtttcatagatgataccttagaaggatcatgtgatacgtgggaggtatcatgattcttctcagatatcatgtctggtatcatcaagtttcatagatgataccttagaaggatcatgtgatacatgagatgtatcatgattctgctcaatatcatgactggtatcatggctcctgtgggtttcacagattataactaagtacgatcatgtgatacttgggaagtgccatgatcctcctcggtatcatggctggtatttactccacaaaaagtctacacccatgtaatacacttcatttgttcatatatggggaaatgatatttgcttccgtcaacttccagatcaaatatatgtacatggagtggacatggataagttcatatcatttgattcgatcgatgtatcgtctgacactgcttagagcaagaaaatgaagaacctcctgttgatggagactgtcaaccaaagaaaacgcggtgggtgtcagcgtcggcgccaccaccacgctcacaccgctctcccgcactgacctcgtgtgcatcggcggtgacactgaagaggtggagctgccaccaccacgctcacgccgctctcccgcactgacctcgtgtgcatcggcggcgacactgaagaggtggagctgccgtcgtcggcggacgcgatgtcacaccccaatctgataccgccgtacaacggcacctgacaggagcgtgtcgtagggaaaacggcgtgaaccgcttcctacgaaaccgcgatctcggtaccagtcccaggacatagtgttggtacccacggtgacaaatatgaatcataggaatccttaaaatagatagaggatttatttaccttaacttaggttgcagctcagacagcccgagaatacaaccgacgacacggacgaggcgaacaccaacaacaacagcagcagcggaaccaacggtctaacacccaacaccacaggcgacggctgggaaccaggacgaaaccctaatcttcactttatcttctcttcagggcggaggaactatatatatatatttatatagagcaagggtgagtactttcgtactcagcaagtcacggaaacttaggtgtttaatgcaagcttggaagagaggcaaggttgtttagcaaatcttttatttgaagacattttgaaatcactaagtgatttatttcttcctaagtttgggctgaaaagagacttacgtctcgattcgactttaagggatgtttttcaacagctcatttagtaatgtaccgacctcccgagtcagatcattacttctcggctcccagagccattccacttgattaatcggctcccagagcctttttcattttctcggacttccagagtccagctgcccagcagcacaacaatccgcttccactcgggaagcctagtctatgatgcccgcagacatcccgaatcacacagattcgtttctgactactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccaacccagggttacctcatgccatatagaaggatcaaatcctcacgtaagcataggccattttaggcattcacaaatcaactccaaccaccttgatcggtaagtgagcaagcttctcgtccttgccttaccaggaacccggtttgtccgacctcgccccggcgttcccaactattggcatgcgaggtttccctgaaccgactagttacctagccagggtgtcccattccaccttgtggttgcactttgattatgtttgatgagtttcccacaggaatcggtccttatatgcgaatacgggacagtgccacataggcacaacccccgcatcgtgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtggtacaacctacaggaattagtgcgactactgggtaggtccgtcggtttggcatgcaaaccgaggccaagcaagttaaacgtgagtgattctaatgatgcaagttgcaaacaaaataataatgactttccaattataggagcaattgatcaaagggtgacttgccttgctcaaggtcttcacgaagcttcacgaatcttcgagaaaacccgcgatcgacgaaaatccgataaccgccactatacgcaaacaatcgaaaacctaaacaaaggaccaaaagaaagatcctatttagactaattagtagtgccattaaatagatctcaatttcacggaattactggaagtgaaacggagtcaatcggacgagcggttggggagatatgaattttggaagtttaattggagtttctggaataggagaaatggtttatggaatttatagaaataatattctcaagaatattattgacagtcactgtcatgcgggaccaaaggaaatgttttatggaattttggaatagggaattgatttatgggacaaaggaaaaaggatttatcaaatccctggaaaaagaaaaggatggagggatgttaattggacttgggccgagcgaaggggcgcggcccgaagagatgcgcgggcgcggccgaggcgagcgggccggcgcgtgggagggaggcggcccaaggccgaacgaggcgcggcccacgcgacgcaagccgatggacgcggtccaccgagtcgggcgcaaggcgggacccacaaggcgatgacacggctcacgcgagcggggtgcacgcaaggcggcgcgttggatcggtggaccgggagacctttgaccggtctccgcggggccgggcaggtagatgtggcgtcctcgtggacagccacgttggcacggcgagagaggaggccgggcggccaatccgacggctcacggcgtgtggcgagttccggcgagcggcggcgaaccggagtgggcggcgggcaccggaagtgagagggggtcaaggtgggatgattcaacggtgcggatgagggagaggcggcgacacggcggctgacgacggcggccgtgcggcggcgggatgggtggcacggcgcggccgcagtcagcgaggcgggcggccgcggtggcgcgccggggaggttcaagaggacacggggtgggtcacggcgcaaggaatcggcgagagaagggccgacggcggcagattgcggcggcggccttcgccggcggagagaaggggaaaatctcgccggggcaacgggagtccaattcaccggggaaggagcttctacacggctccgggaactcgtttcaagccacgggcggcgacgagctagcctagggagtcatggcgacagcgagcgacctccggggcagagcaagagcgcgtggcgagctatggcgagcggcggcgggcgcggcgcatcgcgcggcaggaggagtattatggtggggatctcaccaacgaagaggaagcagcgttggcgtcgcggtcggtgtcgcggcgaggtggtcgcgacgccgagacggcacggcaccgagagggcgcggccggggaagaagggagggagaggtggtgcccggagctcctcgtcacgcgtccacgcacgcaccggctcctccggtgctcggcaacggacggcaacggcgagagcgggacgagcagcaacaaggcggcgacggtggttcggcggcaatggcgcggtgggtgtgaggactgaggcgagtgaaaacgagagaggaaggggataggggtggcttggttttatagcggaggcgaggtcggtttggggaggggagaactgaccttggcggtcaagtgctcggctggcggtagcggcggtttcgtgggcggtgcgaaagcggcgacggtgtggatgtgttgagcggcgaaggcggtggatcgagcagcggaaatcgaaccgctggagcgcgggctggcgcggtcaaggagatgaggcgggtggcgcgagcggtcaagcggcgcagaggtggtgacgccggcagtggtcgggaaagggaaaaagaaagggaaaagggggcttggtcccttgccataatgaggagagggagagtgaggaggaggaggagagggagagcagctgcttctcccactcttggacgggtgcggcgtggagtggcgggggccaaggatgacgtcgacgatgacggcggcggtcggtttggcatggagcgggggcaaggcggcagcgcatggcgtcggcggcgaccggccggtcggccacctcgcgaggcgcgcgcgggaatgggcgaaggcggtggaggttttgggcggcgacggcgggaaatcggctaagcagcggtgcatagcgcggcgagaggggagagagaaaggaagcagagagagagcgaggaaagatagaggtagaagagaggcgatgcctctctctctcggcgcgtgcagcgcacgtgcggggggggggaggagatgatgggctgggaggggaaatgggccgggggaggaaaatcggtccatccaaaaatacagggaggtaaagtagacttttacagagaaaactgatttggatagaattggagagatttagggtttggattcgaattctattttgatattcgaactcgagggtttagggatgtatcaagggaaactcaaggagaagtcatggaaaggattcaaaaggaatacttgggtatttgttctcgggaacatagggtggagtcaaagaaaggattcgaggcgggatttgaataattctggattcgtagaagttggcgaggatttcaaaggaaggatttgaatttcagaatttgatttcagagactcgaatcggaaaaggaattttcgaggtggaggattttgattccgatgagagggaacaacgggattaaattgagatccctggcacaatttagactctcacacaaagaacggaaattttcgcaattaggattttgccgagttagtttttaatgactcacgaaaagcggagcgttacacgcgagcaggtgccgccgccggctccaccgccgcaaccgccgccgtcggcgccagcgagatctcacgcgccatgcccacggtgagagaactgtgagtgggggactcggataagcacaagaaacgttgtgtctctgttgagagcgggactcggataagctcgtgatgatttctggtgattcctagaaaatctgtcccgtcccgaccgtgcccaaacgggataccggtgtttagcatttccgaaattaattgatacttcctccgtcctataatatagtaacgattttgctatatatttgtcgacaaatttttccccaaaaatttgacagatgtaattataggacaatcgtaatgtaattacactgtaacttacatgtaattacactgtaactatagtgtaacttgtatttaactttcaaaaatctctccgtaacatgttatttcggtaaaatggagatcgtgggaacaaattctttcacacatgtgtgtgctatgatttgttttcttcctcaccaaaataaatcttgtaatagatctaacgattcaaaattatgtgaaacttacatatatgttacactgtagttacgtgtaagttacagtgtaattacatataagttacagtgtaattacactacgattgtactataattacatctgtcaaatttttggggaaaaatttgtcgacaaatatataggtagtccctatagtaatctaataccggataagacactttatagtacaatgaatttgaacatgcttcttgtctagattcgttgtattataaaatgtcacatccggtaataggttgctatattatactaggacggagggagtacactagtacttaccatttaatatagtattgtctgacatcaaagtctctttaattcatactgtcaaaaaatcttaaacactaggactaagctactgaattttaggctaaaccgctagtaaacaaactaggtgctataatatatataactacctactgccattaggcagcttatcattcgcacacattctcacaagccatacatacatagtactagcatgttggtgtgcgctaatgcagagatgtcaccatggacaacttcatctacatgtaacaaatggtgatcaccgatcaaagatttcagaaacttccatcacttgcaccccactccggcctcggcggctctccgcggcgtggagttcttccgccggctcccgtgttgccggaacccgttctgctgccgcgacgacgacggctcgccgccgtccttcctccggcgccgctcaatggcggaggcgctgttgctgttgctgttgtcggagccgcgcttcagctgccgccgcctcttcctccccgggttctgagctgcggccttggacgaccccgccttgctggcttgtggcgccgccgccgccgccgccgtcgtcttcgcggcgtcgtcgtcgatcttggcgatgtcgtcgtgttcttcctcctcctcctcctcctcggtcttggcgacgctgtcgtcgtcttcgtcctcgtcgtcgccggcggcgtggtcgtccttgaggtggtgatgcttctgttgttgtggccttcccctcctcttgtacgccgggatcacctcctcgccgccgccgccgctgctgctgccatcgtcggctttcgcagcttcggtggatttcctgcctttcccacccctcggccttcccatccaggcgaaccaaacaaacaggggatgaggtggtggtgatgtttaagttggtaactgcaaaataatatgataaacaaatcgaagttaggatatattttttctctctctacttatctgtaatatgtgtgctgctagtttcaactagtcacaactcacaaactcaaatagctgactagatttgcatctatgctcgtgtgaaagaatacgaagaactgattcttacagctaaaagctgcaagcctataagcatcacatgtttgaggcttgtggggtgaaagatttgagccagttattattacagtgggaaaagaagtttgtttgatggatacaaaaggagaaccaaccacagaaatactattggaagtttggaacaacctaacacaaaggcaagaaccatgtgaacagactcattcatgtcctgtaatcttctatccactgtctagaacttcaatccaaagtcataactacctcaagagcatgagcatcccgagtactaactaggtaagtagagatggaaatcagaagaacgatcaagaacaagaacaaaaatatgtactgacctgttatgatgtctggcaatccgaaaacttccctcgacaagccttttcctccgggattaataagagggtttcagtttgcagcaaagagatcttcagagactagctagctgagctattctacgattgctatcaggcaagaaccaccaaccaggacatgaacaagagagagagaaagaacagaggggattcagatatcaagaagaaggcggcgagatcgagtcgagagcttgagatcgtgcacaagactacacgagtttgtgcacacagaaaagagaggaaccaagagacagcaggaagaagaactggctacaccatttctgcagatagagagagagagagagagagactgtaaagagataggagaagtagaaaagatggagatgggagtttgcttgcttgcttggtttggctgccggtggtaacaacgtgcagcaggaatgtacggccctcaggtacagcaatagcacagtgaaagcatttctgatgctcgcttactttctttctttcttttttttttgggagtggaatctctgtttcaggttttttcctgttacaaccaggatgaaattcgtagagctccagtgtctggccctattaaactattgatgatttactgcgagatgtaataagagtacaagtgtgtgtacaatggcgagttctaacttatacagacacagaaattatgaaatgcaccccctggctcagtacatatgtacactgctgatacacctgctggtttcttgtttggtgaaagggcgagatcgatgaaacggtgaagaaacagtagctaaccctggcatcttaatttggtggtactagggatgaaaacggtcagaaacgatcggaaaacagcctcaaccatttccgtaaccatattttttctcggaaacgaaatcggaaacggtaaagtcagaaacgaaaacgatatcggaaatatcggaaaaccggaaacggaacaatacggacggaaacatgtcggtacagatcggaaaccggtaacaaatacggaaacattaaactataaaaacatatatttaactttacataagtatgttatatatatacataaattcaagcttatactatataaattataaattaacttcattttagccatgtacaaaagttagagattttattgaagagtcattcaatctataagctatgggtcaagtatagacatgtcctataatatcgacatatttagaatacggtaattaccatattataagaaacgataatttccgcgagaatacggtaaatacggaaacgatcggtataacagcaaaaccattttcattttcatttccatattttttaccattttcatttttgtttcggtcgattaccatttctatatagctcggccggtagaaagtcgaaaaccaacgtcggtcggccggtaattaccgttaccgttttcacccctaggtggtacacacccaccaaatgcatgtgccgtaagaagccagttaccatctctgcccgatggacgaatcgaatcggtgatggtttcgagcaatacctggtgctgctacaaaaccgggtttattgcatgtatcacagacctgtgggccaccttgtgcagccacacagaaacaccagtgtactgtgtaataatgcactggtgcaggtacactggctgtttgcaaattgcatgtagtggaacttatgctaattatgggccacttttttggctatttcttggtgattttctctgtgaatgatgtacagatgtgcagtgcagtgatacggtgtggttagttgatggtcctgcctgtcacggaagatgaaaatatcaacggaacgaaccacttctctccaacacccgaccaaacgcgattccctctcgcatgcgagtcaaagaaaaaaaaaaacgttctcttttggagagaaaaagggaagcggccggcaggcagcagcagcagcgaaggcgcgcaccgcaccaacgacgcatcatgcgatgctgctgctggtgctggtggtggtgcgacggtcgcgtccggcgcacggaaagacgccgccggtgggcggtggcttcctcctcactcactcgctgcgctgccgagcccatgccgcggcagcagcagatgcactcattcatttacgccgctgcctgcctgcctgccatcgtgacatgccaattgaaacatgctgcagcgagaggtacaggggcagcagcagcagcttcagcttcagctcgtgtgggtgtgggtgtgggcggcgctggctgctgtgacgtgctttccctttctcgcctccgttaggaacgatcggcagataaacgatgaataacaacagattaatcacataagatacgagatttaacatgaaaaaccattctaagataggaaagagagagccatggataccagccagcaaatcttcactatatcagatgagattacaacgttgaacggcgacttacaatatatatatatatatataaaggtaaaacctctaaaagtatgacgatacatactgccgtgtgaaaatgaatttggatcctgactcaacagcctcgcagaagatatcgagaacgtacgtacgagtctacgtaggtacagcgaccgagcgagcgcgagtggcgagcaaagcaggcaagcggcagcgttggtggtgttggtggtggtggtgtgtctgcctgcctgccgcgtctgctggcgccgggccggccgacagcctcgtgccaacgcctgcagacgcgctcgtcgcgcgatcgccgattcgctttcccggtttcaaaccaaccatcatacgcgcgcgcgcgcgtacgtacgcgtacgtgaagtggtgtgggtttgctgctgctgctgctgcggcagcgcgtggccgcgcgcgcccgtgttcgaacagtggaggaggaggggagggctccaatgatctgtcagtttggtcggcacgacgacagtggggagaggaggggaaatcacggaggagctagctaatctctcgtctcgtttctttngcagtcgtcgtcgtcacggtcacatgcggatccaggggggggggggggggggtgaagtgaaaggaaggacaggatcacaggaatttactgggggatgattcatgaagcccatgaggagggtccgacaaagctgaaagggcattgggcttccggcctacaatgtccccatgggcctacatgtaggggaaccacgttccttttcatttttatggtatactcctatcttttaaacacagttttttttggcaaaattttataaactatcacaattatcactctagtttgaattttttttctttgaagcagatctcttgtgtttaggcgatccatgaagagtagccagagaaatacttcaagttttgcagtacatttactctttcagatgtgtgtcattggtatttctggctgtagatgagcgaagaggagggaacggaccttctttgatatttttttcgtattgctccaattgtatacccattgatcgtgattgctggttagagaggtgttcggtatgatgcaatgtaactcagaccactaatgtgcagcatgagttgagagagggaggtgaaagagctcagatatgtcgtgtgagttaaagagtgcagacatgtcgtcttcttttgcaaaatagaataagatttgaaattgatcttgtggaatatgtccatgccatttgtttttccaaagtgtatcttttacaagcaagaggctaaaacctataattatgtgataagggagatactcaatctatagtttcgtgagataagtttgttttgtgatagatttgtgcaaaatacatgtaattttatgaaatttattctttttatgattacatttgaaagtttcttttaaaagaatttatggtagctttataagatagtcgcatagtttttgagagagaccaaaagggagatatttaactatttatcactcctacaagtggcaattaataatttgtcactggattcacatgttataggcatataggaacccacatttcataaactatgaatggcaaattcttaattgccagtttgccacatcttaaaagtggtaaaaagttaaatgccccaccgaaagagcctccgcgttggggtgagtctactatgtaagtattcgcggacgacgaacggtttcaacagccacgtttgggctttcctatcctaattgatcattccaaaaagggacatttaacttcttgccgcttttaagatgtagcaattaattatttgtcactcactgtctatgatatgtgagccctcatgtgtctatgacatgtggatccagtggtaaataatttagcaccaagtggcaaatagttaattattcttccaaaagcacagaaacaaaagcagtcgacaagttcagatataacaacagccagtcagcaatggacgtacaatgcctgtcacactgtgtagatcgagctctaccatctctctgactctctactctctaaactctacaggccgccgtcgcagcagggaggcagcggggcaccacacaggcacctgttgcgagcgtagcaatccgcaccgtgcgccgccatgaacctccccgccggaatctcgccgcagagctcgttgtcgctgacgttgaggtgctccagcctgacgtccatcagcgacttggccaccttcccggtgatccggttgtggctgaggtcgaggtacctgaggtggtgcgggaacctcaccccggtcatgtcgaacgccagctcgttccacgacaggtcgatcttggccgccggcgccgcgatcccgaacaggtgcggcgacgggtcgccggtgaggcggttgtgcgagaggtcgacggtgtccacgtcgccgtagcagcgcggtatctcgccggtgagctggttgtgggagaggatcaagaacctgaagctgccgtgcaccagccccggcgggatggcgccggtgaggaagttgccgctgaggtcgaggtaccggaggttggggtggtcgccggcgagggacggcgggatcggcccggcgagcctgctgtcggcgatgacgagggtacggaggttggtggcgccggcgaggtaggacgccggcaccgggccggagatggaggtgccggtgatgtcgaggtcctcgagcagcgagaggttggcgaaggagggcgggatgggccccgacatgccccggacggacgcgatctggaggacggcgagccccgtcagctcgccgagcgccggcggcacgggcgcggcgacgccggcgagggagaagagcgccagcccggtgacgcggccgggctcgccggagcagaacacggcgggctcccacgcgcagcagttggtcgacggccgccacgacgacagcctgacggggtcgcccagctgcgccttcaccctcagcagcgcggcgcggtcgtcgccgttgcactccaccgccgacgagacggcggtgcaggcggacaggacgacgacgacgaggcagagcagtggaatccacgacgaggctactactgttgcattggccattttcttgggtttttagggttttttttggcagcaatgcaagctactgtgatgatctgcactgaacttgaccacctgcatatatctatagaaatcgccatgaaattcgtgtgctagcttctgcatcagattctcgtttattcacttcatgtaaaggacgttcttgtgttctgcattcaacatgcatgtgttagcagcaataaaaccgctcaaatccgtgcaggattctgcagagattgcctcaacatgtgcctcaaggtacacaaaccagaattcagttagcgatcagttactgccatccagagatcaattggattcatcagataataagcagtgcaagaacaaaattcttttctcaataagatacagattttggtggtgtttaaaacttatgtaggtgagatgaagatgaagattaagtgttatacacaaaatgaggtggatctcacccaatccaaatgtgggtgagatcgaaaaggccaagaaactttcgcaagtgagttggcttgtctgttgttatgcagttttctacagaattatgtatgatggagaaaagctccttatagatatccttcgtctgagagttgtgaggtcaaatggttgtccttgtaggaccaggagcagtcattactcgatgctatagccagacttgacgatgcatcagatagtgaaagtggtaagttactggcagactctacttgcactgttaacagtatctttgaagggtgatgagtattagccacattagtatatttggttttataatgcacaaccaaataattagaaagagtgaaacctggaacttcaaattctgcccaaacattgagaaattttggatgtgactcagtatgttttgatcgaaaatttgtcagtctttcgtagtactggccacccacttgtgtcgtccttgtctgatgcctcaaatttgttacagctatcaactattattctaactagtcattgtatatgacagaagatatggctgtcggggcccaaatggtttctgctggtgatcacatgggcaggaacggcgttgcttgttggtaacaactggcaaagtgttggattttgaagattgtgtttgtgaagcgcctgtgtagatcaccggtcaaaggaaaatcatcgatggggcattggcaatttggcatgccaaaagtggatgtactgaacatgtccctgatagggcctcttctttaggctgcgaaaagttcaggtcacaaggcgcagagcgcttttccttcggtgataacggtggctgtatttgccccctaacagacttgaaggaactctaatctgactattaacattccaaaactgttaaaccctttgccaccatctccaatcttcttgtctctctagtgcaggatttgtaaactccacctgaatgcaacgtgaaaacgaagactgtatcttgctttccagtgatcaggttgtgataggtaaacaactatagagaccatatttaatgcttagggcacnnnnnnnnnnnnnnnnnnnnnnnnnnnnnnngtcagactgaagatctgaaggtcgcgtgttcgatccacgctcaccgcatttaactttcttttccttttcagcattgcattttttttctttcttttccttttcagcattgcattttcttttctgcattgtgcatagaactttcttttccttttcagcgttgcatttttttttctgaattgtgttc

SEQ ID NO: 69288 - DNA, 8050 bp, Oryza sativa
  unsure (1)..(8050): unsure at all n locations
atttaatgcttagggcacatgaatgcggggatagctcagttgggagagcgtcagactgaagatctgaaggtcgcgtgttcgatccacgctcaccgcatttaactttcttttccttttcagcattgcattttttttctttcttttccttttcagcattgcattttcttttctgcattgtgcatagaactttcttttccttttcagcgttgcatttttttttctgaattgtgttctttgaatgcaccatttatttttttttccttctcttttcctctcatcttgatttcaacgttgcattttttttaactgcattcattcaatgcaccattttgtgtttttccttctctcatttaaagaaggataacgaattgcattctcaaggtgtgaatatattctcctttataagataactaaaaattatcttccagtaataaataaaaaaagtaggtcgactttcacaccaacaaaaccgttagcctactcccatccctgcgtgggcgcagttgtccccgatcccctcccgcgaacagtaacaccttcggagagcgggcacgcctaacttgtggagagctgagaagcatggggttatggatttcaattttaaatttcttcatagggtaactgttggagccgatctttaaaaaaatttctaaaatttagcaccttgagattgatggagtgggagggagcaaccatgactaaactcgtagagagcgagaaatatgaatgtggttgtggatttcaattttgggcatacggaactgttgaagccgatttgtttttctttcaaaaaaaaaacccaaaattttgagattgagaagggaataaaccaaacgatgtgagagtgagaccctggtgatgggtaacgatcaattcaaaccatcaatttgtaagtgatcaatggtgttgcttcaaacacatggtgatggggaacgacaaattcaaacagcaatttgcaagtgatcaatggtgttgctacaaagacagacgatcagttagtcgactacggaatgcaatacattagcctccaaatgctgcagacgcaaaactacgtaatttactcataccttgaactatccacctttgctacttgctacaggtcacatctgttctactagcttacactacactgcccccaaattggcaaatttctacctcctcccaccccgcttcgccgccgtcgccgtcgccgccgtcttctccgaccggttcaccttggccctcttcgacggcggcggcgtcgttgcggcggcggcacctcgcttcgacggtggccgccccacgcttctcttcggcgtggcgctcttgccgcccttcttggagccgccgcggccggcatccttcctgccgggccccttacgcgtcttctgcggctgctccggcgacgtcgccgccgcagcacgcttccgtgtccccattggtgagcctttcttcttcttcttcgacggcgacgagccctggtttagccgtttgaggaagtccacggcgttccgcttcttggcgggcgtggctgcgtcggcggcgatcttcttgtcgggcttcttgcttccgtcggtcgctgcctccgtcgcttccgagagcttggccattttccggccaccgacgctggccgagttcttgccggggccgcggcctttcttcgtcctcaacccccacgccttgtccttgctcgctgacgccgacacggagaccttcttctcgccgtcgtcgctcccctccccttcctcggcggcctcacccttctccgcgctctcctccttcttcgccgccgccgcggccttcgcgatggagctccgcttccggcaaacgatgagcggcttccctcccttctcgatcagcgacccgacgatgccagcgccgccgccgccgccgccgacggagacgacgccctcagctctccgcgtatcctcagccggaggggacccggccgccgccgccaccgcggcggcggcggcggtgccaggctcctgcttcggctcgcggaggcggagcgacgcggacacaagcgcgcgggcctccgcggcggcgccgcgctccggcccggcgcgcgggaagaagacgagcgcgttggcgcagagcagcaggaggtcgcggtagtaataggtgggngcggaccgccgccgccgccaccggccggcgacgcgtccagcctccgccgcaccatctcgatgtccacgtggcgcctgatcgcgccacggtacgcgtcgctctcctgcaagtggattttaaaaaaaatgaaaaaaaagaaaaagaaaaaggaaaaaaaaaggagaaaatatctgtgggggcatctggctggaaggcaccccacccgcccaactgattgctacgctgcacccaaccaaccacgcagaatgattcaaaccaaaaatcgaacaaaaaactaggaactttcaaattcaccatgagctaatccgatttgaaactttcgcgttcgttcgaaggacacaaaaaatatgaggtgtgcacatgcgtctcacctacctaccacacaacaaaccaacccgaattcataagcaagcgatgacgcacacgaatttttctggtcacgtaattcggattagtgctagtgctatgtcatcatgccacatgcgtggccctaatctaatccataataatctagaggacccccgttaattacggatgggtcccaccctctgacatatcgtttgaaattcccctctttacccctcccctaacttttgaccggcggcggtaaaaaacaaagggtaaaaagggtaaattgtaaatgagcggtaaaattcatttttacctggctttcgtgcagccgctcgagcaggggaccgaacctggcggcgaacgtgtcgagcagcgcggcgagcggctgcgacgacgacgacgacgacggcgactgcgagggcggccgcagcgcggaggcctcctcgccgtcggcgtcctcgtcggcgccgggcttgtagcggcggcggcggcgcaggctggccgagctccgcaggtcgctgctctccttcgacgcggccaccgactcgccggaggcctgctgcttcgccgccgccgcgtcctcgtcttcctcctccgccttgacgctatggtcaccggcgcgcgccgcgggtttcagatctgtggaattggactccctgcacgaccggccgggctcctcgctcgacagccgctcgtcgccgttcgccgtctccggcttcccctcgccgccgccgccgccgtggatgctttgttctctctcctctctcagccgcttcactttcgtctgtagcgttctgagacatgaaaataataataataaaatagttatttatttatttaataagaattcaataattggagaccgagagatcagcatcagacggctcatgaaacgcgcggtttagaggctttttgaaagagaatttggtgattagattttttttttcttctggtgttttagtgttttttacccgatggagagatcgcatcgctcgacctcgcggcggagctcggcgacgcggaggcggcggagctcgtccatccacccgtccgcggcggaggcgtcggggccaccctcctccgcctcctcgtcgtcgtcgtcctcctccgccgccccgccgacggagaagcggcggtggaggtggcggaaccggaggcggcagctggtgggcgtgaggcccgggcgcgcggcgagggggctccgcgtctgcacctccatggcgacggagtcccagctccccgtgccgtgcctgctcacggcgcaggccaagagcagctcctccaacgtcccccagatctcacctccacctcctcctcccgccgccgccgccgccgccggagacacgtcggggccgtccgatccgtccgccatgtgctctcgtcgtcggcggctgcttcccccctttttcttctctctcgctcgcgcacgcttctttgttcgatttttatctcggagagatggatgggatggatagatagcctctgcctctgtgattcgagcgcgcggcggcctcgcgcacccaaaagacaatttcgcgtttctcaggggggtgttttggagaaggcgagcgtgctgttttcaaactggggcccaccttctgcctttctttttattgtacgatccccatattgcccctgattgcgcatactattatcccgtactatatatgagacgcaaatgtcgcaacaaaccgtgtttatttgttaggccttgttccattaatccctataagtaagggattagaggagatttatttcacatctattgtggcgtgaaattattctccctcaatctcctacaatcctattcaatcccctctaaattgaacaaggccttataggagaaaattcttgctctaattccaaaccgcaaatttgatacgcagtactctctctataaaaaaaaactcagcatatccagatttgttgtactataattccatcccaaaataaactcgttatgtacaaattcgttatactaggatatatctctatatccaattcgttgtaatatgtccaattctagtacgaggtttattattattttttttacagagggagtaagttttttttagaaaaaaattgattcacagtaaacgtgtaaacgatctaagcaaagtcagaccgtgcactttctttcttttttgacacggacggcaacaaaatgcttgatcctgaaggtgcatgatcctataaagtatgccaagaattcatcaggatgcggattagcccgtgagctgacacgtgggatctgaataattttggcccggattatcggctgcgttggattggtacgggtgaactgtttgactgggcctccttgatgattcgccaatgaacctgtccttgcttccgtgctgaacccgtgtcttcactgtgcggttacaagaaaaagatttgaacgaacagggcatgccactcgtcagaattcatagtttcaaactagtattccctaaattctcaaattcattcatgccgaatgcaaaagctggcactctgtttatcatcaattttttgtttaggaactttgatcaaaggtacaagcacagagataatgatcatatggattgaaattgtaataaggatgatctggaaaactaaagcgtttcatacatctcaatggagctgaaacttcaactaacaaaagagcgagtttatacatggcgaattggagataaataatactactagtagcagtctagcacaagcaacggcctggaaaataaggcgagattattacatcaccttatgagaattccatttgcttccctggggaagcaaactgcacctaccaaatgtattattgagcgcaaaattttaaccaagcagccatgtcaagttgcagtattgcagggggttgcaatttcagcaaattctgatacttcttcacttccggcgagcctccagtgccttcttcaactcctcgctcgcctcattcgacaccggcttcggtccactgtccaccatctccttgccgttcccgtggcgatctggcttcgccaggaatggttgtggtggtggtggtgccagggacgacggcatccttcgggcgtcgcctttaccgggcattgaggcggctctatttccaccgatctcggcacgcaggtcctccacggtacgccgcagcatgatgctctctgcattgagcacctcgagctgcctcttgacgagcgagaacccttcagtctgaaattccggcgcatccttcttcttccccttgtcggcatcggaatgtggaggattccgcagcgtgtgctcaattgtgatcttgttcatgaccagcagcggcaacttgttgatggccaggttacccgccttgcggccgtacccgtcgtcggcgagggcggccttcagctcgggcggcacgcgcagcccccactggaaccgcaggctcgccttgctccacagcggcagcacgctcctggtcgtgaggcgcatcccggacagcagcgcgccgaccccgccgccgctcttccccgcggcggccacgttcgcggcgaacccgttcccgctgaacgagaacgccctgtggtcgtcgccgccgttggcgaggtcggtcagcttgtgcgacggcggcggcggcggcagcggcggggccggggacgcggacgcgggcggggagatgacggagttggcgagcgagaagtcgccgatgcggggcttgaagaggagggagaaggccggcgggctggaggagaggaggttgaactcggcggatatggcgaacggcgcgcgggcgggggacccgagcgggccgaggccggtacggacggagagcgcgaagggctggagcgggtcgttggggcggtacgagaggcggagcgccgggccggaggcgaaggcggtggagaggtcgaagcggagatcccgcgagtcgccgccgccgccggccgagacgccggtgaggaacggcagcccgaggacgccgacgggcaccttggcgcgcaccagcggccggtcgtcgtcccggaacttgatcgacgccttcatggccggccacctagggttagggtttggtcgatgggggaattcgccggatttggtgaggttgcgggaggatagcggcagtggaggtggggaattttgaagtgcggaggtgagggatttgggggatggggcggaggtcgtcacgccatttcggaggagggggcgtcggcggcgggattgaattgtggggaggaagcggaaatggaagggggacggaattgggttggatggctctctagctggatggaccgtttttactctccttccttactccctttcctacctgtaataagtttatttttagctcctatgtttatttaaaataaatttatttttaaagcaattattgctctttacatttatttaaaataaacttattttaaagtaattattgttcgttacatttatttcaaaataaatttatttttaaaataactattgcattggagtttaggaaagtatgaagttattaaaattgaaaataggtaaaatgagaacatgttgtattgggatttgataaaattgactgcccaaactactcactctagtgcaggtttattataatataattcgtccgtttcatataagggtttttatgtttgtttaagttaaactattttaagtttgattaaatttagaaaataacaataatatttatgttattaaatgaaaataattattgtgaaatatatttcataatttacttttttatatagcatatgataatatttttctcaacaaaacctggtagcacttataatagtttgatttataaaaagagaaaatccaagaaatgttagtgataagcacccaatttcaagaaaatgtaatcgataagtatgagttctgtaaaatatcattgtataagcgacttttctcagaaatgtcatcgtcgaccatccgcgttgttaaatacatcattcatcctatagcacttaacggagggctaccaacggaatcctaatgatgatggtatttatagaacaagttgtttgtacgatgacatttcatgacactcacactcgtcgatatcatttcttgaaattgaatgattgtcaatgacatttcttagacttttttttctatgaaaaagatatagaatcttttatattttagaaacatatatgttcataatccaccgtttgcgaagcaaattcttgttttctcagaagattattttcgtaataatccacatgtgcataagttaattgtttagtttgttgttttggactctaccgtgcacatcaccaccttcttagttcgtgagtacatccctccatgatggtctaagaaagcctaatgacaggtccagtcattaattcctgatatggcctttaggcccaaaattgtactctcaaatagtcaaatctaaatctcattattatttttttccctataaaccatccatttttcaaaccttggccatccaactgaattttttttcttgggtgaaaaactgaaaatgcattacacggtgcagtcaaaactggcctaacatcctccaggaaatcaatcctaaacaaattatccaattgctaagcataagctacatttacaaagggatcaacaattcagagttcaaattatccaattgctaagcata

SEQ ID NO: 69289 - DNA, 22147 bp, Oryza sativa
tccagaccaagccatcttccgctttccacaccccgtcgtcgaagttgcgcgcgtagctgtccgagtcgtactcgtacctcgccggcgcggcgagcctcctcctcggtgcgcgccgccgccgccccgccgcgcagtacagccccgcggccgccgcccgcctcaccgccgcccaccacgccctcgccgcggcggcggccgccgccaccgccaccgccaccgccaccgccgtgccgtcccctcctcctcgccgccggctctcgcacgccgtcagcctccggtacgcgatcgcacccatctccaaaaacgcgcctctcctcttccgactcgtgcgcgcgtgttttccattttataaactcttcacatcatcataaatgtgtttttccggaccagctggcatgtgggacccacccgtcggggaggaggacctgttcggtgctactccagctgccaggtgggtccaccaccagaggcagtttaataattttattgtgagctctaatccgtgttagtactactgctaaaacaaaagatttgggttgagtttagttcacatcaaaattagaagtttggttaaaattagaacgatgtgatggaaaagttaaaagtttatgcgtgtagaaaaattttgacgtgatgaaaaagttgaaagtttgaataattattttggaactaaacacggcgttgttatccgagatgggaggcatattggcattgtttccggatgcgtataatcaagctgggaaagagcagaagtacaggctgtttgattgcatttggtgacctgatcaaatcaaacctattagtgtgccagttgctgggcttgatctttgttaggaacaaaaaaggctgggagatgaataataataataataataataataatatagtatcagaacaagttcttccaaatcattggttatgaacggcaatgctttggatttcagaagttggcatctggtaatgaggggccatgacagcttcttaacagcagccaggattccagactacagagtgctggaataccgacacagtatcacaagactagttctatgttctggccaattagacaattagtacccataaacggatatatagctgctctaattggcaatcacctgttaacaacatagtagctgggatttagtagtaggcatcaactggcaaagcaagcttccatgatcttaacctgattgcagctgttaagggaactacccccaaaatgcatacaaatatgaaagtatgaaaggcatgtagccaaactactatggatattttactgagtttacgcacgtttcagaattccctgtacaaaagaatccaatttgaaacaaaataaggttttaccattaccatgaatctgtcttacacaactacttctcgatgcctaagttcatatctcatttctttgccttagagaaacgaaggcacctgtacttttcaccgctaacagtgatctcgagggcaccgtcttggttgtcctgattcgaagcagtgcccatgagcacgctcttttccttctctaagttctccttttccatcttcagccttgcctcttgccgcgcaatctcagcctgtgaaacatgcaattggatcaagtcatgctgcaggtcaagcatagttcactctatctgtcaaaacaagtttgtcatttcatttgcgaataaataaatatgagtaaaatcatcaagcatagttcactcttatatgtgaaaacaagtttgttcaagcttcaaaccatctgaaagaggaatgtgttctcaacttattatttctactaatctggcaaagatataatggtaacaggtcactctgcactaatacagggtccaaaatcactcggcatgacaaattgacaattaaccagaatggaaccaagtgattgttttggataggcaagaatcaagtgactgggagtttaaatttcccctatcaaataggattaccttattacagtcagaacaacaacatttaacaaatctcttaaccaacaacatagccttccatacgcaaaacatttatccaaatgaattaagatcagaatccgccaacacagccatattgcttatatctcaatagtagtctctgaatggaactatgaaaggattcagccatttttgggacttgctgacacaccataatcgatggacaggaggagggtaacatactgactactgagacaaaacgacatgataataggaacgccaacaaaacatgtaaagaagaaacaagccaaaatgtatgcaataaacttcggttgacataatataattcatgtaactgtacatgtcatgtgatgaagcaggtatgactattgaggaaagatcccaaatgtaccacgaactaacccacaggtctagattatctaggaaagattttgttctctcacaacatgattcaaacctattcatccttaaaaattgaaaccttgagaaggtattcataaataatacggcaatcctactcatacactctagtctacatatgcatattcttcacatttggcagcagttccaccaaatgaaattcttcaccattagcagtgtagtcagattcctatcggcataggagctaaactactgaaaaaaaaaatctaataaggcattacatccttgtccgcttagttgtttgacttgtttttaagccaaaaactgagaaaagaaaaaaaaacaaagaagaaagaacaggggcggatttggagtgatgggggaagcaaaggaaggggatcatcaacatcagatcatcaccgacctcgcggcgggagagctcggccttccaggcggcctcccgctcggcgacctcgcgctcccgctcctggatgtagctctgcatctcccgctccttcatgacgcgatcctggatgtccgcgtccagcgcctcctgcagctccttcacgaacctgtccaccaccgccttgatccgcaccgacatctccctcccccgcacttcgccgcctcgccgccgctggcgccggactccggcggctgggctagggctccgatgcggccgcggcgcggcgaaattttcgtgggccgctcgtttcgtcgtgggagagagcccagcctctgctgagtcagcaactctcctgggtccgtacgctttcgactgcgaaagcccgcagaaaacgtattccagaaaaccgtaatcatcaagtgaacacgtactctttgtaaacttgcaacaagccagcaggatgaaaacggttgggaaaacatcttcgtccttcgaccattttagtaaccatacttttctcggaaacagaaatggtttagaaaaatagaaaatatcaaaaaatcaaaatcacatatttaatttaacatggctatataatataaccacataaattcatttctatttttaccattttcattttcctttttcttttaccgtttccgacggtttggtaggtacaaataagaaacgggctttagtcggtcggttgagaattttcgtgactattttcatcctacctatgacctcctttgaaaattttcatttttgaggattttggtagaaattgagctaatttctaatgttccaaagaatccaaagtatcagcatctgagatgcggcataaaagagatgcctcttctgttggcatgtccttgccaaccgaaaacacatgatctcccaacttcacagacagtcacacaatgcaagacatacagtgacaaatgggttagcatcagcaacagagaaaaatgaaaaatgtgcagaacatttttcagcttcacacagagagagcataccagaaggtaaaagaactgagccacaagctaaccgcaacatgccaacatagttacatagaagcaatgagctttttcatcggtgtctggaagataaaaaaacaatttaaccacctaaataacacattgagtctagtctccaatagtaacagcacctacaccagaagagctagctagagatgcaacggctacagttttcttccctgattcaggttcagacattacactagataggggggctagttaggatccatggcgtcgcaccggagtacctcgagtaccaccgccacgacatttcctttcgcaagttctacggcggtcagacgggaccaaggtctggtcactgatgatgatgaggaggaggagctcacttccaggataagctgggtagccctggctggccatggttgctggccgtgacaccttggttcagcgggctccccgggccgcccgatgattcactcaatgtgccccttgatggcgggctgcttggccccgtcccgctcatcggcaccatctttagcggtgcagacattgggtctgaaggagcatgcagctttggcccctttttcccttcggtgttgaagcttcccaccacaatctgtggacacaggaatggtaattgttcattatacatagtgtgtaacacataattgttcattctgtagtagtgtgtcacacactttagaagatagaacaacctgacataagctacagcttcaaaagtaaatattctataaaaaatccaaagatgtccacctagcatcattcagataatatttccttttcgaaaactacatgaaagccaaaaaacttcaaaggaagtccaagacaatgaatgaatttcagcaaaccatatactatagtagttagtaaaaatagacaagatcataaaactataactaacaaacttacatacagagagattttctagaagtttatggttgatgtaagggggaatacctgcactggtgaagcagctgtcagaagtccagcaactccaccacccaagacgcgaccatcagggcctgctagagaaacactgagcccaccagttcgactacgatggcctccattctctgatagaaggaatgaaccggacagcgacagtatctcaaatcgtccctgttcacagaaaataagaaggtttcctggtttattcttcaacggaggaataagaatttccactgtggtaattctacacaaacctaaaactcgagctagataattcattaacacccacagttttaccatatacaaactcttgtattagtatttacagcttatgcagtggttgcatttgatgttgaaaatagattttctcgatatcttctgacggtcagaagcacatacctcgtatgttactgttccaccggaagtagcagcttgccgaagtgtcacatttgatatggcgccgtttgctgacagaacgcatactccacgagttccatgctgggagaatgacatgatctttgcagatacatcctgaaatgtagaattcaagtcatttccaattagaagactgtccatatttgatttctgcacccttatccttgtatctacacacaaccaaaacttgccaagtgcttctatagcatataatcttgtgatatgtaaagtacaataactaagataatgggtactgtagttaaaaaaaatctgaagatctcacaagatagaattccattcatacaccatgcataaagacacagctcacccgtagaaatgtaaaatggaactatgttagcatgagaccatatttttttcacacatttaattggaattaatagctacaagataaaaaaatgcccaggtgttagtatgtgctcaagtgacaataaaaaccagtaatctgatcaagacagcaacacaatcaacaacaaccaaatgtcctatgttgcatccaaaagcaagtagatggatgaaaagaaaaaaacagaaagcaaagactgaacattgctttacctctccagctttaacaaaaataacatgaggtgtgaatccagctcctgctgaccctgcaaattgcaattcaaccaataatgatcaaacacatttactgacctcgaaaagaagtgaaaaagacacattccaaaacaccagtcataaaaatcatagttcagtaatgtaacagctaaagagtaaccacgaagtggcacaaaaattactgaaaaaataaaaccaaactttcctattcaaattttgcactaaagaagggttcccttccatgctagaaacaaaagaaaaggtttcctaaccacttaaccaataatctgcatacagtaaatcatctcagatctagtaaaaacagccagcaaaacctgagcaagtgcagagttaagtactcctgacagtaactttttatcctctaaacaaacaataacaaaatgaaaaaccaaatgagtttcctctaaaacttcatctcctcttcttgaacataacaaaataacaaaaaatttagcaaaaaatggaatagtattataggtttagagatatagtgatataccgatatctccaattccgaaagagggcacgtgcttcttgttcgtggagccctttggccgccccctcttcttcgcccccggcggcggcgccgacgacacggcgtccggcgacttcgcggcagccgccggcgagaaaggcccggaggccgccaccgccgcggtggacacgggcaccaatgccagcgacatggagccgtcggggccgtacttccttggccggccacgcttcttcttgaccaccggctcgccggcgtcgagagccgccgcgccattgcctcctgcgggcgggtacgtcgccgccggggccggggccggggcggagttcaccggagcgaagatgggcgtgccgtccgccgtgtacgccatgcgcacgctctgcatgccgccggacgacggcggcggcggcgcaggcgccgccgccggcgggctcttgggcagcacgaacggctcccttcctcccgccatctccgacgacgccctcacctgagtcacctccatcattcccacaccttctctcgcagaagctcagctcagcagctcactcagctcagtgatttcttggaccgaaatttcaaggcgagctgaggaagaagacgagagctgcaaaaaccaccataaaccccgcgctgctcaaagctgtggaacaatttttttttcaacgattttacagcggaaggatggtgatttcttggaatgggtgagaaggaagctcaaatgaggggagaaaatggaaaagaaaatcggaggaagaaatggtaaacccacaatttcccaaataaaaacggaaaaatagctggaaggagttttaaaatccaaggtttaatttggttcggatttagcaagtgagcactgaaacacagatcccagctcgagcaaagtaagcagccaaaaattaccaagaaattaccaggaaattagggacactagcgagtacttaagaacaaaccgcaagaaaataatctgaacaaaaaaaaaaaggctagagcaaagcttgcaaagccttatgcggaaagatggaagctcaagagcactcgcagaaactcactcaaaacaactcgcgaggagaggagagaaaatttagggatttcgcttgtctcctacgtaaattcccctaactcgcccgcctctccaatttttctctctccgttttttttttccttctctttcttttcctttttcttaacgcccctactagcacgtaatctttggggaacaaaaaagaaaaggttttataatttgggaaataaaaaatgagcaggtgaggtgaagcacgtcaggattgcattggtaaagggtctaccttatttgaccccaggggactttattttatttactttgtgtccttcctttgctcttggctttatctgcttatgtatttcttcttcttttttttatcttcctcttttgttctgtttgtttttcactgtgctcatggacctaaccaaaaccatttccaatctgcccacaaactccagccaagcacatgccaactgtcttgcaacatctcataaaacaaaagagcatgccttttgaagttttgttttgaacagattcatattgaggtgaaaaacatgataagttgatgttttaaactggtatgtcattacatgtaaatatatatgccttcacatgtacactttgtatgcttgtaaaaatacaggaggtaatatttaatattttttaccatcacatgatttaatatttttatcatttaattataaatcatatggcatgaaaaagtcacgactatgagaaaaaaaatccaagaatactaatgatgacaatgaaatagggagcagtagtcgcacatatcctccttagaaaccactatatctcgtccttagatcctatgaaaataattgtaaaacatagataattctaacatcgttgttgaccagcagagttatgataaaaacatggttataacaacaagatacaataatattatatagtggtgagataagagatacctagaaaagtctataaatattgtattagtgatttctccgtaacatcccctgcaaagtgaaccacaggtttctatgacactacaaagtagatatgtagtaacatagattgaaatggaatttgctgggagagatgaagaatgtgggtggaatggtgaagtaatatagtgggatgcgaatggttatatatcatttgaatctttcagtttgttgatttacataaccaaagaaggaagctcttaacccataagctttgtaccaatcggatatgtgcaaccgttacgtattcacatattttttattaccctctccctatttcaaaatagcagtatgtgaatggatatatgccatatgaacgtttcgattttatcgattcaccaaagaaggaagctcataacccgttatttgtaccaaccaaatgtgtctagccattacgcattcatgtgttttagtaactgctctatgtttcaaaatagtaggatgtgaatagctaaaaatcatttgaaaacttaaaatgattttcgctcattaggcattacacattcatatgctcattaggcattcgcttttctgagcatccgctctcgatttcaaaattaaaacagaaaaaaaaatcgtgtggccaatacattttgttttccaaaaaaatattaaagtgaaaccatcggagtctgtaattgtatgaactggacaaggcacttgagattcctacaaacgcaccaattctttttattttggaaaagttgttgtgacataataaatctgtaatttgtaaaatcaatactcttcaaattaaagaagatgaatcaccaaccaagttatgcagtcctaaaaacatcattgatgtagtttcctcctcacacataacataatcatagtgtgtagaccacaaagaccattccagtaacgaatttacaaggaaattctagcctgagccattctagtattttgctaggtgacacaaaaaaagaaaaaagaaagaaaaagtcggcaccacaaccctggaccaggtcaacaaatccggatttaatttttgatgaagaaacgaaatcgaaataggacacggcatcattaagtcgagcacttttattcccctaaagatccaaacacaagcagtaccaattgctaggcatggcccatttttgcacccaaaatttctagcttttcttgtcccatgcaatgctccatcttcacggcaaagtaaatggagtatatttacatgaattttctcatgtccatgatgctttgaaataattgcagtcactagaggaataataattatttggaattaccaaaaagaaaaagaaagaggagggcctaagcaggagagattgagtgcctgctaagaattagcctgcaaatcgaataaagttctgcactttatttataccaccactctttatcaaacttgtccaccacgtgtcgtttgcatcgtccttatcgccgtctgtagattttttcattctaaaaactttaatttgtttactgtttgatactatcttcctcttaatataaaaagttttagagttaaaaacgattattaagaaagtagccaaaggccgtgtttagttcacccctaagtacctccaacttccaattttacacacaaccaaagttaaataggaagatgtgattggttaaaaagggtaggagaaaaaaatgaatggtgaataattataattggttgagaaataaatattggtgaagaaattattatattttaggataaattttaagtgctagaaattattatattttggaggcggaggaagtaactatttaatccctgtttgacgccttgacgttgtgagatgggctgttattgttgttgcatatatatatatattgccgtccaagctctagactgatcccataatacagatgtgctatgctgagaaatcgcaatttaggtactggtttggattatcacaccagtctgacatgacaagtaattgtttggaatatatatattagtatttttttcaacataaataggcagttgagatgtaataaatatttttgttcaaaatagtaggatggtacattgaggaggtgtgagtgtgacagaatgagctccatctgtacagagaaaaattaaagcagagtgacttcactattttcagttttgcaagcagtgacttcagctaacacatttgcacgtattaactgcattggtacagaaaaatgaagatggtgaatttatttacgtggagcaaaacacggagaaaacgatgaaattgtactggatgcatctgcaattctgcatcctgctgacaccttatcactggagccagcaagaatatactgaacttttcccgtgaaaagtgagaagaatatatcaatatactcagtgtttatctgtgttttccttgagaaaaaaaaacagaaggaattcactacaaaatgaactttgaagcaagatggacgtgattattatgatcaattcatgtataaaaaaattcatgtcagtactcatattcccaaaaaaaaaccaattaattcagataatttatttggctgggtacacaattcagattaattttgtactgcagggattagctaagtccaagctaacataacctaacctacttgtgaaaactaacaaaatgctcaacaagaaacaaaagacaaagaatgttttttttttcaataaaactgggtgaagaggatcactcagaattaatatttgtaagtgtcataatcatctttagatacatacacattaattcactgtaatttctagtgtgaaatatttctcttgccgaaagcgtgcaaccattgcatactgtgatgtttgcgtgcacttattgaccacttttttcccataataaacagcaaagcaaagtgagaacaaatgagcattgtaacttgctccaatatattttttttcttgatggccatacacgccatccttttctctttaatacaaaaaacaagccgtctattttcgtgtatcttcaccttctgactttcttctgttttagtgcggccaagcttatccatgagatagaaagaaagaaaaagaaaatctttatcaaaagtaacccttgtaaaataaattttcatttcttgaagcaagcattgagaagaagataagaacaagatttagccacaaatttccaaggaaaaaaatatcttcttcatgctagagaatggatggaatctttttgttattttaacatgctaagtgagagacgacagtgagtagatgtgtggttctaaatcctcctccactgtggtgtggtgttgttgccttgcaaatcaattattggtggggaaaactggaaaaggttggagaaaaaacgaccacttatattgactgtttctcctgtttatgttctgaatatttttctgaagaaaaataaaggaagggtgtgtttttgtgtctagggggtatgcacaattgcgcatgctaattaggtagtagagcattttctcctgttaggcagacatttgttggaaactatgtacttattgacaaatactagtgtggtgacacactattgagtcacaccctcatcaagaaattggtcctattaggtaaaggagaaaaaaaatgctatactcaattaaagtgatatgatattgttgcttcaattgagcacaccaatagtgtagggacttatggtggagccaattggcatgtcaattccacacatataaaaataaaacaaaatgcattaatgcaatacagcaaactgtaacagtcttttatgtttagaagaaatggacactcttttaagtagagggttattgtcaaatcacaagagaaaggaaaaaacaaaagcatgattactactggaaaagaaggaaaggaaagagaaagggaaagcagcaaggaaggagggctcaccccccatgtgagcttccccctgaaatttgataaattccacttatctttttttttttcacaacagccggccatccatgatggcttttggagccttgtaacctaacaatccgttcctgattttaataccactagactgctattacatatctcatttgaccaaattaatacaagctcaaatgcgattattgcacatgacacaaaattaaagcccttttagtttgttcatctgcaattttgtttgctcatgaactgtaaatttatctacggttttacttttaacctcaaagttttgtgttgctgctttttctgctcgtgagctcccggctttttattggtttgtcggtgtaaagatcaatcatctttcgacaaagctcccaacaaacggtacaatcttcgtttcacctagggagtatagactctactctacctgttactaaatataaatatgtacaggaatcaaatacataatataaatatttctgagacattgactccattatacaggaatccaaatatttttaggcaatcaggtgctcagtagagaaatccaagcaactcaaaactcaaaattaatcaataagataaatgcaatgaaatcttttctatctatcttaacgtttgccactgagagaggtagctaggtgggtacgtctgtacccccaaaatgttttacacaatactagtatataattttaatactgcaaaaatgtacttataattcatacacaaataagagctattcaagaaaattaaaaagtcatttgcatgaagaaagatttcaactttcacaaatcaatacaatatatattagtttgataatttattgataaatatcactattttcttatagcgccaccaaatcagagtttgaacccatgacgaaaatcctggctccgccacttatttttactactacaaaataacctataacctaaaagtttatatttaacacagtagctgctgaaggagtaattaccaccctgactgaagactccttgtgatcatctgctccaatgtgtttcaatgcggccaacctagtcgtagacactcctagctaggttcaccacttcaatgaacatctttgacagagagagagaggccgtgtttagttcacccccaacttttaactttccatcacatcacatcacatctaaaactttcttacacatataaatttttaacttgtttttttaaactttcaactttccctaaatttttagcttttttcagagactaaacacagccagagtagtagtaaatgcgagcggcagtgaagagggcagtcgcaagtagcagcagtaatgaaaggcgtttccaagaggaaaaggatgaacccgtggatgcaatcactcatgagatgagcaacgtagggccgtcgtcaatgaatgtcctttttctccaagtcgccaactgttttctgctccatcgcctccgatccggggaagacagtacagtacagtacagtatagttacagtcacaagccgccgcaagatcgtcgtcgtagtagttgttgtttcagtcttcagaggccatgtgagtgtggcccaattcgagttagatgaaaataaaaattaagattaagctgaagtaatagtatgcagacgagaaagtatgagttttaattattacaaacttaaagttgaatttaattgataatttaaagcaatttttatatagaaagttttttaacgaagcgtattgttcagcagtttgaaaatcgtgctatagaaatcgagatataatctgcatctcaatcagaaatgaacgggtaacgggtatatgttactactagatgttaatcgaggatttgtccggacctctgtaaattccgaatgtccttgccggatctattcgtttattcctgctacgtttctaaaattacaattttgaaaaagaaatatttgtacgaaatacattgcttagacccttagttctaaactactcgtccacttcagattatctgtcatcctagtattcagatttttttaatcaaaatatcacgttccaaagcattttttggtgtgaagcttgccaaacaacaaataatctgaaacgaaaggttgtacctggtaggtttataatttactctccccttccacttatatactccatgatgatagttagatcatttttgaactaacaaacgtcgtatataaataaaagaagggagtataatgtttatctattttataaacagatcgatcatctgttagccatcgtcctcatttcaccttagaaaaaacatgcctggaaggaatagactgatcccacgcaaaaaagattaaaagaaaataaaggaaatgggctgatggcctgatgggtagaggaagctgcaccgcaaacctgcacttgtttagcccaatcagacaggtagctgtagctcactccattagtggatagaaataagtccacttggagtcccttaattataaagatccataaccctaaaccgtaataccggatatcttgatccatccaactattaaaaccggtgtaatttgactttctcgatggttttgagagtgcttttcattgacatggcatgttgacctagtccgacttgtgctgacatggcaccctaatcacaaaatggaagtgaggcccacatgtaagtcacaaagaagaaaaaataaaaaattgtagggcacatgtgttagtccccttctccactctctagtctctatcttttccccaaccatagcaatttctcccacatgggcggcgcagctgcgcaaccacgtagctcaagtctggatccggcggcctcgtcctagcatcgtcgccgccgaagaagggggagggatccgccgcagcggtggaggatgtggtcatcaggcgacgatcggcggggagcacagcttgtggtaagagtaagtaggggtgaaaacggtacggaaacggacggaaacaacctttatcgttttcgttttcatatttttttcggaatcggaatcggaaaccccagaaacgaatattatcgaaaccgaaaacggagcgaaaacgaaccggcgcggatacggtaacggaaatttatcagaatacaaaaacccctcaaactgagcttcaaacttttgtcaagtccaattctcaagtctcaacagtcaacaattcatcataaaacacaattatatgaaatcgtcacaacagcaaaatatattcttctataacttcatataatttgcataacaaatatttaaaaaaaaaattacatcaaaacaccctttataagatatatagtatacactattattcagtgctatactgctaatctgctatgagctatcactccatcatcagtacatagttcatcaattgtttcggtcatcacacaacagcagcacacatcaatccatcagtacagtacttggatcaatcacaaaacagctacttgcatttgatgattccatcataaatctacagcacaaaagaaatcaaatcaatggtttaggctcgtcggctcgtcgctgggctgctggctgctgccgctgggctgttggctactgccgctgggctgctggctgctgcgactgcgaggcgaggcgtcgtcggctccttggtgtggctgtggcgtcatcgtcagtggtggtagcggcggtgaaacggtgggacggcgccgcggccgcgagacggcgctacgaaacggcgggacagcgtcgcgagatggcggcggtacgagacggcgaagacggtaggggcgaggtcgcgaggagccgaggacggcggaccagcggtgggcgctagcggtgggcggagcgcaatgcttcgccgccggctcgcggtctcgcaaagttgcgatgccgtgtggctgtctctctcctctagggttagccactatttgggtagatgccgcgatttgggttgggcttaaaacttggggacgagttatagactattgattctatgggcctttttaacttcggaaattccgataatttttccggaatttttccgaccgattccgagttccgacggaaactgctattatcatattcgattccgtttccgagaaaatatttccgttttcgattccgtttctgagaaattccgaaaaaattccgaccggctgattccgtttccgaaaacaggcccggaatccgaaaagtttccgtaccgttttcacccctaagagtaagaagggggcgggcagcctcaccctggcatcgtcgtcaattgaggaggtggagggattagctgaggcggtggaggatgcggtcggtgagtggcagaggatgcggtcggtgagtggcagaggatgcggaaggcaggcagcatagggcgtggtcgtcgagcgacagtcggcggggagcactgccagtggtaggaggaagaaggtacaacttctacagtggccactgctagataacaccgctacgcgaggctcgtgagcactgtggcagccatctgccgccccctcgctccgaaacatcgggcggcgggggaaggcaatgctcacactagaggaacatgcggaaaccaatggcaaggggcaacgggatgggtcaagggagagggtgggactcgtcggtggggggaggagaagtagggaggagcagcatgcgtggaagacctcaccagagcacgatagcttcctttttgtgttcgcagatccagtgggatctattctctctagctcatgatagtggacgagctcgaggagacttgccaaccgacggccaccacccaactccatcttctcgtctccgtgcgctagtccctccgtcctcccacctcccatgccacgccaccggcaggcgccacggcattgagctccatgatgacggtgcccatgaccatgctactctaggcgaggggcatgctacggcagtggacttggtgacggagggctcattgtagccgggtgcctagaggactgccctaccgtcgcccgccgttgccccactacatcctgcagatgctatgtagccgagaggaaatatgatgattaaaaggagacataagcaaaggaagagaagagtcactaacacgtggcccccacatgctgactctaacatattggactaggtcaacgcaccacgtcagcaaaaaccattgaaagagtcaaattatactggttttaatagttgggagggtcaaattattcagtattatagtttagggatacgaatcagattggacctgtatttaagggagtcagagtggacttagcggataaccgtttctcgctggatcctgggccatcccggcccggcccaaatatcgattaatttagccaaaatgtggcggcaaacacacacgccgaattacagatagtaatacaaatcacaacattatttgctcggaatgagacaacgaacacgaacgccatgaattgccttagctagatgtcgcgttgcatcttctccagcgacgcaaatgcgatgcagcagcagccgcgccgccctctcgccggcgtcatcttgcccggtcgcttcatcctgtctcgccggaggaacgcaccgtacgtctcgccgtcgtcgtctctgaaccccctgaaacctcctcacgccggcacgcggcgtccgatcgatcgatcgatctatcacgacagcgtccacatgaagaacgccgaccacaccgtcaccgcgacggaggcgagggcgtacacccacacgaagatgacggagcactcgctctcccccacgccgaacagctgcgtgatggtccctgaaccaaaaacacacacaccaagattcagtattaattcttcagttgacatgaagattcaagatgagtggggtaagaattacgatttgccccttcgcgctacagtgccaccttgaaacccacaaaatccctcgtctttttcgtgggttctagggtggtaccgtagaacgaaggggcaaattgcaattcttcgctgctacagggggctggctgtaaatgtgttgcctacgtggaatgccacatcggcggtcagctccggtcaaataagatttggacctactatagtccattaaaccaagatagtagaactaaatgtgcaattttcaagtgtatggatctaagtagcatttgctctcaagtttaaggaccggccatgtattttacgtattcaagattattccattctttctttcctaccaatgttcatcgccggcggcacggcgtactgaagcaataggatgaactggtagaggggatcagggtggatgaggcccaggtgaaccgccgatttgacgagcaaggtgcctagcgaagggagaagaatgtatctgacgacgattacgctcgctatcactgaaggctggacgcttgcttctcctcgtaatcctggaaaaaaagagttaatgtttcaggtcatcagattaatggcattgttcttttcgtcagtaaaatgtactggtatttctgtcaggttgtttagtgtgagaatagtagcatgcttaccattgaggaggttccctcccattatcagtgtgacagatggaattgctcctccactgtgcaggaaaaaaaaacacgtaaaaatgattagagatcggagttaatccaaaaggacaaaatgaagagaaaaaggcagcattatcattgatcaataggatttggaacaccatgaagaatgttcagaaaacaatagaaatgatgtggaggtgttaccctattagatcagctgactcatgaatgacacgaagaggagcgttttctccgataatagcatttctaattagaggcgttcctccaattataaacccaataatctatacaaaatgaaaaatgatactcagcatagttttataacacaatgttaaagtttgtaatactcagcataccacagcaatggttgaaggagcaaagatcttcttgaagtcaattgctccgaacattgatgatacaaatcgcttcgctctctctgacaatgtgacctatgaaaatttaaagtttataattcaacaaattgtcataacaacattgtgcactaaaacagtgtacaacttgaacttgtaaaaggtaaatatttcttccagcattaagagaccttagttttgcttgaaggtacacttgaattggatatcaaagggagtgtgcattgattgttatcgtttgggattgataaattctcttctgacgctgttcctgtactgctccctgaattggatacttttgtatcatttgttcgagcattaccttcatcagccacttttgaagtggctcgcataatgttatacgcgacagtccacagaaagacagcaccaagctgcagcaaatcactgacgattgtgacaccggtgttcttaatcacaattacagctcacaaacataagacagttgcatcgactatctgcagaatattttagatacaaaaaacagatatagccttacagccattgagagtgaagaatacgctaatccataagtgtgacaaacatcaggtgctccaaacgggcttcctttctctttgcaaagagcaggaatgatgatgagaaaaatattgccccaattgcctgcatccaaccaagggaaatgatcaacgttaggcaccggaagaaacaaaacgagggttgtagtattctaaggtgtgattattcaagttcagttagtcctctaaattgtcccattcaatgttatcaagtatcaattgactacagactcttagtaaggtgtaactgtccaagttcagttagtcctctaaagtgtcccattcaatgttggcagaaaatattgtacaaataatgttataaatcctcgacatgttcaatcatgatcttgtcctaagatctcctttttgttacatgtacggttcaagtccagcagaggtggttggttatcagtattatggctagtacaatggtccaacaggactacctgatctataccatctgaaatataaagacagccttgtctgttgtactcatattggctgatttgaattgtgtcaataatggcctagtgggatgctgggacaccttaagattggatcattggactggtactggtaatgacttactgtatacatacaattgattctcagcttttccatttggttatccatgaagaggtaatgtttttgacaatgacacttgcatgatgcgttgcatactcagattgacattgatttgtagtagtactataaactccagaggaataaccaacagaaaataaatataagagttttataactataagtggagctttgcataagcatgagaagctagcacttcataaagcaaagagttttccacactaacatacatgggcccaaacatccacacaataaatatgtatgtgaaggatttgtactatgtttatctactataagggcatgaattttaaaagatatgtgctgtcgatttacaagagcagaggaactcctagttaccagcagaacagcaacccaaaatgaggcctcttagcctagccggtgctctggtgacatgtaccacgatccatccaaggattaacccaaaggtacaagcaagaagaatattcacaggcatgaaccacctgcattgtgggtaaaaagaaaataattgttttatttcagttgttcaatgacagtttggcaaagaaacatgggagacttacaatttagccaagccttccaatgtgattgtttgtgctaaataggtcgcaacaagagatggattaaatacataaaatactatctgcaggcaaaaaagtttatttattcagagatgatgtatggcttgtattagcaaaatatttactacaattttgcacaattgaatttaccccaatcaccacaacttacattgtttagatatttccgtgcatctttgttcagtatgccaacaaaatcagttgccaggaatgatccaacaccagtaaccagaagcatgttcagaaccggcacacatgctgtaataaagagctccaggaggcccatgattgttgtagcttagttcaacaagcagtcactgttccctgtcctgaaaagtaaaaccatcaaacatgctaagtgcatcgcaactaataatagttctcatgtttcatgtcgagaaatgcgtatttgatcgtctaaaagataaacttctaaaataaaaaacgtttttttttgctacaatgatgagaaaggaccattattggaccaaatgtcatgtccatggtacagagattgcaaattgtacaactgttttacttcttccttgtctccaataattctactacatgcgaaaccaaacaagttttacttcttccttgtctccaaggattctactacatgcgaaaccaaacaagaagaagggcgaactaccagtctaccacaaggaagaaaaactaagggctagaggataaataaactaagaagttgattttttttttattttttagagaagggtattttttacccggcatctacatccaaccggatatatgcggccatttaaattaggaacttaaccccgcaaacaacttaatctgaaattcaacccaatctgaaattcgcttctatggagatttgaactcaaaaccttaaggtactgctcaggtcactgcaaccactaggctacaagaagttgatgcagcgaagtatcacaagattagcttttaaaaagagcaggtaactgagattctcccaaaggagaagaacactacaggagcatgtgaaatgagcttcagagtttcagacttcacatggtttcgatccacccctatatcgatatgctcatccatgcaaagtgcaagatcaaaacagctttgaactgagtcaatgcaaagcgcaagatcaaaacaactccaaggagtcagtcaactgtacaaaatactagagctcgactaccttatctctaaacgacttacagaaacagaatcgggagaatagggaggaatcctaaattcctagcctaattcatatggaaacttaattttaacaaactctaacatcaactccaagtgcatgcagctcattcgcacagccgtgcagcaaatgccatcagtagcctgatctgatcgtcgccgacgatggagcttgcactgtactatactatttactgacaaactaaactgtagcttacatctgccaatcatctagctctgactgatgactgatcgaatgagcacactccaatagggagagtactatagctttgactgaagaacaatttttcttcttctgggctgca

SEQ ID NO: 69290 - DNA, 1018 bp, Oryza sativa
attccgagagaggagaagagccacctggccgataccggcggagctctgcgccggcggcggaggtggcggcggccgaaaattccgtggccgccttttcttctcttcttctccagctcgggctctcgagggtgtggttctgaggcttttctcactgagattatatatatattgctcgttcgagttcaaagtcgtcgaagcttgtcttgaagtgtgggatcgatctccgcagaaacgtgccgtgtatgcgtgccggtgactcaaggagggttcggcttatctgatacaggtgattattatcttgatatcttgtcatgttttgtcttttattagtattgatattgttgactttttttcatatgaggtttgtccatttgcgtcttattattactccttccgtttttagctagtcaaagttatattaagaaagagattaaaaaatactatatatatgtaatacgaagagaaaatgagaaacttaagttattggactaaaattatattatttagagacaaagatagtagtacaaaagaacaatgtaaatactctatttgtccaaaaaaataataattttatctttaatcataggtgttcaaaaataagatagagtaaaaaaattgtctctggtagctaagtgataggtaagggtgtcctgaaagaataaaatttatcgatttactagtcaagggtagattaaagggacgagagcaaacttattttgggacaaagcgtagatgctaagttatttttgggacagagagtactgtctattttgttgtgacttgttttataattaaatgtattttacatatgacttatattcttattatatattttctttgaataaaatgaatgactaagtgctcattcgaaatgcaagtttgaaaaaacataagaatatcattaacacaaaactatgctatgaatacatatacagaacatgaaaacacaagaatcttcgaatagagattcatcaagcaggatcacaaagctactcaagcgaacaaaggaaatattatt

SEQ ID NO: 69291 - DNA, 10939 bp, Oryza sativa
  unsure (1)..(10939): unsure at all n locations
ccccgaatcctggccgagcacctcgcttccatctttggcacggagaaggaccgcgtgaactgccccttctacttcaagatcggcgcgtgccgccatggcgaccgatgctcccgcctgcacaacaagccgtcggtctcgccgacgctgctgctctccaacatgtacctgcgtccggacatgatcacccctggaattgatgctcagggcaaccccatcgaccctgagaagatccaggccgacttcgaggatttctacgaggacatctttgaggaactcagcaagtacggcgagatcgagagcctccacgtgtgtgacaacttcgccgaccacatgatcggcaatgtgtatgttcaattcagggaggaggatcaggccgccagagcgctgcaggcgctgacggggcggtactactccggccgtcctatcattgtcgagttctcgccggtgtccgatttccgggaggccacctgccggcaatatgaagagaacagctgcaaccgtggtgggtactgcaacttcatgcacgtcaaggagatcggcagagacctgaggaagaggttgtttgggcacctgcataggtcccggagaagccatagccatggccggagccgcagcccgagcccgtaccattaccggagggactatgatcggaggagctcatcgcggtccagggaccacgacgattactaccgtggaggtagccacgattactaccgtggaggtagccggaggagcagcgagaggcaccgcagcagctacgacagcgatggcagcaggcggcggcacaggtccaggactaggagtcctgtcagggatggtagcgaggagaggagagctcaaattgagcagtggaaccgtgaaagggaggctgcacaagtgtgatctctggattagttgctgtttgcaatggcccatgtttctcatcttgtactggtagccctagattaaattagcatcatatcttatcttaatgatctgagcttggatgtactcgagattttccttactgaacttgaattttctgtcagatgcatgtgttaactgaacctatttggtgttaaattatatttgtactgatggttgtgtgctttcggttttgttcagcattcggtatgtttttgtgcatgtggtcaggactagctgaatggttgagtaaatctcgagtgatcacgatccacaatgcattccccattcggtagtatgctattgtgcatgtgatcaggtctagctgcagtagaatttgttgacttgtaatgataattgcagcttggagcaccaattgttttttgttttcattcagaggtttcagcacgttgcatcttttagcacctgttagtgagatgaaatgatttacaggtgagatcatttaagttatcattcaaatgtagtagttgatcattcagacgtttcagtatgttgcatcagtgcaggtaaaactaagatgcaggtgggaagagcgacgtaccagctatatttctgaattttctgatatttcggatcttttcatttgtaacctctgaacttatgtttcgcatattttagcaccgtgagttgttatgatacactgccgaactacacatcttcagcgactaggagcaagctagcagcggcctcgtccatgataccagtatatgtttcctacaactgattgttccactgataggatatattgcctatttctcatatctcagacaaccgaagaacccacaaagaagacatctactgcaaataacaatcatctgaacgaaagagctcgataacagatgacaggaaaaggaaaaagaaaaatcatgaacaaaaggaacatgagaaagaaatcagggagcacaagcatgcacaacagattaacagcactgcaaatactgagcaagctggacatctgacgaaacataatgaaatatttcgtggatggctcaattaaccaatgagtttgttcccgctcacaatttatcagcgattctccgcccaaaaaagctacaggtatagcaaccctcttagaaacctaagaaaccaggggtgggtaagatgtcaacttcctattacatgaacaaaaaaaggtagaactagatgtagatcaaatctacatcttagcttccttagcagcatcctggtattcagcctcaggagtctggtcaccaccactgctgctgctgctgccgccgccactgccgccaccgccaccttgttgcatgtgctctccaatctttgaaactgccttgtttgcagcctcaagcttctgcttgatcttctccaaatcatcctcagccattgctgctcttagatcagatacagcagactgaatctcattggtgacttcagcaggaaccttgtccttgtactcactgacactcttctcaatgctgtagatcgtggtgtctgcagagttcttcagatcaatcaatgatttcctttcctgatccttctgagaatgtagctcagcctccctcaccatcttctcgatatcactttcagacaaaccgcctgaagactttatagtgatttcttgctctttgccagtggacttgtccttggctgacaccttgacaataccattggcatcgatgtcgaatgtgacctcaatctgaggcatacctcttggggctggtggaataccttcaagctggaactcaccaagaagcttgttgtctgtggccatctccctctcaccctggagcaccttgattccaacctgggtctggttgtctgcagcagtggagaagacctgactcttcttggttggaatggttgtgttccgattaattagccttgtgaagatgcctccaagagtctcaataccaagggagaggggagtgacatccagcaaaaggagctccttcacatcacccctcaagatgccaccctgaatggcagctcccatggcaacagcctcatcaggattgacacccttgcttggtgtcttgttgaatatctgagaaacaatatcctgaacctttggcaccctcgtcataccaccaaccagtagaacctcatcaatgtcttttgcagatacgcctgcatccttcaggcagttcacacaggggatgcgagttctctcaatgagagactgcacaagagactcgaactttgatctggtcaaggtaatattgaagtgttttgcaccagtggcatcagcagtaataaaggggaggttgatttcagtctgcatggttgaggaaagctcgaccttggccttctctgcagcttccctgagcctttgcaaggccaacttatccttgctcagatcaatgttgtcagacttcttaaactcactaaccaggtagtcaagcaatgcaccatcaaagtcctcaccaccaaggaaagtatctccattggttgccttgacctgaaaatggtacaaaaagttatgatcagcacacatgtggtacaaaaagttatgatcagcacacatgttcaacagatatgcttaggtttagagtatatgaacatgcaatgagaaagaaaattacctcaaaaactccattggagatctcaaggattgatacatcaaatgtgccaccacccaagtcaaatacagcaatcagaccctccttgttgttcatcccatatgacagagctgcggcagtgggttcattgataatcctcatcacctctagcccggcaatcctaccagcatccttggtagcctggcgctgagcatcattgaaataagctgggacagtgataacagccttggagacagttttgccaaggaaagcctctgcagtttccttcatcttggtgagaacaaatgcaccaatctggcttggggagtactgctgcccacccatctccacccaagcatcaccattaggtcccctgacaatcttgtaaggcaccatcttcatttccttctgagtctgtgggtcatcaaaagttctaccaatcaagcgcttagacccacggaccgtgttctgggcattggtcactgcctgccgactcgcggttatgccaaccaaaagatcaccattctggttcttggcaacaatggagggtgtcgtccttgcgccttccgcattctcaatcactcgtggtgtctgcacaaacagattcattacttctataacaaagcatggctagttcaatattaaccgaatatatagataccaaactaaaagaatgtaacagtaagtcagaacatcctgttaatcacaaattaattccacacaacaactatattcatcactactatactaaagcatccataattcactaataactgaatgtatcactatccaattaaaagaatatcatgactagtcagaatatcctattaatcacaaattgatccaattcagaatatcctattaatcacaaattgttccaattcaacaactatattgcagttcaagatatgctactgaatcaggcaccaattcaagatatgctactgaatcaggcaccaatcaggcaccaactgttttacaaacaagaaaagataacaaatttcgaatggaacagggaaagaaaaaaaagaccacaccttcccttccataacggagacacacgagttggtcgttcccaaatcgatcccaataacatccgcggcggcaggctttgagctgtacacagagcgaatccaatcaaccacccatcaagcacaaagaagagcagttgagatcgacacaaaagacgactactaaattacctgaacgcacgagccactgatccaagcctggacaacagaggagacgccgccgcgtgacgggccatcggagcctggtcagatcaatcaaacaaacaaaatacattacatgagatcacctcaaccatcgcacgcaggcaaatcaacactacagatcccaaaataatattaccacttcaccaagaaaagaaagaagagcagagaggggtggaacctgagaggcggcggaggcgagggcgtggccggtggacctggccagcctcgacgcgatgagagatccgatggccatggcggcggcggtggtggcggcggaggtggagaggaggaggaggaggcggcggcgagatccggaaaaaccctaggcggggtggcggcgagggcttcgctcttaaacccctcgcgggatgcggctctggcttgcaggaggggaaagaaaggcgcggccaggggcatttccgtcatttcggtggggtcgggttgtgtgactgacggtgggcccgggggtcgggggtcgtggggagaaggttctagaccgcatcttagctctcgataggtggcgaagtcagaataattgtttgaatttgttttttcttcttgcgaaggaatactggtagtagtgtttttcttgatgaagaatgcaacaaaacaaatcaaatgcatctagcgaagtttgatttcaatccgcagatattacggaagaactgaaagaataccctgatcaggttataccgaattcgggtctagccgcttagggtcagatcggtagaaagttgatttttttttttgaaaaaaaatacattttttttggatgctctcaccgaatcgaatagcatgaaaattccgagctctattacatttgcccaatgatgaagatttcaagcaatgcagcccattaaatctcctaggcccagctcaacatttggcccataaattccatgatccatctcactatggccgactttcttgtgctcacttgcaaggcacacgagatgaacctctgctttctgaggcctccaaaccctctcttctctaactgaatttttgtttaccagcattcgagggtctgtttggaaagctgaagattatgaaagaagttgtgattgttagaagcttttccaaacaagatttgctctggtccaataaaaaatatctcgagatacggtacctcacgctaataaatcgtttccgatcattggatctacctggacaggacattgttagatccaacgatcgaaaacgatttggtacctcgaggtaccttttgttggatagaagcaaatctcacccaaattactctgcagctatagaattcagaaaatgaactagaaactagctctttcaaaatctcataagctatttatcaaactgtttctcagaaataaactctccatccgttagttaccgtgctggagttttaagaccataggaattaacacttctcttgaagaagtgctacctgctgctgcatagagcatcagaaatgactgctataaatcacaagcagttttccacggatcaacaggttgagatgaaagcctgaaacggatgcatatacactgagcacaaagctgcatctgaatcctgaatggagcagagcagctgagaatgaggacagaaaacacatttactgaaaaaatgtgtttcagtgacaagttcagtgttcactcctgggtatcaggcatacggtaaacatggggaagccggcaaggttcatcgtctacaaggcctgccttcttgtaggattcgacgctgtcggcgagcgtctcctcaagtttcctaggtttccagcccaactttgtcggtttctccgatgtcaattcgaccttgttgcccacatcaaccaatctgaccaaggaaaaaaaaaacagagagagaggagctgctcaaatcgtgttcatgttttgagcacaaaacacttagggcttgttcccttcgttgagaaaaaaacaacttacaaaactatggtaataccaaattttggtaagttaaagttaggtggtgtatggcctgaggttttggcaaaatttggcaagtagctgcagttacttaaacgagtagctgcagttagggtacatgctcttcatcaaatccaccaaatccttcatgtccatttggtcttgagcacatatgtacctctcacatggccctgacttgtcatacatgatacactagaagtaaagaatcagtgacatcacggacatccactatgggccaaaaattgttgttcataacatcagggcgtcctggattgcaaccaaaaatccaaaactaatttagtcagcgtacaagaggaaatacgtattagaaagctagaaactactccctccgtcctaaaattaattgacttttgtacacgaatctaaacataggatacattcatattcctttacacaaattgatttatcataggacgaagggaggagggtgcctttgagggtgaacctttcatgatgtagaggagaactctgctgctggtgttgagttgcatggtatgcaacagtgggccaaagacaagggcagggcaaactgtaatgacatgcagtccatttttctctgaatattccagggctatctcttcagcttcggtcttggcaaagctgtaccagttctgccaacacaagaatatatttggaggtcaataaattagtccccgaaagataaattaatgctgcacgaagaacagtttaatttgcaatatctgaccttattttctctgcagaactccttgtctgaccagcaagtctcatctctcaccctgtcttgaggccagctcgggtaaagcacacagcaccaatggaggagaccatgacgagtttctgaacaccggaagctgagcaagcctcgagcacatttttggtgcctttcacagcaggaaccatcatctccttctgcatgtatatatgatcaccagctagattgtaagattgtagaagagttattgtacaaatatatatttctttagagaagggtattttttatccagcatctacatacaatcggatatatgcattatttagttacttagccccttaaataaccaaatctaaaagctttttttttaaattggaaacttagcccctcaaataacccaatttaaaattcgtttatatggagatttgaactcagaaccttagagcgccactcaggtcactgtaaccattagactacatgtcctttcacaattgtacaaatatatacttatcggacacgtatcctattcggtgctgcatatgcagtagttgtaactgacacgtgggtcgtacttgcaccaaacccagacccagtgacccacatgtcaatgacgcatgttacgcatatcagggttcacatatcacatatcagtgacacccactgcatatgtagtgttgtagaggatcccactccacacttgcctatggatcaaccgtctcgtcttccggcaccgaagtgccggtatggaagaccccctcgcagccggtgaacgccaccgtcagagcgtcgccgttgagctcgtcggccttgaacaggtgcaggttccccggagccaatgtccagctgcttcagaaacgcgtccctgggatcatctgaaacaagaacacgtataatcaccatacctgacctgacaacaaaggaaaagatcgatgaacataagcaaatatactgacgtgcaattctttttgcgcgtttgcaaaaagccgaaaaagatgaacatcagcaagaagtcgatcgagaggtccatgcctgggtcggctgcaacacaaaactacaaaagtccattgctactgctctgctagtagcatcaaacatttgtttaatcgggtggcggatatattaaaattacacacacaattgtccatcttaatcagtagacaatattcaattattgccaggcataaattgtgtcattgatcacaggctgaatcaattcactaatggaacagagcagatgataatgtggacactggacaggaacacctgatccctcatctattacagtattattggaaactttttttttcagtgacaattagatcaagaacagtagcagcaagacggcgccggctgttcactcctgagcatctggtgcacggtaaagatggggaagccggcaaggttcgtcatctacaaagcctgccttcttgtaggattcaacgctgtcgacaagcgtctcctcgagtttcctaggtttccagcccagcttcttcagcttctctgatgtcaattcaacactcgtagtcatatccacatcaaccactctgcaaaaataattgtgttcatcttgtgatactgatgcaataacctgatgtcatttcagtttctctgtcatgaataggatagttgatgatgataatgatacaaggcaaattacttggctgtgtagctgtagttagggtacatgctcttcatcaaatccaacaaatccctcatgtccatttgttcttgagaacagatgtatcgctcagatggccctgccttgtcgtacactagaagtaaagcatcggcgacatcgcggacatcgactatgggaaagaatttgttgcttagtgcatcagggcctcctgcgttgcaaccaaaactgatggaatcagtgcaccaatcaccagaacaaacaaaaactgtagaaactataaaccattgagaaaagctagaaaacagataccgtttgcacggtatagttaggcccggtttagttccccaattttttttcccaaaaacatcagatcaaatctttagacacatgcatagattaaagaaaaactaattgcacagtttgcatgaaaatcgcgagacgaatattttaagcctaattaatccataattagccataagtgctatagtaacccacatgtgctaatgatgaattaattaggctcaagagattcgtctcgcggtttccagacgaattatgaaattagttttttcattcatgtccgaaaaccccttccaacatccggtcaaacgtccgatgtaattcctaaaaattttcttttcgagaactaaacagggccttaatagaacctgctccctgcttgcatatgatctgacacatgcattctcacaaatcacaagcaactttccacttctcatacggatagctcgggaagataaaaaatgacgagaagtagggtccatgttgaatatgtgcggatgagatgacatgggccctccggatttccattgatgtccacatataaaatggaccctagcttggcatgcagctacaaaattttttagaaatttgttacgttgtactattgaagcagcaccgatgaggggaaagtcactaaattgtccccttttctttcttattttttgattttgtttttttaagatgaaaccttctaattttcatctcaattaatcggtacctaggtaccaaacatgatactatacctatattactatctttgatatatatctaggtacctagtctgagacccataagtatcatatccgatacaataagtgccatgtttgatacctattggtaccatgttcaatacctacgtacttggtctgatactcgtgggtatcacatccgatacttaggtatcaagtctagtattcgtggataccatatccggtacctaggtatcaggtctgatacctatggtaccatatccgatacctagtaaccaagtcccatacttatggtaccatatttgagacctcaggtctgatacctatggtaccatatctgatacctagtaaccaagtctaatagtacttatggtaccatatttgagacctcaggtctgatacctatggataccatttccgatacctagtaaccaagtccaatacggtaccatatctaggacataattaccatgtcagatacccatgagcaccaacaagtttgatacaaatagacatgatatgtatctccaaatattagtatcatcacatgtatcaatctaggtgactcaacctaattggtcagcctagctctcattccctattttataaaaaaaaagaaataacgaagagcatctatccattacatattggcccgactccatccaagccacctagcacataggcatgtcagagcatgtggcctagctctgtagtcgtcccatctatcaaaattatacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69292 - DNA, 709 bp, Oryza sativa
tgtcacagtactttagtaagcaagcaatatatcatacatggagcggcgagatttatgggttcggcatagctggggagttcacagagactaacgatgaagtactcaatattcctgacccatcgaagctccgaggcaaggctggaaggaggaggactctcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcatgtaatgtcagacttcggcatgtcatgtctttaggtctcgtgatataacgtcggactaaggtgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattacta

SEQ ID NO: 69293 - DNA, 767 bp, Oryza sativa
tcctgcagcccgagctccctttgcagtgaggtaagtagtgttcttttattttgaaagatggcatactactgattactaaccttcaacatctctggtttcaggtgaagtggcttgtgaaggagctgttgtagagcaattttttgcagacgctcaccgtgctcctccttgagagctgcttctcttcatgacatgcaatggagcacgaaagcatgtcaaagcaggaagtaatgaagggcgaagtaggtcagaaacttatagtactatgtactatggtgttgctacgtagttgtgtggtattccttattattcattgtaccatgaataatttatgccaatgtcgtagtagctacatgtaactatattggctttcatggacacgtctatggtactagatgtaaaactgctagatggctttagatgaacatctcagatttattttccatagaatgcacatatgaaagtacctgagcgtggcgacgctggtgctttccatgataaagatctggctggtgtagggcggtatgctgctgaagccggagacatgcacatcgcagaagcctaatcatcagactggagcctcaactgaaccatcccgtatctgatctgtttagataaagacagttatattagaaatcgccaataagtctcggacgataattcccagcatttcacaacttaagaagttcagaattctagcagctattcgtaatgcatcccattgcagtattgcataacaaattacagagatgaatatcaatctcccagct

SEQ ID NO: 69294 - DNA, 718 bp, Oryza sativa
ctgcagcccgttaccgatatctacaatacgcacttctagattagtacaactaaaaccctaaaatataatgcattgattcaaacaaatttttaaagaatacacactatttaactcaatagtcacatataggatctatgaatattacctgaaatcggcgtctgaatccggcagggcttcgccccttctctcttctcctcccctctcttctttttttttcactggaattgaggagagaagaatgagggctgggggctgggcagcaggccttttataggcagcgaggcctgccgcccggccagagggcggcaaggggccgcctgcaaaatagccggccccgactgacttttttgcattcgggccccttgccgccccaccagagggcggcaagggttttcctgcaaaaaaccctccctccatcaccgcccgttcctcccatgtttgccacgtcagcttgccaccccagaggtgggcggcaggggctatttttgcaatttttttggtcgatagattatttctgtaaatattaaaaaaaatctaaaaccgaaaaaaattccccatcattatgcatctcaccaattgcaacggacttcacgcaagccatttgctcctttatataatagcaccaaattatggaacgatgtccatctgttctcctcaactatttcatcgtctaattcacatccctcaaccacaaaatcacatatataggccttccaac

SEQ ID NO: 69295 - DNA, 2609 bp, Oryza sativa
cagtgaactccgcccaagtgattggttgtccttctgctctgttcatccggaaatgatcccaccattctgaagcagatccttgcaactgatgtgaagcgaaaacaactttatcctgatccgtgcactggagcaattccaacttctcctcaacagcgtgcaaccaatcacctgcttccactgggttggtagtgctagagaaggtagggggtctcacacgaagaaaatcagctaacttgttctgcggcggcggaggattgacattgttgttcccttgctggttctgcatttgttgcactaacatgttgatcaattgggtctgttgagccagcacttgagcaagggttgggttctcttcattgttattgtttccacttccactggcgcgagtgttcaccatctgttgcagattagaaaagatagtaggagaggggttacactaaagataagaccttaaccaggttaacactgatctgatgtgtgtagaccattatattgttcaagttgattaagcaaacaacctagtacagttgcacgctcatcactggactacatcaatgacgggaatgcaaccatacctacacacaaagcaaacaacagcgttctaccctactaactattcttcaaagacactttggcggcataggttctaaggtaggatgccaacttcattccatcttgacatctgggcacttcagttcttcctcgatccactttacttaacctccataagtagacctcattggcgtcttcaagtttcaatgtctcagaactactcaagttgaaagcaggaggggagaggatgataaaatgatttatagagaattctagagaaggaagaaaggaaaaattttcacaaatcatttttgtcgaaaaaattcgtccttaaagtttgaccatttggcttatcctacagtcgagatggctctgataccaacttgtcacgcccggaaattcactagtaatttccgaacttatttgtgcataaaatcctcgtccaggaatcagccgaggtacacaaactgacaattttaatatacaaacccatcataataataacgttacatacttacaaaagaaaagaaaacagcagcggaataacgatttagcgatggcttcagctccactcccacaggcagctcaactggggtataagccaaacgtcttctctttctggatcctttatcttcaactgaggtttgatgattattgcaagaatgagcatatgacatactcaacaagccacacagcaaatatgcaagtgcacaaggattccaaaggatggcataatataggctcatttgcaaaaagcagcatttagcaaaacatttaagataattaaaacagtagagtaattaatcatcaattttaatcaacactgaacagcacacccatgctgcacaggcccaaccatcctgaacaaccatacccggctgtacagatctaactccaaaccaggagctaagcaaattattaccagttataacatccataattattgtgaaaggtgtgagactaatcacgaaaaacattgctcaacccgcccataaccgcgggcacggctattcgaatagttttactctggccagaggtgtaccactgtacccacaagacacgattccacacatgttgccatgccccgaagtaccaccacggcactgcaaagggggaaatcgtgacaatacccttcgcacaacacaactcaccacagtgcaccattcctggatcataatcaccccctcaaaaaccagaggcatggactccccagcgaccgccacggacttctcgccgcttctcagtctggcaccctgtaatgaaccatgctatacaaaagataaagccgttgcccatgctggcttgtggttggcacggtaaatgtttcacaacagtagctcgcgaaccggtccttaattgtcatgagcacaaccatcaaaaccacatgctcacaacccaccttaaccagattttaattatcaattaattaacatcacacgattaatcatcgtgagctaccattaaatataaccataattaataagaataatataatataatttatatttaatcccctttaattagctaatgtttctaagcatagctaagcaaacttacatatagcatttagctgaaccaatccaatatataaggttcatgctaatcaaattataacccataggaaaataagatcatcttcggccattaattaacggggaaaggttcaccacccgatgacattaaaaaataatgcatagttgaaataaaataatagctttaaacgggttcaacatgctcaaagggttgtttgggatctgtgcgacttgccttgggcttccgcaaacacttccgaaccttgctcaacgaaaacgctctccttcagaacgtcggaaactaaagcaaaagaataaaaatcaacaaaacagtacaaaaacaagcataaacagtacatgtgaatatttttaacatgtagatcttgattttagaaaaatttagcaacttgaaccacctgaaacggatctacggttatttagttatgattttccgaagatttcatctataagaaaaaggggaaaaaggaaaagacgatgatgtcatgatgacatcatcaatggtgg

SEQ ID NO: 69296 - DNA, 1063 bp, Oryza sativa
gataaactcaaaaacgagttcgattcggataaaatactcaacggtttgctccgattcttggggggaaagatagaggagaacgagaggatcaaaaccgctcaaaaatccggactcggggtggcgggattgggtgcgggatcggcgcggcaaggcggcgcggcgaccgactcgggctctgcctgagttggaagatgaacagtagcgcagggaggaaaagtagacttttccggctgggctgagaggagaggaggcggctcaggttgggccggcggaagagagaggaaggaaaggaaggaatgggccgaaaatggcccaagctgaggaggaggattttattactttcccaattaaaataatcacttaaatgatctttgaattgttaaaaatacttcctatgctcaaataattccaaaaaaaaatcttgaaaatacttggacactcaaagtacttaacaaaattataattagaccatttaatgattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctgataataatttattaaataattttataaatcctgaaacaaaaatcaggatgtgacaccggtacgccgatcgacgtcgcagcgttgtcctctcctccagctgctcctctgtttcgccggaacgccgtcgcccgtgctggcctctccatcctcatcgtcgccgacgtcccttcggccgcccgttcatcctcaccggctcgtcgtttcacggcgccgcctccgtcatcgtcatcgcagcggcgtgttccacaccgtcctcgtctccgtgcagctgctgctggctgtcccttgtcgcctcctcgccggccaccgtcgtcgttgtcgtcgtcctcttgtcgttcccgttcgtcgtggtcgttcccacgcctcatcgcgtg

SEQ ID NO: 69297 - DNA, 3141 bp, Oryza sativa
ggtcctcccaggaaggtgatatggtacccgggacccgggtcctctgacgagtctgtgataccgggctccctctcaacctcctctggctctgtctcagctccaagatcagtatcctcctctaactctgagtcgatctggatcggagtctcctcgctagaacccagctgagacgggggtgctgcgaccgcctggataggctcggccacggtgactgtagactgctccccactggggtccaccaagcagggtgcaggctcagtgcccagtatctccgcgctctctaagatagtacggaaggcagtcaggtacggtggagtgaggaacagtagtagtcaaagtggtggtcgcacactggcgcaggtggcggtgggggaggtgcggtggaagtagaagctgctgtcgtagtggcggtggctgcaccgagctgctcctccaactccctgacctgctgctgactactctgcagctgcgcctcaagtgtggcgatcctatcaccacgggtgtcgtactgtcctgagagctgtgcgtactgcacatcacgagcctgaagctgggccagcagcaagtcaatctcgttgccccacgcgtggtgctgctcctcaagctactgtcggtgctgggtgagactggtgatctcggtctcaagctctaacaaacatctctgctgctcgtctatctcaagcagtgcctcctcgtagctgtcgtctactgcctcagcccaatgggacaagtgggtcaccatcgggttgtagcagcacggtgaggcctggacggagcagaaagtgtagtcctctcccctgtacgggtggtgggcaaactcagtcctcatcagctccactcggtgtagtgagtgaaggcgaaggaatgcctccctagcagcgtcctggactgctgactctgcaaagtcacggcggtagcgtgcccggaagcgatactctggctcaacgtcagtgcgtggctcaatcgtcacccgagcctcccacttggcacggtctccgacaacgaacctcctcctccaaaagacgggctgtcttaataagaatttgcttgctgttttaagtgttttaattcagatcagaacaattgcagtttaaattcctttataataaagcttagttcctgagcatctgtttttcttctttcccccccctccgtctgccctcccttcagatggtcaacaccaggaatggcatccgtgcagcaggtgagggcagcagcggtgaagaacgcaccgacggtggacatcccaatagtgcctctggcaacggtccgccaccgctccccgagaatccgacccttgcccaagtaatggctcatcagactcagatgacggcagccatgatgcagcagatgcagcggcagtagcaccagcagatgcaccagaggatgcagcagcaagctgcgtagcagcagcagcagtttggtccccctccccctcagtccaagctgccggagttcttacgcgtcaggccacccaccttctccagcaccaccaaccctatggaggcaaatgactggctccacgctatagagaagaagctaaatctcctacagtgcaatgatcaggagaaggttgccttcgccacacaccagctccagggtcccgcgtcaacttggtgggacaatcacatggctacccgtccgccaggtacggaggtcacttgggcggagttctgtcgcagctttaggaaggcgcaggtgcccgacggggtcgtgccacaaaagaagagagaattctgggcactccaccagggcaaccggacggtgactgagtacctccatgagtttaatcgtctagcgcgatatgcaccagaggatgtccgcatcgacgccgagaaacaggagaagttcctagcaggcctggatgacgagctgaccaaccagttaatctctggagactacgccgactttgagaagctggttgacaaggccatccgtcaggaagatcagcacaacaaaatggacaggaagagaaaggcagcgcagttccggtccaaccaaggaagtcaccagcgaccgcgcttcgctcctggacagcagggtggacctaccaccatgatcgtccgccagcaccgccctttcaacacgagcagcttccaccagggtgccagtggcagccagaaccaccagggaggccagcccaaccgcagtacagctccgcgcccaccgatggcaccagcacagtcagctccatcagcccaagccaagaaggagactggagcaaagccagggtcctgtttcaattgtggtgagcatggccactttgctgacaagtgcccgaagccaagccgtgccggggcaaggtttgcccaagctcgtgtcaaccacgcatccgcagaggaggcgcaagcagcaccagaggtcgtactaggtacgtttcctgtcaactcagtcccttctacagtactttttgattctggtgcaacgcattcttttatttcaaagaaatttgtggggatgcatgggttaagaaaagaagagcttagtacaccaatgagggttcataccccgggaaatagttcaacctcggtcagttatagcccttcaatgctaatagaaattcaaagatcaccatttctagccaacctcatccttcacgaatccaaagaccaagatgttattcttgggatggattggctgaccaagttcaagggagtcattgattgtgcgaatcgcacagtcaccttgaccaatgagaaggtagaaaccgtggtgtacaagtcaccagtctcaccgaagcagagaatctccttacatcagattaaggtggaaaaccctgtgaccaccgaggagaaaagttcacagaaattgaggatatccccgtagtctggaattatcaaaaatggttcccggaaaactcactccattccacccaaaaaaaaaaatggatttccaaatggatttgccaccggggactgttccattttacaagaaaccgtacaggatggcaggcaacgagctagcagaggttgtcacgaccggaaataacccaacgggcgttccttacgtgcgtgtattattccttgccccagaggcaaggttcaccaaaagttgatacaattcaaaatttaacaagcggaagcgtaaatagttaattattacatgggcagcgagggcccagcccacactaagacaacgaat

SEQ ID NO: 69298 - DNA, 3050 bp, Oryza sativa
ttcggctgagggagccggaggttagggatggccccgacaggtggggcccacctggcggtggctcggggggaaggagagaggaggacacggttgggggagaagatgacaggtggggcctcgggtcccacctgtcggagagagagggagggagaggccggctggggaggcaaagcagacttgagggagagagagagccgagcgggccgagggagaaggccggcccgagagggagagagggggggggaaattgggccgaaaggggcccaaagagaggagggaggattttatttgttttctttttattttaattggttaaatgatcttcgtgactttaaaactatttctcgagctccgaaaattcacggaaaattccggagagtacattagggcacaaagaatattacaaaatattcccggccaaagatttttaagggaaaattttaattctcccattattttacttgattaaattgctttaacttttatttaatttccagaaaatgcattattaaatgatttttaatcccgaacgaaaatcggggcgttacaaatctaccccccttacaggaatctcgtcccgagattctgggatggctagaaagagggctggcactggcggtctgtcttatctgctgacacatgctgtctctttgtcacgaccggaaataacccaacgggcattccttacgtgcgtgcattaatccttgtcccaggaggcaaggtacaccaaaagttgatacaaatcagagtttaacaagcggaagcgtaaatagttaacttaatacatgggcagcgaaggcccagcacacacagagacaaacgagaaacagcggaagactaaggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacgagggaattataccatagaggggttagggttgcagtaaacagcatttaaagacatttagttgctcaaagctattttgtaaacccgatcctagaactatacaatgttattaatcaaggccgtgaacccacacgaacctgccttaacccaaggcctacgatgattcagaccgaaccggcaacccgaccctgggtcccagctcgtcctaagccaacccaggccaaccattccacattttagttgttaagcaggttttaagaattaaaacactaacttgggtacattgctcggcttgcccataaccgagggcgcggctattcgaataggttttactctgatcagaggtgtacatctttacccacaagacacgtcttcctcatgtgcagccacgtgccacataccaccacggcatatggacggaagacatgacatagtttccaacccatcctagccatagacaagagtaccgacccaaccccacctatagccggaacctccgggacaggtaggcaggactgagcccctagcagcaggacaccagccctgtgccatgacatctcttctaccgggccgcagcacgtgtagccttcatttgtcctagagatgtccatcgacccccgacttcgtccatctccatccgtgtacttttgtttataaccagactgagccacaaactaagccttacccactagccatgtggaagtacgatagtgctttgcaacagaggcccgaagaccggtccttatgtggccgaggtgctactatcaaaaccatgcaccccaagcctagcctaaaaccattttgagagttttgaatagaggggaaggtgtgcatccagttccacaataatccaaccattccataatgttcaagtgatatgaataccccaaagtctagaattataaaatcacctaatgttgcctaaataataagcgaagcatctacctaaattcagactagtggaaccatgagtagagtgcccagtagttggggttttgtttattctagggtgaacaaggtaataataacaatgacgacagtaaggtcataacaaaggtaaataggcatggctaattaaaacagtgataacgcgggaatttaaatgaagcgataatgcattaatttaaatcaaaataacttcgcaaagtgggatccaatatgttcaaagatgatgtgacttgccttgctcgctttcccaaacgtcggcttcaacctccacgaagagcggatcttccgaagctgcagcgtctacacgaccaatggaaaagaaaagggcttttactctaataaactccacataacaagcaggaacaaagcacaaaaatgggttcttgacttcttaaggaaaaattagagacttgaacggtccaattccgagttcaaatggccaagttatggccatttgaagtttatatgctctttaaatgaatatttacgaatttcttcatttaaattttaatttaaagggtttattgcgtcagccgggggagagggacgcgcggaccgggtccacgggagtggggcccacgcggcagcctcacagtccacggtggaccgggtgcacctgggctcacaccggcgggcgcggtgggccccacgcgtcagccgcacccgagggccttggcggctgacggccgggccccacgcgtcagccgctcggcgggaggcggcgcccgcgcccctatggtcgccggcgacagccataggcacggtggagcggcggccgagagaggggaagggaagggggaaaaaggcgacggtccacggctcaccccgaggcgacggcggcgacggaggaggcggccggagcagagggaggcggtggcgcggctcgggtcgacggggtcggcggcgttccggcggtcggcgaccgaaacggagaggtggacgaggtcggcgaggatgcggcgccgaggtgggaggcggtccggggcgacggcggcggtggaccggagctcggcggcgacggcgcatagagagagcgacggcgcgagctcgattccggcgtggagaaggtgcggcaagtggcggaaacgggggctgcagga

SEQ ID NO: 69299 - DNA, 2667 bp, Oryza sativa
cgggcagggcggcggaagcggcggaaggaaggggatgacgggggggccccacccgtcagcgagggtggggggggggcccgcccgtcagcggcgcgcgcccggggaggggcccactgggctgcaggggaagaggagtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaattttaacaaaacagttaagtaattaaacaatattaagccaacgctatacaacataccctgttgtataggcccaaccattctgaacaaccaccccggctgcacagttctatctccaaaccaggaatgtaccattccaaaccaggagctaatcaaattattaccagttatagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccattgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataagctatcatgaaataatagtgagtcattagttatcccataagtgtactaatgtttctaagcagggctaagcaattatatctaatatctagttgaaccaatataaataaagctcaactagtcaaattataataacccaaggtatcaaggaataaggtaatcaagaacaaaagggctataacaatcaataggttaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgtgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcgggctagggtttggtggaccggcgcatgggcggcggttcacacgaacggacggccgagattgatccgatccaaatcggacggccgagatcgattggtccacgaccggctcacgggagaggatcccgatgacgtcaacgatgacatcaccgacgacggcggcggctcggcgaagaagacggctcgggcggcggacactcgtcggcgaacggcggcaccacggcaccaacggagggcaccagcacgtagaggacaacgcggcgaacacaccggtgaccaaaacaacggtggagaagcaacggacggcgacggcgacgagaaggaagcggcggctaccttcgggttgtcgacggcgacgaagctccggcgggttccgacggctgcgaaggggcggacgaggacggcgacgacttggcgacgacgacggcggtcttcccgagtgacggcgacagctggagcgacggcggagcacggctgaagcggcggcggcgacggcgaagctagggcacacggcgctagggcttttccgacgacgagaggcgaaggcgaaggtggcgacgggtagaggagacaccgggggtccttttaaagggctcggaggcggcggcgaaggcccacggcgacggcaacggcgaaggaaaccttcggcttggagagagggaaaaccgatccgaatcgaactcgattccaaagctttccaaagcgatttaaccaaagattccaaaggagaaaaggtagaggagatcccggagatcatttcccctctattgattcggccggagaaggaaag

SEQ ID NO: 69300 - DNA, 999 bp, Oryza sativa
ttcaatggtgcagcaaaagtactgaaatctttgacgaaacggtggtagaatcctgcaagaccaagaaagctcctcacctgtgtgatggtttggggaaccggccaactccttgtggcttcaatttttgactcatccacctcaattccctatggagtaacaacatatccaagaaaagagactcgttccgtgcaaaagatgcacatttcaaagttagcaaacaaacgtgcatcgtgtagagcattaaaaacagcacgtaaatgatccatgtgttcatccaaagacttgttgtaaatcaatatgtcatcaaagtacactaccacaaatcgtccaataaaaggccttaaaacctcattcattaagcgcattaaagtactaggtgcattagtcaaaccaaaaggcattactaaccactcatacaaaccaaatttagttttaaaagctgttttccattcatctccaagtttcattctaatttggtgatagccactacgcaagtcaatctttgtgaaaataatagagccacacaactcatcaagcatgtcgtctaacctgggaataggatgacgatatcggacagtaatattattaatggctctacaatcaacacacattcaccaagaaccatctttcttaggaaccaaaattacaggaactgcacagggactaaggctttgacgtacatacccgcggtccaaaaggtcttgaacttgccgctgaatttccttagtctcatctgggttggttcgataagcagcacggtttggcaatgatgctcctggaatcaaatcaatttgatgctctatccctctcatgggtggcaatcctgggggtatctcagctggaaagacatcctcatactcctgcaaaaggttagtaacaacaggaggtatcgaactagcaatatcatctaaagaaaccaaggcttgtttgcatatcaagaaatagcgcatatcatcatttgaaatatcagcaatgtcacatttcgttgcaagcataaca

SEQ ID NO: 69301 - DNA, 1220 bp, Oryza sativa
ttctcctctaggctttaaaatcaattctaataattccaattaaacaacaatttatatatttgggatttttagggtgtgacaccatcgtcctccgtcgctcgccatcgtcgcttgtcgtcagtgaggcacctcctcctctttctctctccctatctcccgcgccgtctagtcgtcgcgtcgctgcctagccgcttagccacagccagtgtcgccgcgccgtcgcaccgccgccgcttgtcgtcggacgccgccgtctgccgcgtcgccgtcccgcggtagcgccgccgtgcgccatggtcgccgggccggctcgagccgcccgtgcgcgccggccgcgtgctccccgccgccgtccgatctaccctcgggtagattggggccgtcggtttggccacccgcgtggttgccgaatgtgcgccgcgtcggcgccacgtgtgcaccacgtggcgcgccgccccttccccggtccgtggactcggtccaccgtgaaccgccctccccgagtcgttgccatgtggggcccgcatgtcggcgccgcccctctctctcccgggatttatttattgcgcaataattcaattaaggatttttctgtttatagtaaaaacacagtgaatcttctaaaattcatatctaattcatccgagctccatttaagcctattcaagtctcagtaaatcaagaaaaatgtgtagaatccattaaaaatagttttgttctctgtttcagtagtcttatagcctgtttgtattgtttgctttgtatgtcgcttagattccggctctcctgacgctccgttgtactttgaaatagtcaccgaggttcctccagcagcagtgcaaggcaagtcatgcttgtcacttgaacatgttgatcctatattgcaaatgctcttttgtttccgttcaaatactgcattgttttataatattaccatggaatgtttacctactgttatagccatgctattttggtacgatgttcctttcttagcttgggatataacatgactagaggttggactagggattgcttagccttgcttagttcaactagcacacaatgggggacaacattaatgcatagatatcagattgtagaaatgatgttggttaatgcccaccgctccggtgttggttaattaaaatatattaaatggtgggctgtgggtgcatggttttgatggtcgcgcccatggcaattaaggaccggttcgcggg

SEQ ID NO: 69302 - DNA, 5467 bp, Oryza sativa
cggattttcgaaaaatttgttcgttagggtcactgccatatcgcttaaataagcgaatgcaaaatactcgcagatgagattggccccgatggttggactgtagagaatactgttggtatttcttaacatcattactagaaatataattcccagcaatggcgcagaaatactcctggtatattatggttacagagtttatccgcaagtgcacggatataccattgtagcatttcacccgagagtattccaagggtatcgtatttattttatcccgtgggaagatcatgtagagagaacttgactaataatttatatattacttgtgataatcatattctaagcaagggttaagataatccaagggtagagtgacacacaagcattaactactcattctcataatatatcatctaagctaagtggaaagaaaagagaaagaaaatctattcatatatttctgatatacatagtatacatacattctagttaactgatatactagctaataccctctatctcgatgccctcctggtacttcgagaagccacccctgactaccgagttccttacgacagcccgttatgaccgtataaccagggcaaaatacggaagaataccctccccagggaatcaacttacgattatataccggcacggaggaacacacgtactgagctgtcaccatcagcggcccacctctcatccgcaatatataaccccaaatatcatatcccgtaatctagacaccatgtctaaactaccagatactactctaatatcatcgttatggcatagagtaattgcataagcaaacactatacccgcagcaaagcatctcccagataagatagccgtatattcagtataacatgaacataatgtaaagtaggtactcatatactcggaaagtctttcaataccataaggccctctttgtttaggcttaggcttattggcccagacttttaagtcagcttattggcttatatgatttataagccagtggatttaatgtcctaagtttagtggtggagtcatacatctatctcatataagccaaaaaagcttctccaacctagcttttggcttgatagtgttagagtggcttatagcttcaaaaaagccaaatgaaaaagctgcttgtttgttttcgcttagactttttgacttataagttggcttataagtctaaacaaagagggcctaaatgtatttagaagagtattcaagtaaaagtacaaagcttaccaaaagagaagagaaaagctactagagccatacccgaacacttccgaaggcttccgggcttctgatttctactatattcctattccaccagctagatactactaaactaaacttgagagaaatgagagagctattgcttgatgtgtgtgagtgatgtgagaagaggagctccttttataggcaggtaatgacggttgtgacggttggaatggtcggtaataccctccaatcgtcattggggatcaaatccagccgtccatccaaaccctgcatccatcggcgccacgggaggtttggccggccaaaccatgaactggcccaacccagcccatcttcggctggcggcctcctttgttgtcctcctcccatctgcatatcaagtgtgtccattctcctagtgatttcacccaagtcccaacgagaggaacttgagcgccattcacttgaagatggaagcacaccacttgatctggaaggttgattgtccccccattggatgtcatgaggcgcacgccaccggtcctcactggcacttgcccaggttgagaatccaatactgtgacgtggagcatgggtccatccgggtgcatccccaattggctcccaacctgcctcatacatctgcacgggtgtgaactttctcgttcatttcttgtcatgttgtgcgtctccctgtatgctccacctgcgcgagattcttctatggtctacaggggaatggttagttcatggcagttgtacaaatgataccccgcatttggcaacgggatttcatttgtacaactggggaaaaagtaaatcaaagatccgtctactccatttttcagaatgtgcccttgcactagataagcctcatcaatacacggatgagcggctgagataaaagcaatttggtcgctaacgacccctagcccttttgctatccgagtaatcagagaagtgcactcaacaggaacagagaactttatactttctaaccattgccttatcatacatttcacaggagtaatttggatctttctaaccatggcaaacatgataatcaattcatctgccctaatgggcctcagatcacctctaggaaacaaagccatatcaatcgatttgtgcatgagcctaagtgtaggattatggatatcattcgttctaggtttcttgcaaattggagcaccataaatatcttcccaaaacctaattttctcgaacccagaaattcctttctggagatcgattttacaggaatcgtgaaaatcaagaagtgtacttaagcctttccatgtaagtgtaaactcttcacggaaataacgaaaggaaattacatcttctatttctttcaaagtgcacagaaattgtaaagtaagcagacgagcaccaggctcatctaccacagcaaatctctgccaaccaacagctttccaaatagtacgaaattcagcatccatacctatgttttttagcagctccggtgagtattctcgcgtgtgagcatactcccggtcattcagcatgtagtagtcttgtctctcccgatcactgacaaggtcgaggtcggtgtcgtttaggagtcatcgcggagcttcggcgtcctccatcgagacatctgctgatgaacaagtactagactcatcatgatgacttgatgaagagccggaccccttgaacagacgagacagttgtcttctcattctgcacaatggagcaggaacggactaactcggcagaggttagtaatgacaagaatctcacccgccagttagtttcacgaaagcaacttgtatatatgcaactagtgtttgaatttgagggaaactatcaaagcttgaatgaacttgagagcaaactttggagagggaatgaaaatgtgttgaaatggggtggaattccctctctcggccggttggcttaagtagtgcacccacacggtcaaaaccgacctgtggggcccactagccgttgcctcaaagaaggaggcagccgaccgttggcctcgctggttcggccgaacccacagtgggcccaaccaaccccactttcggccgttgggttccaacggtcagtgtggttgtggcacaataaattttcactgaaaattttattttggtttgctctgaaaagttcatttgaagaatttcctaaaaattcaaaaatcctaaatgcaactttgaaattcaaacatgtgatgatgcaaaaatttaaattgttgaaagtaaatatgcggatacataccaatcaacctgttggcgaaggtcgcgtcatttaaagtccgacgtgcaagactatacctccatccagttcagtttgcggattttctacccgtctctggaggtgacggagcgggcgtctttggcttctccctccacaccttctttggttttggtgcggacagcggcttcttttgagccaactgcttctagcttcctggccggtatgggtggttctaccggcgtcttccaataacggttcgtaggcattgttgttttcttttctaggaaattctgaatgaatttcaccaggctgtctgttttaggtggctccacttcgacctcttgaatattctatgggttcggcccgtactttattctaaccatggagcattattccgtgctcagttgaaactcaaacttctcttccttgccgttgatgtggaaatggatactccccgttcccacgtcaatgttgtctcctgcagtgctaagaaactggctccccgggatgaagaaatctcgtatcttgactggcacatcctccgctatccctgccaggtaacggactgacgaatcagccagttgaaggcgcattggtgttggtgccaacaccgtgaagtagagcttgtcgaagacgtcttttggcatgacgctgacactggcaccaaggtcgcacaaggcctggtcgaactgttgtgccccgatcgagcaggtgatcgtaggacaccccggatctttcttcttctccgggagcttatggagtatcacgttgctgcattgttccgtcagcttgaccacctccgttgttgggagtggtctcttgttgttgagtatgtccttgagataacaggcgtatgttggcacttgcatagtgtccaacaacggcacgttgatgtggatcttctagattacttcaacaaaacgagcgaattgctcgtccactgacggtttcctactccgttgagggaacgatagcaaccgtgtgtcgcagtactcttgcggcactgtcttttctggcggaacttccttgccagccgagtcattagatggcacttattttgatatcccattagttcctacagggttaggatatggcggatcacgagtggacttacctcccctcgtcgtgatggcccttattttcaatggaggagtcaggttgccccgggatcctcccagtttgatttgcagggactaaggatgccaactgagctagctaggtttctatcattttattaaagcgcaactgattttgaaaagcagaagcaaagccatctaacttgacatatgttttctaggaccttgtcattagccgcaagctttttgcttagcgcataggtggtcttagcttgcgcaaaaacgagatccttcaaggaggactggttattaccgttgttgttacctccttgataatatgggcatggtttgttccacccctgacctccttgtggacgatacctgttgttgttgttgcccatgtacatcgcctcctcacggctttctgggcagtcattcccaaaatgacccgtgttgccgcagacctcacatgtggcgtgagagtccaaggccttgacggtgccttgcggccgtttctcgtggtcgtccaattgcttcatgaggaggtccagtttggcagcaagtaactctgtctccttgacggtgtgcatggcttgctaatgggtctgtagtcgttcctcgctccaacccatattggagaccatcttctctattagatcaatggctccttgaaccgttttagagaagaacgctcctccagctgccgcgtccatgtgatcacgggacatcggggtgagtccattataaaagttctgcgggatcagccagtcgtccatcccatgatgaggacaggcggctacgtactcatgtagtcgttcccatgcttccggaatagactcatcccttgtctgctggaaacttgaaatccttccacgaagggctttggttttgcccatcgggaagaatttcgagaggaatgtcgtagagcatttgtccca

SEQ ID NO: 69303 - DNA, 1202 bp, Oryza sativa
  unsure (1)..(1202): unsure at all n locations
tgtgatggttggaatggtcggtaataccctccaaccgtcattggggatcaaatccaaccgtccatccaaaccgtgcatccatcggcgccatgggaggttcggccgaaccatgggctggcccaacccaacccatcttcgactggcggcctcctttgttgtcctccttcatagacttgtgaattttggcccaatgtgtcgtgttatttctgagttcttggcccattcatacataagtctggttctcgacaccgtccaattgatttatcgtccgagttgatgtcgattctcctccactttattgtcattcgctgcaaaaggttagtatacctaatactagtggaatattattattgtaacaaatatattgtcggatcccaaaactaatgattcggaaaccgacatgtttaactgtatcaagccctggatcagtagattgatacagcttcaacaatctggattttcattgcgtacatttgaacaaggctccaaaggagatgttattacataaattaataggggaatttacaagattgtggctaactattacagcagaagctatagagtgtctcaactctaatattttgctatagacttaaaccatctaactaatctagatttgtgaactaggttgaaataagactaacttatatgattgaactcctggctttggcaagaacttcaatttaactctggaaaaaggaggttgaagcaagggtgagtacaacgtactcagcaagctattatattcaataatgaatgtataaaaaggtaatatttgagtaggattacgattacttgcagaaggcagagagtatagaaatagaaagcctgatgttttaaatgcagcagcatttagtaaaatcttgaattaggtttctaaccaaagtaccatatgagtcccgatactcaattccgtgagcacggctattcgaatagattcaggtttactttactgcagtaaatgtacgctttacccgcaatccatgacatgccaatattcattagcttagtcatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69304 - DNA, 1745 bp, Oryza sativa
ctatataaacgctccccgagctccccacctccgtttccgccactcaccgccctctctcctcgccggaatcgagctcgcgccgtcgctctctctctccgccgtcgccgccgagctccggtccgctgccgtcgtcgccccggaccacctcccacctcggcgccgcctccttcggcttcgccgcatcctcgccgacctcgtccacccctccgtttcgctcgccgaccaccggagcgccgtcgaccccgtccacccgagccgcgccgccgccttcctccgctcaggtcgccgtttccgtcgtcgccgtcgccctcggggtgagccgcggaccgccgcctcctttcccccttccctctcctctctcggccgctgctccgtcgtgccggtggtcgccggcggcgaccatcggggcgcgggcgctgcctcctgccggccgcgccgacgtggccgcctccgggcgcgcctagcggctgccgcgtggggcccggccgtcagccgcccgcgccctcgggtgcggctgacgcgtggggcgcacggcgccggccggtgtgagccgggtgcacccggtccaccgtggaccgtgagactgccgcgtgggtcccactcccgtggacccggtccgcgcgccctctcccggctgacgcaataaatatatttttaaattaaaatttaaatgaagaaattcgtaaatattcatttaaagagcatataaacttcgaattcggaattggaccgttcaagtctctaatttttccttaagaagtcaagaacccatttttgtgctttgttcctgcttgttatatggagtttattagagtaaaagcccttttcttttccgttggtcgtgtagacgctgcagcttcggaagatccgctcttcgtggaggttgaagccgacgtttgggaaagcgagcaaggcaagtcacatcattctttgaacatattggatcccagtttgtgaaattatgttgatttaaattattgcattatcgctttatttaaattcccgcgttatcactgttttatttagccatgcctatttacctttgttatgaccatattattattgttattgttattattattaccttgttcaccctagcttaaacaaaacctcaactagtggacactctactcgtggtatccctagtttaaatttaggtagatgcttcgcaattaaattagacaacattaggtggttttacaactctagactttgggatattctcatcacctggacactgtgaaattgttggagtattgtggaattggattcaccccgccccctctattcaaaatccccaaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtctaaggctaggatgggttggaaactatgtcacgtctttcgtctgtataccggggtggtatgtggcacgtggttgcacgtgagaaagatgtgtcttgt

SEQ ID NO: 69305 - DNA, 1509 bp, Oryza sativa
ttcagtaagagaagctttggagaagatgtcttaggtggagtcctggcttataccccagttgagcgcctgtgaagatggagccgtaggcccgctagtccgctgctgtttatttttgattgtcaggcctgaagtgcctttgtaataatgtaaatattatcgatataataaagatgtgccttttgtatcatgtttgtttggtgtaccccggcttttcctgggacagggattaatacactagcgttcgggaaaaggcaattttctcggtcgcgacaacttcttcttcctcctcttcctcttccacgtcggaggtggtgatgtagccatcttctgtagcaacataggcccgttgactagggcaatctttctgcacatgcccaaatccttggcaacggtggcactgaatgcgtcccgtcgaggcgacagatgaggcactcttggcgggtacttgcgaggaacatttacctgactctgctggtcgtgcttgccttgctcttgccctgatgcatgcccctgcaattccttctctgcaagcatagcaaaccgaaacaactggttgacagagttaaatttcttataatcaacaatgttctgaatttcctccctcaaaccatagtaatcctgtacagatttatcccgttgttccaaacgcatcagtttcttgcgtaaatctctatgataagatggaggaacaaacctatcgcgcatagctaccttaagttcttcccaagtagtaggtagtaccccctcatcagataacccagcccaccacataatagcaaaatccttgaactcactactggcttgtctaactctatgttgctcgggtacaaggtgggcattaaacttttgttctactgttatctcccaatcaaggtatttctcagcatcataatatccccaaaaagatggtattttaaacttaaccttagcataaggatcatcgggcactcgattattattattaccttgttggtggcgagtgccacccgtacctgtgcggtttgtgcataggcgacgtcgtagccgtgcttgccttgtagccggtgcgtcaatatagccactggaatcatacaccgtgtcttcaggatgagcatcgtcgtcaccactcaccacttcctcattttaatgaaggcatcttggaaagactttgcaacggcctctgtgatgtccttttgagtattttgttggagagttcgtagttgctcttggctgacacagacagcaaaatcctggggactcttctcaccttcgttacttgacattgaaacaccaaaacagaaacaaaacggtgaaggttatccctaataatctactacgcaggtgtagtggtgcctctcgacgattctcagcaatatggagttcctaactaagctcttataaggttcttaccagcaaagcaaaggatacctagaaggcgtagtcagcgattgcaaggatcaagaacttgtgctatccagaagtaatatgtggagctaggaaggccaaatatatatatatgagtggtacaca

SEQ ID NO: 69306 - DNA, 1770 bp, Oryza sativa
tgaagtttcggcttccggctaggttttccagaggggatataacctagactattatgcggtggaattgggatatggtggcagcgaagttgtagggtgttctggtgatgcgtggtgatctggatgagtgtttatgatggcggaaacggctctcaaaggatgaaccctaacacacggtgaaaggtagcggctagggttacaaaggataaaacacatgactagactaaaatacgtactagaccagcaacaggaacttaaactaggactcaaactcaacactacagactctgaaaaagaatcatgcaaaggctaaacacggtctaggttaaggtaactaacaactaattttttttggcttttctgtagactctaggataattgtgaaaacaaaaactaatctagggcaaagaaactgagcgaacctgacggtgaacctagagctctcataccacttgatgtgcgctagggttcccgatcttccgaaaggttctgataaacaacgatttgggcagagtcgcgacacaaatcgatccggcttcttgaacgcgcacgctcttgagccccgcaatcgcagcaccacgtctcctctggttatcacccgtgtcgaaacgcggatgacctcgccgagaaggctaatccctgtttgccaattgaagaacacaaataaaaacgagatagaaaaacaaccaaaattgcagatgaatgattaagctcacgagttggggtcttacaaaccgatctagcggcgaaactgttctcgacagattaatctaagcaaaacccaaaaacctaaagatggtggcgagtactgatatatagagtttagggtcgtgcaaacccttctcgacgcaaccctaatgggttccaacacaatacacgggccaaaggcccaaatacgatgacgcagcaccgggatagattctggacgtcaacttgttcggtcaattcccgttactccggaaagaatttggacatgggaccaaaaccattggaaattttatcttcttagctttccatcgatataaagaacgccccaatccgagtacgtatgcgacctgggcgcctgttttagtgcagactggtcctggactccgaattgcacccgacgtcgacttggtttgggcctccaccttgaattggacgtccccgatgatcctccatggctctcagaccttctccaagtgtctccttgtcccctccattgttcctaatcacaatataatcaataggtagcaatctattctcgaattcatataaagaagaacataggaacgagctcacctctaaatttaattgtcgcgcacgagctcttgttatcggtccttgaatgaccgttggaggattgttgtgtgtatccgaggtagtgatgtccgcatcacaatgaggtcacgatcaagaacaaatatcctttaccgcagattgatgatttgtttgatcagctaaaaggagctaaagtgttttctaagatagacctacgatcaggctatcaccagttgagaattcgtgaagaggatatccccaagacagccttcaccactcggtatgggttgtatgagtgcacggttatgtcctttggacttaccaatgcacccgcattcttcatgaacctgatgaacaaagtgttcatggaatttctagataagtttgtggtggtattcatcgacgacatacttatttattcaaagtctgaagaagaacatgagtaacatctccgttggtactcgagaagttgaaggagcactacttatatgccaagttcagggctgcaggaat

SEQ ID NO: 69307 - DNA, 1443 bp, Oryza sativa
gtgcctcggctgattcctggacgagggttcacacacatgtaagcgtttggaattttggatagaaattccgggcatgacaagttggtatcagagcctctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactccctcctttcacttgtctttagatgctgcgttacaagcctgagtacctgtttggtgttgagggttttgtccaggagttgcgtacgatgtcctttgtcattggatttgggactgccccattttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgacagtggcagttaccttgagactgaaggaattgagaatgatgctaccacgaagcatttggttgagatgttgtgggctatggatgaaagtcgtgtggagactgtgttagccgctcaagatcgtgaagaccggaatcgtggtaagatttgcaagttagaagacaaggtggatcgtttggagaaggaattagccgcattgaagggagaagcaccgccgtagaaggccaggattcgtcttaccgcaaggaagagagctctatttgtccctctctatcaactggcgccaaaggttcgtgtggtggagaaagaagttgccccagctcaagcggatcctccggtcatcatcataagtagtgatgaagaagaagaatccaagcgcatcaattccaagattgagtgggtagcaactcaagatgataaagacgagccttcaatcgacctccgatgcttggaagaactagagtgacttgttaagtcgttgtcttagagcgttgtgttagtttgcttgcttaaagtttgcttgtgtgtggcgcat

SEQ ID NO: 69308 - DNA, 2052 bp, Oryza sativa
catcctagggatggactggttagccagacataaaggtgtgatagactgtgccaacaaaaaagtaactctcaccagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatatatttggtacctggaacagctccgatccataagagaccttatcgaatggcagccatgagttggcagaagttaagaggcaagtagatgatttgctacagaaaggatacatcagaccgagttcatcaccatggggagctcccgtatttttgtggaaaagaaagaccatacccagaggatgtgtgtggactatcgtgcactaaacgatctgactatcaagaataattatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaatttgatgaataaggtgtttatggaatacctagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgcgatgcatccaaacttgggttaggttgtgttctgatgcaagatgggaaggtggttgcctatgcctctcgacagttacgtccacatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgagagaatctgtgtccccgacaacaaagatctaaaagatgcagttctgaaagaagctcatgatactttatactccattcaccctggtagtactaagatgtaccaggatctcaaggaaagattttggtgggcaagtatgaagcgtgaaatcgcggaatatgtagcagtatgtgatgtttgtcagcgagtcaaggcagaacatcagaaacccgccggtttgttgcagcctttgaagattcctgaatggaaatgggaagaaataggtatggattttattactggtttacccagaacgtcacaggccatgactctat

SEQ ID NO: 69309 - DNA, 3365 bp, Oryza sativa
agttcatcgttttcacccaagggaaaattggcaccgcgttttgtgggaccttataagattgtcagtagaagaggagaggttgcttatcagttagaattacctcaatctttggcaggagtccataatgtgttccatgtgtcacaattgaaaaaaatgtttaagggtacctaccgaagaagttaatattgagcagatagaagtccaagaggatttgacttatgttgagaaaccaatccgtatcctggaaacaaatgagagaagaaccaggaatcgagttatccgtttctgcaaagttcaatggagtaatcactcggaagaagaatcaacttgggaacgagaagatgaattgaagtcagctcatccgcacctgttcgccagttcttccgaatctcgaggacgagattctgtttaagggggggggtaggtttgtcacaccctgaaaatttaaaatttataaattgttgtttaaatggaatttttagaaataattttaaaagtcttgaagagaagatctagttttaattaataaattccaatataaaatgggcccagataaaatttcattcaatactttgcttaattctataattcctagatttttctgggacttatttgagctaaggaagtatttttaataaatggaattgcatttaagaaataatttaaattgaaaaaggttttaaaaagtctcttttggctttgggccgaaagtcggcccaaaacccctctctctctctcctcggcccagttcggcccagtccgccgcgcgcgcgccctctcgctgtcgctgacaggtgggtcccgcctgtcaggaccttcgtcctccttcggccgccgccgccgaaaccctagtttcgcgccgccgccgtttccttccaaatccggccgttcctttccttctccggtcgaatcaaaagaggggaaacaatctccgggatctcctctaccttttctcctttggaatcttcggctaaatcggtttggaagttcgtggaattgagttcgattcggatcgacctctttctttcaagccgcgagtttccttcgccgttgccgccgtcgtgggcctttgccgccgcctccgagcccctttaaaaggacccccggtgtctcctctacccgtcgccaccttcgccttcgcctctcgtcgtcggaaaagccctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtccgccccttcgccgtcgccggagatcgccggagcttcgtcgccgtcgacaacccgaaggtttccgccgtttcctcctcgtcgtcgtcgtcgtccgttgtttttccgccgccgttttggtcaccggtgtgttcgccgcgtcgtcctctacgtgctggtgccctccgtttgcgtcctggtgccgccgttcgccggcaagcgtgcgccgcccgagccgtccgctccgccgagccgccgccgctgtcggtgacgtcaccgttgacgtcatcggggtcgtccgccgtgagccggtcgtggaccgttcgatctcggccgtccgttttggattggttcgatctcggccgtccgtgtgtgtgaatcgccgcccgtgcgcccggtccaccaaaccctagcccgctgacgcaataatccttcttttccttttcaaaaataattcattattgcgtcataattcaattttaaccaatataagtgttttaatccgatttaatctttaaaaattcataactaattcatcttagctccgatttagttggttcaagtctctaaatttttctaaaattgagatttacactttaaaaatatccacatgtactgttcatgcttgtttatgtgctgttttggtgattttgctcttttctgcttagattccgtcgtttccggagagtccgttttcgcagaagaaaagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtatattcctggtttggagatagaactgtgcagccggggtggttgttcagaatggttgggcctatacaacagggtatgttgtatagcgttggattaatattgtttaattacttaagtgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttttttccgctgcttagatctttattgattgagaggaactatctacctctgtaatgacattttattcacttattaattagagtaatatttgtactctattatcaatttgttattgtgtgcctcggctgattcctgga

SEQ ID NO: 69310 - DNA, 1408 bp, Oryza sativa
ccccaattaattttggaatccaacgcttgaatcgcgcggattcgagagagcaagaaactagggttcacgggagagagagaagagctgtgcgggaggaggaagaagcgcctggcaggcgggtcccacgcggggcgcgcggtcagtgcacgtgcggcgctcgtgcgcacgcggctacgacaggagggcgctgcgactcgggcaagggcgcggcttgggccgggcggctgggccgaggcaggccaggaggaaggaggaggagggagtgggctgcccgggaggaaagagagaaaaacaaagggaggggagagggacttggactgcgggccgagggggagagagggagactttgggccagacttggcccaaaggaaaaggaggattatttttaggttttctttttaataaactttgattattgtttttgttgcttaataattatttccggtgctctgaaaattcaagcaaaatttgagggctccttttagaccaaagagaatttaacaaaaattctccgggccacattcgaatttttcttgtacgtattttagtgtttgccaatttcttttcgaattttaattaattctattattccttttagagaatgatttttatttttgggatgaatttatcaggacgtgacaaatccaccccccttacaagaatctcgtccccgagattcgaggaggctagcaagaagataggttgggcggtcttctcttcttgtctggcttcttccgtcgcgtcttttataacaaacttgcctagcaaaacttctccactctggactgctgggctcgatctcctattgcaaatggaatcttctcttcacctgacttgtccctggttgaacctttagctgacttcgactgggttgcgacacttgaagatggtgcttcagttccagaacttcgcatagttcatatttttggagtcaacctcatacaagttacccacttcatgtcatgcgtcgagatcagctcgtcattactaggataccatgcttgtcatttacttctaacttgccaccaactgcctcatattagctttcctgctctccgggtgatagctacttctgctatttgatgcaagggtcgataactttgcctttgaattatgcttcccaagagaaccaacttatcccacttgatatactttgacgtcttcccaaatggctttactgctggatttgttattgtctaatcattatcctgccaatttgaggcttcgttgttagatgcgattttaatctgacctctgtagattatcttcgaacatatcacttggttcataactgggaatagctctcacgaacaagcaactcggattcacttcctttacatttggttcacttcccactattctcttcatgttgtcatcatttagcattcaacatattcctttgcacctt

SEQ ID NO: 69311 - DNA, 897 bp, Oryza sativa
agcacagagcatactgggctatcaggaactggaacatggactttaaaggagtaggagaatggagaaaaatacaaattgctgaacttgaagaatggagagagaaggcttctcacaacgcaaagatatacaaagaaaggacgaagcgctggcatgataaaaggataaaaatcaaaaaattcaagccattagacaaagtacggatattcaactccagggttaagcttttcggccacgggaaattgcacagtaaatgggaaggaccgttcgacgtcatcgacacctcttcgcacggggcaatcacactccgcgacgattcagttaatatattcaaggtaaacgatcaacgcttaaaaattttccttgagccaaatgaaactttagatgaagaagtggatgttattaaattaatcgataatgagccataatgatctcatctattgcatgcttaaaaccttgtaaagttgtcattttcgtgcttagcttaggaattagtgggcctaggtgacgacgggaaaaccgggacggtcgtaatagtatagtaggtccgttatccgcaaatcgttagagacaatttaatttaaatgcaataaataaataaaaatcagaaatggggagtcccttacttctagaattcatacattacatagaaattctgttaattacatctccgtagagaaaacccctgattaggaattccaacaagaaagaaaataaaattacatgactgctaaaaggctaaaaagaaaaatctatcctaaagctccagatgtcgcagccgtagaatcttctgtagatttccatttatatctttatttcattttgggagtattttagatgcccactaatttgttggtttttaatatcactgcatgtatggtagcaaatttatacatagct

SEQ ID NO: 69312 - DNA, 1505 bp, Oryza sativa
ttaaatgatcttcgtgactttaaaactatttctcgagctccgaaaattcacggaaaattccggagagtacattagggcacaaagaatattacaaaatattcccggccaaagatttttaagggaaaattttaattctcccattatttcacttgattaaattgctttaacttttatttaatttccagaaaatgcattattaaatgatttttaatcccgaacgaaaatcggggcgttacaacgggcgacggcattccggcgaaacagaggagcagctggaggagaggacaacgctgcgacgtcgatcggcgtaccggcgacgtacaggagccggccggaggcggggaggtactggacgccgacgaggaggccactccggcgagcttcgggcgaggaggaggtgatgccggggatgagggcagcgtcacggagccgagagaggtggtggcgacgtcggccggcgcatgggaaacgcgacaatggcggccggaggcggaacagtggcggcaacgccacagttgccggcgggggcgcacctccaagggtctccgtgcaaaacggagggcaggccgggggagaggaggctgctgcgacgccggggaaggcggcggcacggccggacggcgcgtgggtgaggcggtaggggcggctggagggtggccggcaccgaggaaagagaaggaggaggcggggagaggtggtgtggtcgcgggggagctcgggaaggggctaaaacgatagaatgcaaagagggggttccattttatagcggaagggaatgagccggccacgggaggagcggggaacggcggcagaaaaggcgcccggcggccatggaaggcagccatgaatggcgcagccgttccggtcaaaatagtgcacgattaaaggggagattagggggaaaagggagaggaacgaaaggggattaattccccccaattaattttggaatcccatgcttgaatcgcgcggatttgagggaggaatggcgctagggtttacgggagaaagaggaaggaggccggcggctggaggtcggggacacgcctgacaggcgggacccacgcgggaggcgcgctcaacgcgcgtgcggcgcacgtgcgcgggaagggagcggctcagcttgggccgggcggccggcccaggaggagatgagggagaggcggcccgggggagagagggaggaggagggagtgggccaggagggggaggcccaagaggagggagagaaggagagggagagaaagagagggaggaagggaggactttggccgcgggccgagggagagagagggaggctttgggccagacttggcccaaaggaaaaggaggattatttttaggttttctttttaataaactttgataattgtttttgttgcttaataattattttcggtgctctgaaaattcaagtaaaatttgagggctccttttagaccaaggagaatttaacaaaaattctccgggccacgttcgaatttttcttgcacgtattttagtgt

SEQ ID NO: 69313 - DNA, 1002 bp, Oryza sativa
tcaaaatgagaaaagaaaatgccgagtccgggaagatatctgttgcttcaattgtcaaggaatgggtcatttcgccgacaagtgcccaaaaccgagaaacacagctgccagcacgtcagtccacgcaactccctgcaatcagaagcttgctcctcagcgaattgtcatccatgcatcccgaagcagtcctatagcccgcgttgcaacagctccaactccagcgagtgcattaccacaaggtgtcaatgctcaatttcagccccagccatcagttgacaagacagaggccactatcggcactgtacctttggatgttccagcacagcagccaagaaatcaagtacaggatgaagaacccaagcgtaagaaagttatttacaacggtagtacctgttaaggaagcagacgtgccaatcgccaagtggtcactggagcaaatgcagtacctgttaagcctagcgctagtcagaagcaaccataatactcttatatcagtaatcatatacttatgttttatagttgttccccgtcaatcatgtaataacagagaaacatgagattatgaaggagtttgataagtttatgaaggatccatgttaagattgcaagtgcggtgagttgtgtacactttgttgctgattagggagacccagggtctcatttccgtaagctcataatctattatgaatcaaataacctcgcgattgatggcgaagaaaatcaagtgatcaaccaaagagacatttgtttggactaagagtttcagatgtgtcttcttcggatcaaaggcaggcaccggttgtggagaaattggacacgttgctagcatgtgtctcacactcggcactcactatgaggaagaccatccaccaggggagtgtcccacctgcaaggtcacatgttttctgtgggaaggtacaaaccatgggcccaacgatgcccaactcagtggcttgtggaccaagaccgcagaaatccaacgaacaaccctacgatgtgtct

SEQ ID NO: 69314 - DNA, 1511 bp, Oryza sativa
gggcagctccaactggtaagcgacttctccgcgccgagcaatgatacggaaaggacccacataccgaggtgcgagcttcccttttgtctgaaacctgtgtacacctcgcaatggcgtgacccgaaggtatacaaaatcatccactgcgaattccaggtcacggcgacggttatctgcataacttttctgccgggactgtgccacctttagattatcccgaatggttctgactttagcttcagcttctctcaggatatcagtcccgaacacttggctttccccaacttgatcccacaggagcggtgtccggcacttgcgcccatacaacgcttcataaggtgccatttgtatgctggcttgatagctgttgttgtaggagaactcggcataggggagactcttatcccaggtcttcccgaaatctaggacacatgcgcgaagcatatcttctagaatctgatttagacgctcggtctgcccatctgtctgcgggtggtatgcggtgctgaagtttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcgcaggaatgaatcgagctaccttggttaatcgatccaccactacccatatggaatcatatccaccttgggtctttggaagtccggtgatgaaatccatcccaatttcatcccatttccattcaggtacttggagaggttggagaagtccggccggtcgttggtgctctgccttgacacgctggcacacatcacatagggccacaaactctgcaatttcccgcttcatgctaacccaccggtatttctccttcaagtctaagtacatctttgtactgcccgggtgaatggaataggggctttcgtgagcttcctgaagtatcagctgtttaagttctctgttatctagaacgcatacccgctttccgttccatagggttccgtgttcatcctctgtgaaaccagcggctttaccctgtttcatattcttgaggagtccatgcatgtccgggtcgttcttctgagcctcgcggatttgatcgagcaaggtaggcttggcttctaacgcagccaagaatccacgaccaactatgcttaggttcagagcttccatctgtttattaagttcgggtggaatgccgcggacgttaagagtgttgcaatggctctttcgacttagagcgtcggccaccacgttggccttaccaggatgatagtgaattcccacatcatagtctttgatgagttctagccatctcctttgccgaagattcagatccgattgggtgaagatgtatttcaaactcttatgatcggtatagatttcacagcgattcccaatgagatagtgccggccagatttttagagcatgaaccaccgcggctaacttcaaatcatgggtaggg

SEQ ID NO: 69315 - DNA, 10513 bp, Oryza sativa
gggggaaaggagagagagggagggatagttgggccaagccggcccaagaagggaagggggggaaagaagacttttagggatttttctttttataaaacctttttaactttgtttatttcttctcaattattatttgtgctctgaaaattccactaaaatttatttacgcattttaggcttttaggaaatatacaaaaatcctccaagccttatttgacttttaaatttgcacattttaattgttgaaggctttcacatgaattttaattattctcggcacaatttcgaggatgtattttagggtcgttttgggacgcgacaaacctaccccccttaaacggaatctcgaccccgagattcggaagaactggcgaagagatcgggatgggctgccttcagctcgtcttcacgctcccaggtagcttcttcttcggcgtgattgctccactggaccttgcaaaaacggattacccggttcctggtcctgcgctccatggtgtccaggattttcactggcctctccacgtaggtcaaatcttcgcggacttcaatttgctccgagtcggcctgctcggatggtactcggagacacttcttgagttgcgacacatgaaacacatcatgcacgttgcccaaggaggcgggcagctccaactggtaagcgacttctccgcgccgagcaatgatacggaaaggacccacataccgaggtgcgagcttcccttttgtctgaaacctgtgtacacctcgcaatggcgtgacccgaagatacacaaagtcgtccactgcgaattccaggtcacggcggcggttatctacataacttttctgccgggactgtgccacctttagattatcccgaatgattctgactttagcttcagcttctctcaggatatcagtcccgaacacttggctttctcctacttggtcccacaagagtggtgtccggcatttgcgcccgtacaacgcttcataaggtgccatttgtatgctggcttgataactgttattgtaggagaactcggcataggggagactcttatcccaggtcttcccgaaatctagtacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagcttgtttcctccataggtggtcttcacaggaataaatcgggccaccttggttaatcgatccacaactacccatatagaatcatatccaccttgggtttttggaagtccggtgatgaaatccatcccaatttcatcccatttccattcaggtacttggagaggttggagaagtccggccggtcgttggtgctctgccttgacacgctggcacacgtcacaaagggccacgaactctgcaatttcccgcttcatgctaacccaccagtatttctccttcaagtctaggtacatctttgtactgcccgggtgaatggaataagggctctcgtgagcttcctgaagtatcagctgtttaagttctcggttatctggaacgcatacccgctttccgttccatagggttccgtgttcatcctctgtgaaaccagcggctttaccctgtttcatattcttgaggagtccatgcatgtccgggtcatttttctgagcctcgcggatttgatcgagcaaggcgggcttggcttctaacgcggccaaaaatccacgaccaactatgcttaggttcagggcttccatctgttggttaagctcgggtggaatgccacggacgttaagagtgttgcaatggctctttcgacttagagcgtcggcaaccacgttggccttaccaggatgatagtgaattcccacatcatagtccttgatgagttctaaccatcttctttgccgaagattcagatccgactgggtgaagatgtatttcaaactcttatggtcggtatatatttcacagcgattcccaatgagatagtgccgccagatttttagagcatgaaccaccgcggctaactccaaatcatgggtagggtagttgccttcatgaggtcgtagctgacgtgaggcataggctaccacatgaccgtcctgcatgagcacgcaccccaatccttggcgcgaagcgtcgcaatacaccatgaagtccttgcgagtatccggcaagattaacaccggcgaggaaaccagcttttccttgagagtttgaaacgccttctcgcattgcgggctccacacaaatttctcttctttcttcaacaactgtgtcatgggtcgggcgattttggagaagttctcgatgaatctccggtagtatcctgccaaacctaagaaactgcggacttgagtaactgtcttgggttgcttccaatcggtgacggcggtcactgtttcggggtccacagcaactcctttagctgatatcacgtgccctaagaatttgacttcggacaaccagaactcacacttactaagtttggcatacaattgatgttcccgcaactttcccaacaccagacggagatggtgctgatggtcttcttctgattgtgagtatatcagaatgtcatcaatgaaaaccacaacaaacttatccaagtattccatgaacactttgttcattaagttcatgaagaaggcaggtgcattggttagaccgaatgacatcaccgcgaattcatacagcccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcgacgcacatcctcttcgtcttgtctttcttctccacaaaaatcacaggagcaccccatggggaagtactcggacgtatgtactccttttctttcaactcttccaactgtttctttacttcggccagttcatttgctgccatacggtagggtcgcttgtacagaggagtggttcctggagcaagatctatccggaactcaatctctcgcttgggcggcataccgggtagttcttccggaaacacgtctccgaactccctgacgatggggatttctgacagtcctatctgatgcagttctgaacttctgacagaggttgggggtgcaaagaaaacaaccggttgttccggccctcggtacagagtgaccgtgcgtctcgcgcaatccactactccttggaattgagccaaccaattcatcccaaggatcacatccaagttctttgtgtctagcagaatcagatccgagggaaaaggaatcccctgaatttctatagggacggcagggctataatactttgctgtcataacccctccaggggtggtgatgagcagagggtttctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacgtccttaccaccgttgttggggcggggaggcgcttggccttgctgacgccttggcttcgggcatttatccgcaaagtgcccgggctcgaagcagttgaagcacagacgctgctgaccttgagcgtccctgtggccttgaccaggctgcacagttggcgtaggaggacggggcgcacgagtcccctgctgaccctgctgctgctgcggctgtgggacgcgcaccacgaattgaggtcgaggcgcggagcgaggctgctgctgctgctgctgctgcgaggaggatccccctggatagggattggtgtagcggaccctttggttagcaccctgttgattgcggaaattcgccaagcggcgcttgtgcgactctagttccttgtgcttggcttccaagcggatgctcttgtccaccagtcgttgaaaatccggatagtccccagagactagacggacggacagctctgggtccattcctaccaggaacttctcttgcttctcctcgtcttcccgcacatcctccggggcgtaaccggccagattgttgaactcatgcaaatactccatcacggagcggttgccttgcttcaactctcggaattcccttttcttaagggccacgactccggcgggcacatgggttctccggaaagcggcggtgaagcgggcccaagtaataggctgcccctctggctgcgtagcctggaagtggtcccaccatagagatgcgggcccctgcagttggtgggcggcgaagatgactttctcctcatcgctgcactgcaccgtgtctaactttttccccacggcatgcaaccaatccaacgcatccacggggttgttggagctagagaaggtaggtggacggatgcggaggaactcggcgagtttagagtgttggggaggtggtagtggggcattaagttgtggcggattttggaggtggtggaggaaagcagtcatcatgttggcttgctgggcgaggatttgggtgagaatggcgttggtgtctggtggtggtggtggaggtggaggaggaggttgaggtgggttgccctggtggttgtggttgctgccttcgggttggttgccatcaccggtagcagcatttctcctggtcatcaccatctgaaaaccccacacagaaccagcaaacagagagagctgacaattaaagctaaccacccacgactaccataattcttgaatttattactgctattaaattggttcattaaggttcaagttgcttaggcaaataaaataagacaggctccgacacagttatgccacacaccggcataaaccatgccccacacaacccaacaagaagacaaacgagaaggaacacacgcgcaagcctactaactgctcgtctaccgctgcgacgggccagggcggaaggtgagcaacagcgcatcctccgtgctaccaacgcaggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcggcgcttggggcggcagatctctccctgggcgatcttgagctgatgcagctgcgcctccaccgcgtctaggtccttcttgagctgcaggttctcctgacgcagctccaggatcttcatgttgttctcgaccatcccgcggcgcaccatctgatggaagtcgatacgagccgcgtcgtacgcctccaccatgtgtgccaggtgcacgatggtagcgtcatcctccgagctagcatcccggaaggtggcgtagtcgcgggctcctccgcggcgagggtggtagcggtagggcgagtgctgcaactcgtccgggtagcgctggtggagagtgccgatggcgaggagagcggcgctctggcaagcggcggggaaggaatcgccacccgcggtgactgtcagcgaagtccgctcagaagagccagcgaggatcactgcagtgacctcccaaccagcgcggggctccgcatcgtcaccctcctgttccggaagcggcctggcctggtagttgtcgcgaccgggaaaattgccttttcccgaacgctagtgtattaatccccgtcccaggaaaagccgggttacaccacacaaacatgatataaaagacacatctttattatatcgataatatttacattattacaaaggcgcttaaggcctgacaatcaaaaataaacagcagcggactagcgggcctacggctccatcttcacaggcgctcaactggggtataagccaggactccacctaagacttcttctccaaagcttctcttactgaaggggggaagaaaaatagagcaagaatgagtacaaccacagtactcagcaagccacaccggggatgcacaattaatgcaaaggagtacaaggggataataatataggggttaagttttgcagtaaacagcatttaaaagtcacttagttgcccaaagctattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatccccctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggaggtgtgaaacctattccacaatgatccaacaattccagtgtgtccaggtgatatgaatatcccaaagtctagagttgtaaaaccgcctaatgttacctaattaaacagcgaagcatctacctaaaatcatactagtgataccatgagtagagtgtccactagtaggggttttgtttaatctagggtgaacaaggaaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattctgagttcaaatggccaagatatggccatttgaagtttatatgctctttaaatggatatttgcgaatttcttcatttaaaatttaattaaaaacccatttattgcgtcagccgggagagagggcgcgcggaccgggtccacgggagtggggcccacgcgtcagcccctcggtccacggtggaccgggagcacgcggctggcggcggccggcgccgtgggtcccacgcgtcagccgcacccgcgggcgcgggcggctgacggtcgggcccacttggcagccgcgagggcgcgcccgaaggcggcctcgccggcacggccgacgggaggcggcacgaccgcgccccgatggtcaccgccggcgaccaccggcgcggcggagcggcgcccgagagagcggagaggagagggaagcgaaagggcggtcttcggctcaccccgggtcgacggcgacgacgggaacggcggccgaagcggaggaaggcggcggcgcggttcgggacggcgagggcgacggtgctccggcggtcggcgagcgaatcggaggagcggacggggtcgacgacgacgcggcgaagccgaaggaggcgacgccgagacgggaggaagtccggagcgacggcggcggcgaaccggagctcgtcggcgacggcggagagagaggaatacggcgcgagcgcgattccgacggtgagagcgagcggcgaacggcggaaacggaggagagaggcacggggagcgattatatagcaccgggagggggagatagcggccggagagggaggaaacgggcgcggagatctcggccgccattgattgcgtcggcgaggatcgcgggtgtaaatcggacgaatccgagggagagagagagggaaaaacgggggaatcgggagagggaatcgcggggaatgattcccccctcattatggcgcgcggggacggcgggatgcggcggattcggcggcggcggcggcgctagggcacaggcgagcggcgggagcggcgggaggaaggcgatgacaggtgggccccacccgtcagggagggcggcgggcgggcccgcctgtcagcggcgcgcgcgcgggggaggccgatgggccgcgggggagaggagagagagggagagaagtgggccgagccggcccaagaagggaagggggggggaaaaggacttcttttagggtttttctttttataaacctttttaactttgtttatttcttctcaattattatttgtgctctgaaaattccactaaaatttgagggctccttttagaccaaggagaatttaacaaaaattctccgggtcacatttgaatttttcttgtacgtattttagtgtttgccaatttcttttcgaattttaattaattctattattccttttagagaatgatttttaattcgggatgaatttatcaggacgtgacatttagcatctttcttagtgaacaggtatatcagagtagcatgatcagtatagactatcaccttagctcccaccaagtaagatctaaatttatcgatagcaaaaacaatcgtgagcagttctttttcagtagtcgaataattgaattgagctcctgttagagttttgctagcgtaacatattgcatgatgctttttattcttggtttggcccaagaccgcaccaacagcgaaatctcttgcatcacacatgatctcgaagggcagagtccaatcaggaggttgaatgattggagcagagacgagtgcctttttgaggatttcaaaagattttaggcacacgtcgtcgaactcaaagggcgcatccttggccagcagattggtcagaggccgcgcgatcgtagaaaagtccttgatgaaccttctataaaagccggcgtgtcccaagaaactgcgaatccccttgatgttcacaggaggaggaagttgatctataatcattgattttagcatgatcaacttcgattcctcgttcggacactcgatgaccaagagctatcccttcaccgaccatgaaatgacacttcccaattaagtaccaggtccttctcttggcatcgttgtaagactttgtctaaattttgtagacagtgaccaaaggtctttccatagacagagaagtcatccatgaagagttccataatatcctcgatcatgtccgagaaaatagacatcatatacctttagaaagatgcaggagcgttgcatagtctgaaggacatcctatgatatgcataggtgccatatggacatgtgaaggtagtcttacgctggtcctccggatggataggaatttgatgatatccggaatacccattgttgtcgaatggacaactgcatcacgtcgaaaggcgtggttctctcaacagtggttggaattttcggatccccctattacatggccatagggggctatttatagccctattacgggctctccctattggggtttaggttttacaggggaatttaaatggttacccttataacagggacattattggggcacatagtgtcctttacatatatagacccctattgggcttaaaatcgctaggcccatctacttagtgaaagaatttggcccaacggcccgttgagcaactcttcggtgaggttcggcatctggcgaacctgagccctcttgccagggctttcgccttgtcatcctcgcccacatcgccttctgacgaagtccctacctggctaagcttgggtgtccgggccatggctttcgccataagacattcgcccacacacggtttccttctcgatcttcgccactttcctccggtctaagcttgtcgcttaagcctttggttttggcaggcccggccgaaggcccttcgtggtatacctccaactcccatcaaggaaacagaagaagtatagatttgccagctgttccaacatttcgtcaccgaagggtagcgggaaatgatcctttttcgtagccttggtaagcttcctgtagtcaatgcaca

SEQ ID NO: 69316 - DNA, 3975 bp, Oryza sativa
ccaggtgcacgacggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggagtctccacccgcggtgactgtcagcgaagtccgctcagaagagccagcgaggatcactgcagtgacctcccaaccagcgcggggctccgcgtccccaccctcctgctccgggagaggcctggcctggtagtccactccgtgtggataccccagggccacgcacatgcctcggagctccaagacgaagccagtcatgtccaaaccacgacgggtgacgctgccggccatctacaaacaaaaacaaaaagaaaagcaacattttcaaaggtcagattttggcgataaatgaagcagcaagacagagagagactagaggattttcacaaataaccaaggatttttatttttgaaaatattgctaaggcttgggatctacggctcgtcctagggtcaagggtggctctgataccaacttgtcacgaccggaattaacccaacgggcgttccttacgtgcgtgcattaatccttgtcccaggaggcaaggtacaccataagttgatacaattcagagtttaacaagcggaagcgtaaatagttaacttaatacatgggcagcgaaggcccagcacacacaaagacaaacgagaaacagcggaagactagggcgacgaccacaggcgcttgacggcaggcacgagctagacaccaaagccttcatcttcaaggagctcctcttctgggcttgggaaaaatttgagcaagactgagtacaaccaccgtactcaacaagacacacccacaagtgcagaataaatgcaagggagtacaagggaattataatatgaagggttagggttgcagtaaacagcatttaaagacatttagttgctcaaagccattttgtaagcacgattctaaaactatacaatattattaatcaaggccgtgaacccacacgaacctgccttaacccaaggcctacgatgattcagaccgaactggcaacccaaccctgggtcccagctcgtcctaagccaacccaggccatccattccaccttttagttgttaagcaggttttaagaattaaagcactaacttgggtacattgctcggcttgcccataaccgagggcgcggctattcgaatagattctactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccgcctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccaagaccggtccttatatggccgaggtgctactatcaaaaccatgcaccccgagcccagcctaaaaccatttttggggattttgaatagagggggcggggtgaatccaattccacaatactccaacaatttcacagtgtccaggtgatatgagaatttcccaagtctaaagttataaaaccacctaatgttgtctaattaaattgcgaagcatctacctaaatttaaactagggataccacgagtagagtgtccactagttgaggttttgtttaagctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaccgacggcttcgacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatagatatttgcgaatttcttcatttaaatttttaattaaaaatcgaattattgcgtcagccgagggagagggcgcgcggaccgggtccacgggagtggggcccacgcgtcagcctctcggtccacggtggaccgggagcacgcggctggcggcggccggcgccgtgggtcccacgcgtcagccgcacccgcgggcgcaggcggctgacggccgggccccacctggcagccgcggggcgcgcccgaaggcggcctcgccggcacggccgacgggaggcggcacgcccgcgccccgatggtcaccgccggcgaccaccggcgcggcggagcggcacccgagagagaggagggaagggggaagcgaacggagcggtccacggctcaccccggtcgacggcgacgacgggaacggcggccgaaacggaggaaggcggcggcgcggttcgggacgacgaggacgacggtgctccggcggtcgacgggcgaaacggaggcgcggacgaggtcgacggggacgcggcgaagccgatggaggtgacgccgagacgggaggaagtccggagcgacggcggcggcgaaccggagctcgtcggcgacggcggagagagaggaagacggcgcgagcacgattccgacggggagagcgagcggcgagcggcggaaacggatgaggagagcacgggggacgtttaaatagcgtcgggagagagggaaagcggccggaggagatggaaaccggcgcggagatctcggccgccattgattgcgccggcgaactttgcgggcataaaatcgaacgaatccgagggagagagagaggggaaagagggggaaacgggagagggaatcgcggggaataattcccccctcattatggcgcgcggggacggcgggatgcggcggattcggcggcggcgctagggcacgggcgagcggcgggagcggcgggaggaaggcgatgacaggtgggccccacccgtcagcgagggtggcgggcgggcccgcctgtcagcggcgcgcgcgcgggggaggagccgatgggccgcgggggagaggagaaagagagggagggagagaactgggccgagccggcccaagaaaggaaggggggaaagaagacttcttttagggtttttctttttataaaccttttcaactttgtttatttcttttcaattattatttgtgctctgaaaattccactaaaatttatttacgcattttaggcttttaggaaatatacaaaaatcctccaagccttatttgacttttacatttgcacattttaattgttggaggctttcacatgaattttaattattctttgcacaattttcgaggatgaattttagggtcgatttgggacgtgacaacgaccaacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaactcatttattgcgtca

SEQ ID NO: 69317 - DNA, 1575 bp, Oryza sativa
atggttgtaccggtgtgtggtatgactgtgtcggagcctgtctttattttattggcttaagcaacctgaaccttaatgaacccattttatatcagtaataagttcaataattttggtagtcgtgggtggttagttttaatagtttgttctctctgttggctggtttgttttggggtatttcagatggtgataaccaggagaactgctgctaccggtgatggcaaccaacccgaaggtagcaacaccaacatccaaggcggcccacctccacctcctcccccgccaccaccaccaccaccagacaccaaccccatcctcactcaaatcctcgcccagcaggccaacatgatggctgctttcctccaccacatccaaaatccaccacagcataatgctccacctccaccaccacccccgcagcattctaagctcgccgagttccttcacatccgcccgcctaccttctccagctccaataaccccgtggatgccttggattgcttgcatgccgtggggaagaagttagacaccgtgcagtgcaacgatgaggagaaagtcatctttgccacccaccagctgcaggggcccgcatctctttggtgggaccacttccaggctacacagcccgaggggcagcctattacctgggcccgcttcaccgccgctttccggaggacccatgtgcccgccggagtcatggcccttaagaaaagggaattccgggagttgaagcaaggcaaccgctctgtgatggagtatttgcatgagtttaacaacctggcccggtacgccccagaggatgttcgggaagatgaggaaaagcaggagaagttcttggcaggaatggaccctgagctatctgtgcgtctggtctccgtggattatccggatttccagcgtctggtggacaagagcatccgcttggaagccaagcacaaggaactggagtcgcacaagcgtcgcttggtgaatttccgcaatcaacagggggctaaccaaagggtctgctacaccaatccctatccaggtggatcctcctcgctgcagcagcagcaacctcgctccgcgccccgaccccaattcgtggtgcgcgtcccacagccgcagcaacagcagagttagcaagggacccgtgcaccccgtcctcctgcgccagctgtgcagcctggtcaaggccacagagacgctcaaggacagcagcgtctgtgcttcaactgcttcgagcccggacactttgcggacaaatgcccgaagccgcggcgccagcaaggccaagcgcctccccgctccaacaacggtggtaaggacgtcgctcggggtcgtgtgaaccatgtgactgccgaggatgtgctgacgactccggacgtcatcgttggtacgttcctctttcattccattcctgctaccattttgttcgactctggagcttcccactcgtttatatctgtgcctttcgtgggaagaaatcaactgggggtagaacggcttaggaaccctctgctcatcaccacccctggaggggatatgacagcaaagtattacagcccggccgttcctatagaaatccagggaatc

SEQ ID NO: 69318 - DNA, 2214 bp, Oryza sativa
ttcttcatgaacttaatgaacaaagtgttcatggaatacttggataagtttgttgtggtcttcatcgacgacatcctggtgtactcgcaatcagaggaaaaccatcagcagcatctccgtctggtgttgggaaagctgcgggaacatcaattgtatgccaagcttagcaagtgtgagttcttgttgtccgaagtcaagttcttagggcacgtgatatctgccaaaggagttgctgtggatcccgaaacagtgaccgccgtcactgattggaagcaacccaagacggtcactcaagtccgcagctttttgggtttggccgggtactatcggaggttcatcgagaacttctccaaaatcgctcgacccatgacacagttgttgaagaaagaagaaaaatttgtgtggagtccgcagtgtgagaaagcattccaaactctcaaagaaaagctggtttcctcgccagtgttaatcttacccgatactcgcaaggacttcctggtgtactgtgacgcttcgcgccaaggtttggggtgcgtattaatgcaggaaggtcatgtggtagcctatgcctcacgccagctacggcctcatgaaggcaactaccctacccatgatttggaattggccgctgtggttcatgctctaaagatctggcggcactatctcattgggaatcgttgtgaaatatatactgatcataagagtttgaaatacatcttcactcagtcggatctgaatcttcggcaaaggagatggttagaactcatcaaggattatgatgtgggaattcactatcaccctggcaaggccaacgtggtcgccgacgctctaagtcgaaaaagccattgcaacactcttggcgtccgtggcattccaccggaacttaatcaacagttggaagccctgaacctaagcatagttggtcgtggattcttggctacgttggaagccaagcctaccttgctcgatcaaatccgcgaggctcagaagaatgatccggatatgcatgggctcctcaagaatatgaaacagggtaaagccgctggtttcacagaggatgaacacggaaccctatggaacgggaatcgggtatgcgttccagacgtcagggaacttaaacagttgatacttcaggaagctcacgaaagtccctattccatccatcctggcagcacgaagatgtacttggacttgaaagagaaatattggtgggttagtatgaagtgggaaattgcagagttcgtggccctttgtgatgtgtgccagcgtgtcaaagccgagcaccaacgaccggccggactcctccaaccactacaagtgccagaatggaaatgggatgaaattgggatggattttatcaccgaacttccaaaaacccaaggcggatatgattctatatgggtagtcatggatcgactaaccaaggtagcacggttcattcctgtaaagaccacctatggagggaacaaactagctgaactctacttcgctaggatcgtaagtctgcatggcatccccaagaaaattgtatctgatcggggaagccagttcacctctcatttctggaagaaactccaagaagagttgggaacccaattaaatttcagcaccgcgtaccacccgcagacagatgggcagaccgagcgtctgaaccagatcctcgaagatatgcttcgcgcatgtgtcctagattttgggaagacatgggataagagtctcccttacgccgagttctcctactataacagctaccaagccagcatacagatggcaccatacgaagcgttgtatggccgcaaatgccgggcacccctattgtgggaccaagttgggaaagccaagtgttcgggaccgatatcttgagagaagctgaagcaaaggtcaggaccattcgggaaaacctaaaggtggcacagtctcggcagaagagttatgcagacaaccgacgccgtgacctggaattcgcagtggatgactttgtgtatctccgggtaacgccgttgcggggtgtacacaggtttcaagcgaaagggaagctcgcccctcggttcgtgggtcctttccgcatcattgctcgacacggagaagttgcttaccagttggagctgcccgcctccttgggcaacatgcatgatgtgtttcatgtgtcgcaactcaagaaatgtcttcgagtgccgtccgagcaggccgactcagagcagattgaagttcgcg

SEQ ID NO: 69319 - DNA, 737 bp, Oryza sativa
tatacggaccacaagagtctgaagtatatcttcacccaacctgatctaaatctccgacagcaaagatggttggagttaagcaaggattatgacatgagcattcactaccatccgggtaaagccaatgtggtggcagatgcattaattaggaagagctactgcaatgccctatgcaccgagggcatgtgtaaagaattgcagcaggagcttgaacgtctcaacgtgggaatagtagaacacgggttcgtagccgctctagaagcatggcctacgctcgtggatcaagtcagagcagctcaagtgaatgatcctgaaatagcagagctgaaaaagaatatgaggctcggaaaagcccgggacttccttgaggatgagcatggcacgatctggatgggagaaagattgtgggtgcccgatgacaaagagctgaaagatctgatacttactgaggctcatcagactaaatattccattcatccgggtagtaccaagatgtatcaagatctcaaagaaaaattttggtgggccagcatgaggagggagatagctgagttcgtcgcgctctgcgatgtttgtcagcgagttaaagcagaacatcataggcccgcaggattgctacgacctcttcaaatcccggaatggaaatgggaagaaattggaatggatttcataacaggtctgcccaggacatcatctggccacgattcaatctgggtagtcatgggggctgcaggaat

SEQ ID NO: 69320 - DNA, 2332 bp, Oryza sativa
aaccaagaatttgacttagaaattaaggataaaaagggagtagaaaattccgcagcagattatttgtctaggctgtagatcattgacatgtaggaacaaccaataaatgacttcttgagagatgatatgctgatgacggttcgtgactccagccgtggtatgctaatatagtgaactatatggtatccaagtacataccactaggggaaaatcaatgaaagctgaagtatgaaagtcgtcatcatatatgggatgagccatacttatatcgggtctgctccgatggcttactaagaagatgtgtgccgactgaagaaggacttaagatcatagagcgatgccatgcctcaccctatggtggccattatggtgcattccgcacccaggtcaatatttggcaaagtggcttcttctggccgacaatgtacggagactcaaaagagttcgttagaagatgcacaagctgcgagaggcaaggaggaatcactgctcatgatgcaatgcccctcacatacaatttgcaagtcgaaatattcgatgtttggggtatagactttatgggacctttccctaagtcccgcaactgcgagtatattctggtggcagtcgactacatctccaagtgggttgaggctatgtcgtgcagtgccgcggatgcaaagcatggcaagaagatgttcacagaaatcatcttcccaagatttggtacccctaggatggtcataagtgacggaggttctcacttcatcgacaaaaccttccgagacctcctacgagacttgggagccaaacacaatgtggccactccttaccatccatagatcagcggtcaaatagaaacatcaaacaaacaaatcaagaatattctgcaaaagatggtcaacaaaatgggaacatgatggaaggatagattgccggacgcactatgggcataccggacagcatacaagacacccattggaatgtcccccctatcagatagtctatgggaagtcatgtcgactgttgacagtcgttatcgataagttttgaccgtcaatattatcaaaatagaggagaacttgtagtgcttgcaatgcatatatatgttagattaataatattctactagtattaggtatactaaccttttgcagagaatgaccataaagtggaggagaatcgacatcaacacaaatgataaatcaatcgggcgatgtcgagaatcagacttatgtatgaatgggccaagaacatagaattgacatgacaaactgggccaaaattcacaagtccgcggagcagaacaacggaggaggctgccagccgaaagtgggctagtttgggccagcccctggttcggctgaacctccctcgcctccgttggatccaggttttggctggacggttgagatgaagccccaatgacggtcggagggtattaccgaccattccaaccgcgataaccatcatagttcagctataaaaggagctcctcttctcacttcactcacacacctcaagcaaagctctctcatattctctcaagtttagtttagtagtatcaagctagtataatagaattagagtagaaactcaggagtccggaagccttcggaagtgttcgggtatggctctagtagcttttctcttctcttttgtaagctttgtactattattagaatactcttctatatatatttatggtattgaaatactttccgagtatatgaatgctaactttacattatgttcatgttatactaaatatactgctagcttatctgggagatgctttgctgcgggtataatgtttgcttatgcaattactctatgtcatgacgatgatattagagtagtatctggtagtttagacgtggtgtgtagattacgggatatcattattcggggttatatgctgcggatgagaggtgggctgctgatggtgacagctcagtacgggtatttctaagcgcgtgtatataatcctaagttaattccttggggagagtactcatccgtatttagccccggttgtatggtcatgacgagctgtcgtaaggaactcagcagtcaggtgtggcttctcgaagtactaggaggacatcggatagagggtattagctagtatatcgaaataactagaatgtttgtatattatgtatactagaagtatacgaatagatttcctttctattttttttcagttagcttagatattatattatgagaatgagtagcaaatgcttgtgtgtcactctaccctttgtttatcttaacccctgcttaggttatgattatcacaagtaatatataaattattagtcaagttttctctacatgatcttcccac

SEQ ID NO: 69321 - DNA, 3951 bp, Oryza sativa
acacatggcagtcctaccgatggcgacaccagggtaggcactcgcccctcgcggccccaccaatggctgccccaccgtaggccctgactcccacacaccaagaataaccactatgcagggatactgccttcgctcggctatgtactccgctaggtctatacccatacgagaagtacggttgtacgagggtcgtttcatgcttaacttcatggctcggtccttaactgaccagggacggcactagccttttccggacaccacccaagtaccccagctgccccggtcgaaaacaatgtttaattttgtttctcttttcacaattcatgttatccttgtcatggcaatgtggtgcccacgcctccacatgccgcatctcaactaccctcccctaaggtagttgtccaagcatatagcatttgataaatatgagaatgcatgattctaattagcatgactaagcatttgttcaatgtcgactaaatacacacgttagcagggtttacaatggtcatacaggtaatcaatatcaaggcatggcatacttaacaagtagggcattcatattcacatatgtatagcatgcaattttatttaaatcaacataattttcgcaataggttcaacatgctcaaagattagtgatgatcgacttgccttgatcgcagtcttgctgacccagatcttcattaactcagcaactccttcggaatctaaatttacgtgcgaaagattcgatttgaattcaattagaattcaaattaaatcaccaaaaattcaacattacaaaaataaatagcaaaagtggttccatcagcaagatgttgattttagatgaatttaggttcaagtttcattcaaatccgagctaaaatgagtgagttatgcttgtttaatgattcaaatttgaattaattcaaacaattgtgaaatggcactgtgcagccgagaggggcattattacagtggctgacatgtggggtcaccccatttctttttcctctgtttttattttctatagaaaatgtacagagtcattgacaagtgggaccggccctgtttgaccctagtcaaaaccggttctttaatcccggtgggtcccgcatgtcattgacagtaacttcataatcaatttttcttagattttcctaatctcccggtcccacatgtaatagagtaatttgcattagattaaaagatgattactgtgcactaatcacaatgtggggcccacagctcccctctctgcctttcccctttctttctctctcggtcgtcttctacctcgcgcacgcggctgaacagaggagcagcgcgcggcggtgcgacggcccgagccagaacggctcggcgcgcggtggggaaaggcaacggcgcatcaccggaaacccatcggcggcggcggcgaggcacggcggccacccgacgcgcggcgcgacggcgcgcggcggcatcgagatcgtaagaacggcggcggcgcaatggtggtcgattcaagtgcaaatgacttcgatttaaccatctagggttcacatggagtatagaaaagcaaaaatctagccgatgctacattggaacgaggtctctccacggcgagctcaaccatggcgcggtagcggccggagtcggcatggctacggcagcgcgcaccccaaatcgagggggctgctagcttctaggtgtccaggcaatgctacaggcgcgaggtcttaccacgaagtggcgaaacagcgaagttcgacggcgagtggcgcggcgcggttgaaacaggggcggacggcggtcggcgacgggcgcaggtgttcgacgctcgtcctccctcgcatagcggcctccggctccctccaacagcagtaacggcagcgcgcacaccacctcagcacacccccgccacccacactggccgagaagccctgtggcggcggcgcagccggcgctcaccaggtgttcgacactcggcggcggcgtgatcttgctcctcttcggtggagcaaaagttttagagagaggaaaagtaaatgggagattgagttcggataagaacgagccaaggtcaagtctatataagcgagagggagagcgattccttaatggataatggtgagcgatgacacggctttgtttcgatctctcccaggttctggttcagtgtacaggcgcggcatgattgcctacgcggtagtatgcaggagaggtctcgctagctggagaaaggggcgccgcattacccagcggtcgcaaccgggggtgacaagatggagacgcgacggggacgcgatggcgacaagagcgacggcgatgggcagtggtaacggcttggataggggggcgcagggctatgccctagggtgacgcggggtcgtcgtggcggctgttatccttccatcccgagggcgacgtgcgaggggacgggatgacgcgggcacccgtggcggcgcagcctttggcacgggcttttggcggcttggtcggcggcgggcccacgtggcgtggcatgacgcggtgcggcgcacgggcacgactagtgcggcgcacgagtcggaaggcaggcgcgcggcacggcagcggttggagagggcggcgtcgggtgttcggtcgggttaggcacagatcgaacacctggcgcgcaatgaacagtagcgccaggaaaagaaaaaggaagagaagagaaaggataagggaaaaaggaagggctaatctgccaaatggcttggaattgagttgtaactctatatattttggattcaagaattcaaacatttgatttgaatatttatttggttatttattagttcccaagtgaatttgcttcccactagatcatcccaaatagaaatattttaatttgcaaaattaacttaaataattggggggggggggctttgatagtcctaaaattatttaaaatattcaatgggtccagtactaatacaatagcacgttggttgaacttatttgcataacaaggtattcatgtaaattgtaattattatttagatgcgcatctttactttgatttttccattgagataatttacagtttggcaagcaatatcaaccataacatccatcatgatgcaaaagttttaaaaagttcaaaattttagtgatttttattattgaggatttttaagatgttacaaacctatcccccttaaataaatctcgtcccgagatttcttaccggtcattaaacagatgtgggtattcagtctttagaaattcttgactctcccacgtagcctcctcttctgtgtgattactccattatactttatacatgcgccaaactttggtccgggttctcttctcagcctcatctaatactttcaccggatgctccgggtaggtgagatcactactaatatgaatatctcccaatggggtttgctcctccggtactcgcaaacacttttttagctgtgacacatgaaacacagggtgtacatcggaaatattttctggcagtgctaactgataggctacttcccctcgcctggcaattattggaaatggtcccacatatctcggcgcaagtttccctttgaccttgaacctcttggttcctcgcagcggggacacttttaagtatacgtgatcgcctatattaaactctaaatctcttctccttgtatctgcatagcttttttgtctagattgtgctacttttaaacgatcacgaatcagtcgaactttctcctcagcctccttaattatatcgggcccaaatacagctcgttcaccggtttgaccacattagtggggttcgacaacgtcgaccaaacaatgcttcatttggtgacatctttaagctggcctgataactgttgttatatgaaaattcggcatatggtaggcacctttcccaatccttggtgaaatccaaggcacaagaccttcacatatcttctagcacttgatttgttctttcagtctgtccatctgtctgcggat

SEQ ID NO: 69322 - DNA, 1579 bp, Oryza sativa
atagagtcatagccagccgcggtcttgggcaatccgacgataaaatccatgcctatttcatcctacttccattccggaattttgagtggttgcaacgatcccgctggccgctgatgctcggccttcaccctctggcatacgtcgcatagcgctacgtattcggctacatcccttttcatgttgggccaccaatacgcctctttcaaatcctggtacatctttgtgctgccaggatgcagtgaatatgcaaattcatgtgcttccttgagaattaactttctcaaatcaccctgttcaggcatataaatcctctttttataccacaggattccgttctcattgattgaaaattctttggcaaatcccgcggccatacgctccttaatttctcggacctcctcattatccttctagatttcctctatctgtgttctcaaaagaggttgaatttctagtgaatttacttcaccttgaggaattaaatgtaggttgagtctagccatctcctcttgtaactcaacagctacgtttttgctgcttagatgattgcaccggcccttgcgacttagagcgtcagccacaacgtttgctttgccggggtgataatggattcccaaatcataatccttaatcaattccaaccatcgtctctgccgtaaattgagatctgactgagtgaaaatgtatttcaggcttttgtgatccgtgtatatgtcgcaatgattcccaatcaaataatgcctccatatctttaatgcatgaactacagccgccaattccaggtcatgagtagggtaattctcctcatggggtcgcaattgccgtgaggcataggccacaaccttttcctcttgcattaatactcctcataagccttgcctggacgcatcacagtaaatgacaaaatccttacggttgtcagggagaaccagaataggtgcggtagtcaatttttccttgagctgctcgaagcttgcctggcattgttctatccactcaaatttcttttctttctttaacagttgtgtcatgggcctagctattttagaaaacccctcaataaacctacggtaatattcggccaatcccaaaaagctccggattttcgtcaccgatttgggtgccttccattccgtcatagcctccactttagcaggatccactgctactcctcctgctgatattacgtggcaaagaaaggcaacctccttcagccagaactcacacttgctaaacttcgcatacagttgatgttcccgtagtttctccagcacttggctcaaatgctctgcatgttcctcctcatccttggaatagatgagtatatcatcaataaacactactacaaatttgtccaaatattccatgaacactttgttcataaggttcataaagtaagctggggcgttggtcaatccaaaggacatcactgtaaactcatataatccataacgtgtggagaatgcagtcttaggaatatctctgggcctaatcttcagttgatgatactcagaccgaagatcaatttttgagaacaccttagcccccttcagttgatcgaaaagatcgtctatccgag

SEQ ID NO: 69323 - DNA, 1568 bp, Oryza sativa
ttggctggacgactaggcggaaggcctactgtgacttcgatctcgctttggttggcttttggacagcgagacacccccctctcctcatagatggctatgagttgaagagtagtatgtcattggttcgatgttagcttgcgtgttgtatcctgttgaactgcgtatatgtgcagtccagtgcatcatttgtctgtgtaatgattgtggaactatgtggcatgttatgatattagtaatgatatgttatgttgttcatgagtttgtttcaccatgcttgctatacaaagatcacattaacgaatataataaaaagggtagagatagttaaatatttacttacctagcatgcttcaacagatggctgggcggcgccgtgcaaatgagaacccaccagaggccgatatgaccaccttggctggggttatggctgcacaaacccaactgctgcaggccattgttaacaaccaaggaggccgtggaggctcaagctttggcgagttcatgaggactaagccacccaccttcgctacggcggaagaacctatggaggctgaagattggctacgcatcatagaaaagaaattgactctggttcgggtacgcgaagccgacaaagtgatcttcgcaattaaccagctggagggaccagccggtgattggtgggacacatataaggaagctcgggaagaggatgctggagaacccacctgggaagaattcactactgcttttcatgagaacttcgtgcctgctgcggtgatgcgcatgaagaagaacgagttcagaaggtgccggcaaggaaacacaacagtgcaagaatatctgaaccggtttactcagttggcccgctatgcaacaggggatctcatagatgaagaggagaaaattgacaagttcattgaagggctgaatgatgaattgcgtggacctatgattggacaggatcatgaaagtttccaaagcctgatcaacaaagtcgttaggttggagaatgatcagaagactgtagagcacaaccgcaagaggagacttgccatgaatcgcccaactcaggaggagacttgccatgaatcgcccaactcaaggggtgcctcagcgactgaagggaaccgcttcctcgggatggaagcccaccggggccacaaccaaccgccctgctccatctagcaacttcaacaggtcggctgcaactccacctcgcacaccgaccccaacattggccgctcctagatggaagaggagtggaagttgcttcaactgtggggaacccggacactatgctaacaactgtccacatccaagcaaagctcctatccgcaccggagccaatgcgacggcagttcgcgggaccactacccctgccgccgctcgaggattattcaggacaccacagaccaaccggtctgctaccgggtttggacgcgggcaagtgaatcatgtgcgagctgaggaggcccaagacgaccagggcgtactgatgggtatgttttctatcaatactaccccagtcaaagttctcttcgattcgggcgcatcgcattcatttatatctttgaaagcaagtcgac

SEQ ID NO: 69324 - DNA, 873 bp, Oryza sativa
ggttcgcgagctactgttgtgaaacatttaccgtgccaaccacaagccagcgtgggcaatggctttatcttttgtatagcatgattcattatagtgtgccagactgtgaaggggcgagaagtccattgcctctggttttgagggggagattatgatgcaggaacggtgcactgtgatgagttgtgttgtgcgaggggtattgtcacagttcctttccgaggtaccgtggtggtgctatggcgcatggtaacatgttgtgggattgtgtcttgtgggtacagtggtacacctctgatcagagttaaaactattcgaatagctgtacccgcggttatgggtgagttgaacaatgtttttcgtgattagtcccatattattaatcaatggtaattgtgataattaatgtgactcctggtttggaatggcatattcctggtttggaggtttggtttgttcaaccggggttggttgttcatatgaggttgagcctatgcaacacgggtgtgttgtatggtgttatttaatattgcttaattattcaactgttttactattctcttaaatatttattaaatgctgtttatgcaaatgagctatattatgccatcctttgttatcctgtgcacttgcatatttgctgtgtggcttgttgagtatgtcatatgctcattcttgcaatattcaatcatcagaagaggagtatctcagcgaaggtgatgatctggaggattaagcttgttcctggttaagatgcctggaagtggagtcgccatagctgttccgtagtttgctttacttttgtttttccgctgcgtagaatgtcattctttgagaggaactatccacctctgtaataatttatgggctgcagga

SEQ ID NO: 69325 - DNA, 702 bp, Oryza sativa
aattcctgcagcccagtcccttgttgactctgctgttgctgcggctgcgggacgcgcaccacgaattgaggtcgaggcgcggagcgaggctgctgctgctgctgctgcgaggaggatccccctggatagggattggtgtagcggaccctttggttagcaccctgttgattgcggaaattcgccaagcggcgcttgtgcgactccagctccttgtgcttagcttccaagcggatgctcttgtccaccagtcgttgaaaatccggatagtccccagagactagacggacggacagctctgggtccattcctaccaggaacttctcttgcttctcctcgtcttcccgcacatcctccggggcgtaaccggccagattgttgaactcatgcaaatactccatcacggagcggttgccttgcttcaactctcggaattcccttttcttaagggccacgactccggcgggcacatgggttctccggaaagcggcggtgaagcgggcccaagtaataggctgcccctctggctgcgtagcctggaagtggtcccaccatagagatgcgggcccctgcagttggtgggcggcgaagatgactttctcctcatcgctgcactgcaccgtgtctaactttttccccacggcatgcaaccaatccaacgcatccacggggttggttggagctagagaaaggaggtggaccgat

SEQ ID NO: 69326 - DNA, 941 bp, Oryza sativa
attcctgcagccccctttgacactttgaaggacaagcttacacatacacctttgctacaacttccaaactttggtaagacttttgagttagaatgtgatgctagtggagttggcattggaggtgtgttgatgcaagatggtaagcctgttgcatactttagcgagaagttgcatggtcctgttttgaattattccacgtatgataaggaattgtatgctcttgtacgttccttagagacgtggcgtcattatttgtggcctaaagaatttgttattcactctgatcacgaatcgcttaaatatcttcgctctccacaaaaatgaccggagcaccccaaggtgaagtacttggtcgaatgtaccctttctgcagttgcttgtcaacctgcttcttgacctctgtcgcgtcccaaaacgaccctaaaatatatcctttaaattatgcctagaataattaaaatacttgtgaaagccttcaaaaattaaaatgtgcaaagttaaaagtcaattaaggcttggaggatttttgtatatttcctaaaagcctaaaatgtgtaaataaattttagtagaattttcagagcacaaataataattattaagaaataaacaaagttaaaatgattttataaaaagaaaaaccttcaaaaaaccctccctcactctcttgggccggctcggcccacttccctccccctctctccttgtcacaccctgaaaattcaaaatatataaattgttgtttaattggaatttttagaaataattttaaaagtcttgaaaagaaaatctaattttaattaataaattccaatataaaatggggccagataaaatttcattaaatactttgcttaattctataattcctagatttttctgggatttatttgagctaagaaagtatttgtaataaatggaattgcatttaagaaataatt

SEQ ID NO: 69327 - DNA, 749 bp, Oryza sativa
gggggaaaggagagaagagggagagaagtgggccgagcgggcccaagaagggaagggggaaaaagaagacttcttttagagtttttctttttataaaaccttttcaactttgtttacttcttaataattattatttgtgctctgaaaattccactaaaatttgagggctccttttagaccaaggagaatttaacaaaaattctccgggccacatttgaatttttcttgtacgtattttagtgtttgccaatttcttttcggattttaattaattctattattccttttagaaaatgatttttatttcgggatgaatttatcaggacgtgacagtagtccactccgtgtggataccctagggccacgcacatgccccgcaactccaagacgaagccagtcatgtccaaaccacgacgggtgacgctgccggccatctacaaacaaaaacaaaaagaaaagcaacattttcaaaggtcagattttggcgataaatgaagcagcaagacagagagagactagacagttttcacaaataacaaaggatttttatttttgaaaatattgctaaggcttgggatctacggctcgtcctagggtcaagggtggctctgataccaacttgtcacgaccggaaataacccaacgggctttcctgacgtgcgtgcattaatccttgtcccaggaggcaaggtacaccaaaagttgatacaattcagagtttaacaagcggaagcgtaaatagttaactt

SEQ ID NO: 69328 - DNA, 2373 bp, Oryza sativa
cggggcgcgccagaaggcggcctcgccggcacggccgacgggaagcggcgcgcccgcgccccgatggtagccggcggcgacctccggcgcgacggagcggcggccgagagaggggagggaagggggaagcgaaggaggcggtccacggctcaccccgggacgacgaggagggcggaaacgacaaccggagcggaggaaggcggcggcgctccgacggtcggcgggcgaaacgaaggggtggacgaggttgacggggacgcggcgaagccgaaggagatgacgccgagtcgggaggaggtccggagcgacgacggcgacgaaccggagctcggcggcgacggcggagagagaggaagacggcgcgggcacgaatccgacggggagagtgtgcggcgagtggcggaaacggaggagcgaagcacgaggagcgattatatagcgtcgggagggagagagggcggccggaggggaaggaatcggccgcggaaatctcggccgccattgatgacgccggcgaggatttcgggagagattccaaacgaatccgagggagagagagagggaaaaatggggggaaagggagagggaatcgcggggaataattccccccccactttaatgcgcgcggggatggcgggatgcggcggattcggcggcggcggcggcgctagggcacgggcgggcggcgggcgcggcgcgaggtaggggatgacaggtgggccccacccgtcagcgagggtggcgggcgggcccgcctgtcagcggcgcgcgcgcggggagggagccgatgggccgcgggggagaggagagagagggagggagagttgggccgagccggcccaagaagggaagggggggaaagaagacttttagggatttttctttttataaaacctttttaactttgtttatttcttctcaattattatttgtgctctgaaaattccactaaaatttatttacgcattttagacttttaggaaatatacaaaaatcctccaagccttatttgacttttaaatttgcacattttaattgttgaaggctttcacatgaattttaattattctcggcacaatttcgaggatgtattttagggtcgttttgggacgcgacattagtactccgagtaaccaagcactctcatcacaacgtagcccctctgtcagaatagagattcaaggagtaccatttctggccaaccttattctgttagaatccaaagatcttgatgtcatcctagggatggactggttagccaaatataaaggtgtgatagattgtgccaacagaaaagtaactctcaccagcaatgatggtcaaattgtaactgttcatgcattgccctctgaacctttaaggtcgagtctaaaccaaataactttggaagagattcccatagtacgggagtaccccgatgtgttccctgatgatttacctggtatgccgcctaaaagggatataaaattcagaatagatctgataccaggaacaactctgatccataagagaccttatagaatggtagccaatgaactagcagaagtcaagaggcaagtagatgatttgcttcaaaaaggatgcatcagaccaagttcgtctccatggggagctccagtaatttttgtggaaaagaaagatcatacctagaggatgtgtgtggactatcgtgcactaaatgatgtgactatcaagaataagtacccgctgcccagaattgatgatttgttcgatcagcttaaaggtgccaccgttttctccaagatcgaccttcgatcagggtatcaccagttgaggattaaagaggaggatatacctaagacggcttttaccactaggtatggattgtttgaatgtactgttatgtcttttagacgtaccaatgcccccgctttcttcatgaatttgatgaacaaggtgtttatggaatacctagacaagttcgtggttgtctttattgatgacattctcatttactcctgaaccatagaagagcatgaagaacatcttcgtcctgcactagagaagttgcgagaacatcagttgtatgccaagtttagcaaatgtgaattttggttgtctgaagtgaagttccttggtcatgtcatctcaactggaggagttgccgttgatcctagtaatgtggaatccgtaaccaactggaaacatccgaggacagtttcagagatccgcagtttcctgggtctcgcaggttataactggaggttcatagagaatttttccaagattgccaagcccctgacacgactgcttcagaaagatatgaagtacaagtggtcagaagagtgcgagcagagttttcaagagttgaaaagtcgcctaatatcagcacccattttgattctgcctgat

SEQ ID NO: 69329 - DNA, 2181 bp, Oryza sativa
ggagaggagagagagggagggaaagttgggcgagccggcccaagaagggaagggggggaaagaagacttttagggatttttctttttataaaacctttttaactttgtttatttcttctcaattattatgtgtgctctgaaaattccactaaaatttatttacgcattttaggcttttaggaaatatacaaaaatcctccaagccttatttgacttttaaatttgcacattttaattgttgaaggctttcacatgaattttaattattctcggcacaatttcgaggatgtattttagggtcgttttgggacgcgacaactaccagggcaagcagctcccggagcaggagggtgacgatgcagagccccacgctgcttgggaggtcactgcagtgatcctcactggctctcccgagaggacttcgttggcagtcaccgcgggtggagattccttctccgccgcttgccagaacgccgcactcctcgccatcggcacttttcaccagcgctacccggacgagttgcagcactcgccctaccgctaccaccctcgtcgcggaggagcccgcgactacgccaccttccgggatgctagctcggaggatgacgctaccatcatgcacctggcacgcatggtggaggcgtacgacgtggcccgtatcgacttccatcatatggtgcgccgtgggatggtcgagaacaacatgaagatcctagagctgcgtcaggagaatctgcagctcaagaaggacctagacgcagtggaggcgcagctgcatcagctcaagatcgcccagggagagatctgccgccccaagcgtcgccgcgtctgccgcagccagaagatcaccgcccgcaagagcacctccaggcctgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcgttagatgagcagttagtaggcttgcgcgtgtgttctttctcgtttgtcttttttggtttgtgtggggcatggttatgccggtgtgtggcataactgtgtcggagcctgtcttattttatttgcctaagcaacttgaactttaatgaaccaatttaacagcggtaataaatttaagaattatggtagtcgtgggtggttagttttaattgttagctctttctcggtttgctggttctgtgtggggttttcagatggtgacgaccaggagaaatgctaacaccagtgatggcaaccaacctgaaggcagcaaccacaaccaccaaggcaacccacctccacctcctcctccgcctccaccaccaccaccagacaccaacgccattctcacccaaatcctcgcccagcaagccaacatgatgaccgctttcctccaccacctccaaaacccgccacaacagaatgctccaccaccacccccacaacactctaaactcgccgagttcctccgcatccgcccacctaccttctccagctccaacaaccccgtgaatgctttggattggttgcatgccgtggggaaaaagctagacacggtgcagtgcagtgatgaggagaaagtcgtcttcgccgcccatcagctgcagggacccgcatctctctggtgggaccacttccaggctacgcagccagtgggacagccgatcacttgggcccgcttcaccgccgctttccggagaacccatgtgcccgctggagtcgtggctcttaagaaaagggaattccgagagttgaagcaaggcaaccgctccgtgatggagtacttgcatgagttcaacaacttggcccgttacgccccagaggatgtgcgggaagatgaggagaagcaagagaaattcctggcaggaatggaccctgagctgtccgtccgtctagtctctggggactatccggatttccaacgactggtggacaagagcatccgcttggaagccaagcacaaggaactagagtcgcacaagcgccgcttggcgaatttccgcaatcaacagggtgctaaccaaagggtccgctacaccaatccctatccagggggatcctcctcgcagcagcagcagcagcagcagcctcgctccgcgcctcgacctcaattcgtgg

SEQ ID NO: 69330 - DNA, 2401 bp, Oryza sativa
ttcccccttccctcccctctctcggccgccgctccgtcgcgccggaggtcgccgccggtgaccatcggggcgcgggcgtgccgcttcccgtcggccgtgccggcgaggccgccttcgggcgcgccccgcggctgccaagtggggcccggccgtcagccgcccgcgcccgcgggtgcggctgacgcgtgggacccacggcgccggccgccgccagccgcgtgctcccggtccaccgtggaccgaggggctgacgcgtgggccccactcccgtggacccggtccgcgcgccctctctcccggctgacgcaataaatgggtttttaattaaattttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagtcgaagccgtcggttgggaaagcgagcaaggctagtcacatcatccttgagcatattgaatccccgtttacaaaattatctttaatttaaattaatgcattatcgctttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaaattagacaacattaggtggttttataactttagactttgggagttctcatatcattcggacactatggaattgttggttgatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggaaatggatgaagccgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggttatgggcaagccgagcaatgtacccaagtcagtgtttcaattcttaaaatttgctcaacaacgaaaatgtggaatggttggcctgggttggcttgggacgagctgggacccagggtcgggttgccagttcggtctgaatcatcgtaggccttgggttaaggcaggtccgtgagggttcacggccttgtttaataatattgtatagctctaggatcgtctttacaaaatagctttggccaactaagtgacttttaaatgctgtttactgcaaaacttaacccctatattattaccccttgtacccccttgcattaatcatgcatctgccggtgtggcttgctgagtactgtggttgtactcattcttgctctatctttctcccccccccttcagtaagagaagctttggagaagatgtcttaggaggagtcttggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctatttgcaaaaggtttactccttttcttccttcttcaaatttcaactagtactagatggtcaggtcagtgaagaagaagacatcgtcagttgtttgccgaagctccggaagactgcaggatccgctagcgaag

SEQ ID NO: 69331 - DNA, 1495 bp, Oryza sativa
tctccagaatcaaaatgagcagccacgcttgtggttttcagttcactacttatcattgtgtaatcgaaagtttgcagcaatcatgtagtaaataaatatattcatgtctataaacagtgagcttgctatgtttatggatgattcctgttgaggatacaatgtaccgatgttaagcaccttccctttttgtttaaggcagggctttgtattcatgtaataagggagacatgtgtaataaaagcaagttctaggagggttattttggaagatgctgatatggaattatgtgtataattgtttactgtcaaaggagacctagggtctcatttcagaggaactatgttctaacctcgagttaataaccaacctgatgatagaaaagaaaatgccgagtccgggaagatatctgttgattcaattgtcaaggaatgggtcatttcgccgacaagtgccccagaccaagaaacatagctgccagcacgtcagtccacgcaactccttgcaatcagaagcttgctcctcagcgaattgtcatccatgcatcccgaagcagtcctatagaccacgttgcaacaactccaactccagcgagtgcattaccacaaggtgtcaatgctcaatttcagcccccgccatcagttgacaagacagaggccagtatcggcattgtacctttgaatgttccagcacagcagccaaagaaatcaagtacaagatgaagaacccgagcgtaagaaagctattgtctgttacaaactgtagtacctgttaaggaagcagacatgccaatcgccaagtggtcactggagcaaatgcagtacctgataagcctagcgctagtcaggagcaaccataatactcttatatcagtgttcaaatacttttgttttatagttgttccccgtcaatcatgtaataacagagaaacatgagataatgaatgagtttgataagcttatgaaggatccatgttaagagtgcaagtgctgtgagttgtgcacattttgtagttgattagggagacctagggtctcatttccgtaaacccataatctgttaggaatcaaatagcctagcgattgatggcgaagaaaatcaagtgatcaaccaaagaggcatttgtttggactaagagtttcagatgtgtctcttcggatcaaaggcaacaatcgtcagtctagcttttgacgaactacttcagggtttctctgaaagacagcacgcccaaggacctcattgccccagaagcatcctcaacacccggagcgaagagtacctggttgagaaaggtcgaaaggtgattaatggaagagatcggaaaagatgtttggttactgggaaaagaagtaggtcgaaaggtgattgataaaggataacgagaaccatgatttgtgtcactcgaggaagactcccgatagcaaacaaccctacaacagttgccctgtcattaaagtaggtgaattcacgagtaagagagatgaccacaggtagaagt

SEQ ID NO: 69332 - DNA, 4028 bp, Oryza sativa
aattcctgcagcccgtctacagaggtcagagtaaaatcacatctaacaacgaagcttcaaatttggccggataacgatcagacaataagaagtccagcagtaaaactatttgggaagacgtcaaagtatgtcaagtgggataagttggttctcttgggaagcataattcaaaggcaaagttatcgaccctggcatcaaatagcagaagtagctattacccggagaccgggaaagctaatatgagacagttggtggcaagttagaagtgaatgacaagcatgatattcttatgatgacaaacctggtatcctagtaatgacaagctagtgttgacgcatgacatgaagtggtgacttgtatgaggttgactccgaagatatgaatcatgagaagttctggaatggaagcatcattaaactaccgcaacctagtctgagtcagccaaaaggtgcaccctggttcaagtcaggtgaagagaagattccatccgcaacaggaggtcaagccaagcagttccgagtggtgaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaatccgaaaagaaattggcaaacactaaaatacgtacaagaaaaattcaaatgtgacccggagaatttttgttaaattctccttggtctaaaaggagccctcaaattttagtggaattttcagagcacaaataataattgagaagaaataaacaaagttaaaaaggtttataaaaagaaaaaccctaaaagaagtccttttcccccccccttcccttcttgggccggctcggcccacttctctccctttctctcctctctccccgcggcccatcggcacctcccccgcgcgcgcgccgctgacaggcgggcccgcccgccaccctcgctgacgggtggggcccacctgtcatcgccttcctcccgccgctcccgccgctcgcccgtgccctagcgccgccgccgccgccgaatccgccgcatcccgccgtccccgcgcgccttaaagaggggggaaatattccccacgattccctctctctttccccccgtttttccctctctctctccctcggattcgtccggattccatcccgcaaacctcgccggaacaatcaatggcggccgagatctccgcgccggtttccatctcctccggccgctttccctctctcccgacgctatttaatccacccccgtgcctctctcctccgtttccgccgctcgccgctcgctctctccgtcggattcgtgctcgcgccgtcctcctctctctccgccgtcgccgccgagctccggtttgccgccgtcgtcgctccggacttcctcccgactcggcgtcgcctccatcggcttcgccgcgtcctcgtcgacctcgtccgcgcctccgtttcacccgccgaccgccggagcaccgccgccctcgtcgacccgagccgcgccgccgtcttcctccgctccggccgtcgtttccgccgccctcgtcgtcccggggtgagccgtggaccgctccgctcgcttcccccttccctcctctctctcgggtgccgctccgccgcgccgttggtcgccggcggcgaccatcggggcgcgggcgcgtcccctcccgtcggccgtgccggcgaggccgccttcgggcgcgccccgcggctgccatgtggggcccggccgtcagccgcccgcgcctgcgggtgcggctgacgcgtgggacccacggcgccggccgccgccagccgcgtgctcccggtccaccgtggaccgagaggctgacgcgtgggccccactcccgtggacccggtccgcgcgccctctctcccggctgacgcaataaatgggtttttaattaaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttagtagagtaaaagccttttcttttccgttggtcgtgtagacgctgcagcttcggaagatccgctcttcgtggaagtcgaagccgtcgtttgggaaagcgagcaaggcaagtcacatcatccttgagcatattgaatcccagtttacaaaattatttttaatttaaattaatgcattatcgctctatttaaattcccgcgttatcactgttttatttagccaggcctatttacctttgttatgaccatactattattgttattgttattattaccttgttcaccctagaataaacaaaaccccaactagtggacactctactcatggcaccactagtttaattttaggtagatgcttcgcttttaattaggtaaccttaggcggttttacaactatagactttgggaaatattcatatcacctggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctatgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgctttaattcttaaaacctgcttaacaactaaaaggtggaatggatggcctgggttggcttaggacgagctgggacccagggtcgggttgccagttcggtctgaatcatcgtaggccttgggttaaggcaggttcgtgtgggttcacggccttgattaataatattgtatagttttagaatcgtgcttacaaaatggctttgagcaactaaatgtctttaaatgctgtttactgcaaccctaacccttcatattataattcccttgtactcccttgcatttattctgcacttgtgggtgtgtcttgttgagtacggtggttgtactcagtcttgctcaaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaaagcccgttgggttatttccggtcgtgacaactaaccatcaaaggacgtctaagatcttctacttccatcccatggtttccagcaaaactcatagatagaaaggaatgcgtagcaccagaatcgaaaagcactgttgcaggaactgagttaacagggaacgtacccaaaatcacatctggagcacgttgagcttctgcagcagcaacatggttgacacgtgcctttgtcgctggtgc

SEQ ID NO: 69333 - DNA, 3681 bp, Oryza sativa
cgtgtaacctctctccgccgcttgccgctgactccagccgcgtcgcgccgccgcttcggtcgacgccgacccgcgccgttgcctccctcagctccgctaggacgaggaggacctcggccgccgcccctcttcgccggaaatccgccggagctcctccttcctcggtcgccgatcgaggccgagcccgtccgccccatcccgagcgacgcccgtcgccagagctccgtcgcgacgtcttcctgaggagccccgccgccaccgttccttgccgtcggccgccccttcgccgtcgtgcatctcggtgagcactccacttcctctcccttttcctccccttcgtcggccgcctcccgggtgtcctcacgacgtgctgccgccgccggtggtcgtccgaccgggtcgctgccgccgcgctccgcgctccgtgcccgcgccgttgctggtggtgccgggcagacggttgccgcctaccccttgccgcgccgccgcgcgccgtcgtttggctaggccggctttgtgccgtgccttgccccagccgcgccgcccggctgtccccagccgtccgatcggccttggccgatctgggccgtccacgtggtggacgcgcacccgaggccacgtgtggacttggtccaccgtgcgccgcccctttgtgccgctaacgtgcggggcccgcctgtcggcgctggttccccttgctgacgtcagcaaatgccttttcctttgagaaattaatcatttaatacgcaataaattcgttaataactctagaaattctcttaatggctcaaaacctctaaaattcatatctaattcattcgaactccgaattgagccattcaacttgcaaaattcatctaaaattgagctcaacatgtttgtttactttttatgtactatttccttggtttttattagagtttttcctcgttttgcgtgccagcgtgtagaatccgtcgtttcggaagtccgcggtcgcgaggaaaagagttcggaagattgtttgaagaagcaaggcaagtcacacattccccttgagcatgttgatcccaatttacaaatgttttactgtttgcaaataaatatgcatattttgctaattacatggggtcagggtattacctatctgctcgcttgtgccatgtttacttgatatctgttctttgtcaactttgggtaatgaatcgactagctcatgttacttatgtgacctagctagaactatatgcttagccatgcttaattaccactagctcagttgatgggataattacagtattagacctttttagtatcagaatgagctgtgtgctcaagacatctggccatgcttcatggtcataattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagacgacacatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagttcaggtgggttggttgggcctgttcaatgtggtgtagcgttgatcagtggagatttaaagttactttaattactcaactattgtactgttttgctcaataaaatattttacaaccgcctttatgcaaatagccacaaaccgtccttgtgttccccttgcacgtctgcatcgttggtgtggcttgttgagtacggtggttgtactcagccttgctattattcccccttttcagaagtgtagtgcttctgagctgaagacgaagttagaagaccaaggctcagaccccagttgagttttgcctgtggagtggagctaaagccccgctaggatcgcctttttccgctgctgccgttctctttcggtgtgaggactaagtgcctcttctgtaagtatttacgttttatttacgttgggaactgtatattacttgtcgttttgtgtaccctggctggtcctggacagggatttaatacgcaaaatagtctggaaatttgggttaaatttctggacgtgacaaagtggtatcagagccaactcgactataggttgagccaaacggtcaaaccctaaggacaagctttctgaaaaccctatttgaaaaatgtctcccctcgcccttcggcttttctttgcgaaacagtttttcaaaattctcctccctgtccctccaattcttatagttgttaaaccgtggaggataaaccgtcagctttgtgtctgttcggaagtcaagtcaagcatcaagcttcatgcagcaaagagcgggaaggtccgcccagagtcgtcatcccgcgaaggtcaaggagagttttcctggagtttacctaaacccaatccttcctggaagagtagtttcgttagctgctagggcgtgtgttgtttgcttgtgtgtaggggtatggtttgcatcattggtggggatgcgaccatactaggttgtttgcttaagcaacttgaacaataaaagtctactcacaacagatcagtaggcaagtggtttagtacctcatctctagtaatccctctcattccctccccctctctctcgtgcctgcagcagatggtcagtgtgaggggcaatttcaacggatcaggatcccgtcagtttcatggatcaactcagctcaattctataagcttcccacgtcaacctctcaaagatcagccacaaccccaagtcatggctaatcagactcagacagtggaagagttgttacagcagatgcgacatcggtaccagatctatctgatgcagcagatgcaacggcaatgtcaggagccgcgtcaagtccaccagccacaaatgcaagtccaggtgccagcccggaacctgaatcagagtcagagtcaggagttcccaatatcggcacctaagacccctgtcaaagtgctgtccagatccccgaagataacttcagccaactcaccgtcggaccaaaggaaaataagtgctacctgttatgactgtggtgagcaaggtcattatgtaaggaacggtccatggaagatgttcgccaggtcacctgaaaaatacaagaagcagtgcccagaaagtaaccaagctccaagtcagtctaccgaccagaaggatggtactttgcagcccaactctggagcgaacaggacagtaaaatggaagatggataatggtaggaccatgatcatcaccagttcagaatttactcctgaagacgcagcaaggatacccaagcgtcagaaaggaagaaataccttccgtggagcacgccagctaacccgacatctcataaagtacggtccgcccagacccgaagatgatat

SEQ ID NO: 69334 - DNA, 2925 bp, Oryza sativa
ttcctgcacccctggtgaatacacccattactcacatgaatgccctttgaggaaggtcacatgtttcctgtgtgagggaaccgatcatgtgcctaaggattgtcagcggaactcggtcctagctttgaccaagaaagaacaagggacaaccgtgcaacccattcgtcaaccaatggcagtcgacgacatcagtcacaatccttctgctcttcctccaattccagcccgagtggaagccaaccatggaagaagcaacgtcgctagggatgttcataaatcactacttgttccagtttcagctgtcaatgtgcataaccagaagcttgcacctcaggaccaagcaagtcggttttgtctcaattgtcgtaagccaggacattgtttcagtgattgtcctcttccaagagcagcaaaggcagttcatcgtgattcacaagttaccagcactgcccacgacaccaatcgacacctgaatgtgcaacctccgcctcaacggattatcgtcaagggcaccgtcagaggccgcattgttccaccggccatcgtttcaagcctacagcaccagcgccagcagggtaagcaatgccaggagaacaacagctcgctacagttacaaaggggaggtacgctccttcgtcagcacccgcagcaagtgtcgccagcaccaggtcgctcgactattgtcagttctagcaatgcacctcgtattgctccaattcggaggtccatcggcaaatcaccgcttggtaaccccacgggcaagaagatcctacctgttacagctgtcaagacagttgccactccaccatcaaagattagcaagcagggcaacgttcccggtgaagcttcagctagtaggagttaaagaacgagtcagtcaggttcgaacaatggaagcaattgcagctctagtcaagccctttacttttccatcccagcagtagccttcaagtgtttatctttgtcgcatttcatcttgtacatagaagtttatggcagttatctaatgaaaagggaatattgaataaagtatgagtcaattagttttgctctccacttatatggtccattttgagcatgccaaagcaagttaacctgtgtatctgtcagtgctacaagaaaccaagagtttctcttctgactcatcgcaattttgttgagctcccaaaaccgatttgcgagccaatagaggaatggtttaccaacggagtgaaaatgattagaccctcaacactcgacatgatgagatctctctaaaggcagtgtcagtggtactcaaatgaaaagagtaatggaatatttgaaaaacgacatcatataaagaatcttgagaactttctaaccttggaagctgttagggggttgtaatcgacagttacaccctagtggtgcgagcatgaattcagtatgtgtttccttagttcaaggcaaccagtataagttccaggaatcatttcaaggtttctcagaagttgaaaaaaaaaaaaagaaattgttccatacatgggtcagaagtatatagagtcaagtccagaaatgtgtagtcaagtagggtatatggcagagtatccccttttaacggatcatcttcaccaaaaatatgaaagcgaagttgttatgatcaaagagcagaaactcttggcagcatcaaagccagtttccgatagttgttcagattgcaatattttccggaaaactgttgcaggatctatggtccgtcaacccaggaagagtcagcaaaggatggtcgaagaagtgaaatgtcatgccatgggaaggacctcttgagttcgatctgttaagtgatcagtgcttgtttcaaggaaggtcaactatgcaatctgtttaggtatatgacaacaaaaatcaagtcagaaccaagacagttgtaccagcagttagaactggttggggaagtagtcaagagttagtatgatcaggagctaaatgagaatttatgtatgtggaatttcctatcagcaactgagggttaagttccaaatcttgttgggatgatagtgcgtcgtcattgctctattttgatgaatcggtgaagtttcagttttcaaagtgagggtctttgtaagtccgagaagtgttggttattttccaaggacaatagtccagttgtttccagtcaggcgaaagtaagactactccctgtaaggggggtaggtctcggagatgagttttggctcacctcatcgctgtttcagttgaaggttcaacccactgcaacaatccgggtagtacttgaagaagtcagttgcaaagtgtcagcagagttacatcgattacaagttatctgattgaattctgaggtacactggtgaggcctggtcaacagctcagctttgagaagcagcatcagggacggttgcagttcagacgaaagacagttcaagcaggtttcctggaattacgtgtcattcgagtcaggacccgttcaagcggacgtaggatcaatgagttacaaatggtcgatgcaagtttcaccctcttctaccagcttggtgaattgtcaggttattaaattgctagtattgacagttcagcccaggataagtaagttttatgagtatctgcagtcctagtctgcgtcagttcaagcagaaccaatcaattcaggtttgggaagcaacgggacaacagtgttgaatccagccagatcgctcgtataggtttgatcagctaatcggtcgtgttgggtaccagaactccagggatctaatccgatgataccagtcagttcagtcgtttggatcaaagtaacagaaaggtcaaatctaacctgttcagttatgcaggtttggtccatcaagcaatcagatagttgaatcagaaagagtgtcacgtcccacaacgaccctaaaattcatcctgaaaattgtgcaaagaataattaaaattcatgtgaaagcctcc

SEQ ID NO: 69335 - DNA, 1819 bp, Oryza sativa
ctgcagcccagccttcctgtcttttccaggctagcgcttacacatgttgtatggttgcaaaacctaattataataatccgcaaatctccatataacagcattaaacttcggatgatcatctcttggtcatacgaaccccgaatcgacccgttcaagtctcctaatatttgttataacctaaagaagcatgtgctttcttttttatgtattgttatcgcttctttacaggcttatagctttgcatgtgtgcttcgcgtagtttctgtcgttccgaaagttcccgaagcgtggtttgctgtcacgaccggaaataacccaatgggcattccttacgtgcgtgtattattccttgtcccaggaggcaaggtacaccaaaagttgatacaattcagagtttaacaagcagaagcgtaaatagttaattattacatgggcagcgagggcccagcacacacgaagacaacgaataaacagcggaagactagggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcataaatgcaaaggagtacaatggagttataatatagggggttagggtttgcagtaaacagcatttaagagacacttagttgctcaaagctaaatttaaaacgtgatcctagaactatttgatattattaaacaaggccgtgaacccacacgaacctgccttaacccaaggcctacgatgattcagaccgatctggcaacccgaccctgggtcccagctcgtcccaagccaacccaggccgaccattccaccttttagttgttaagcaggttttaagaattaaaacgctaacttgggtacattgcttggcttgcccataaccgagggcgcggctattcgaataggttttactctgatcagaggtgtacatctttacccacaagacacgtcttcctcatgtgcaaccacgtgccacataccaccacggcatatggacggaagacatgacatagtttccaacccatcctagccatagacaagagtaccgacccaacccacctacggccggaacccccggacaggcaggcagaattgagcccctagcagcaggacaccagccctgtgctatgacatctcgactaccgggctgcagcccgtgtagccttcatttgtcctagagatgtccatcgacccccgacttcgtccatctctatccgtgtacttttgtttataaccagactgagccacaaactaagccttacccactagacatgtggaagtacggtagtgctttgcaacagaggcccgaagaccggtccttatgtggccgaggtgctactatcaaaaccatgcaccccaagcccagcctaaaaccattttgagagttttgaatagagggggaggtgtgcgtccaattccacaataatccaaccattccatagtgtccaagtgatatgaatattcccaaagtctagagttacgaaaccacctaatgttgcctaattaatcagcgaagcatctacctaaattcatactagtggaaccatgaatagagtgcccactagttggggttttgtttattctagggtgaacaaggtaataataacaataacaacaataataaggtcataacaaaggtaaataggcatggctaaataaaacagtgataacgcgggaatttaaataaagcgataatgcaataatttaaatcaaagtaatttcacaaagtgggatccaatatgttcaaagaa

SEQ ID NO: 69336 - DNA, 1360 bp, Oryza sativa
attcctgcagcccgattttgcctgatccaaagaagggtttccaagtgtactgcgatgcatccaagcttgggttagggtgtgttctgatgcaagataggaaggtggttgcctatgcaactcgttagttaccctactcatgatcttgagttagccgcagtggttcatgcgttgaagatttggtgtcactatctttttggtactcgtacggaggtgtatacggatcacaaaagtttgaagtatatcttcacccagccggatctgaacatgagacaacggaaatggttggaattgattaaggattatgatatgggaattcattatcacccaggaaaggctaatgttgtagcagatgctctcagtaggaaaggctatagtaatgctacggaaggacgacagttgccgttggagttatgcaaggaatttgaaagattaaatttgggaattatcagtagagggttcgttgcagccttagaagcgaagcccactctcattgaacaagttagagaagcccaaattaatgatcctgatattcatgagatcaagaagaatatgagaagaggaaaagctatcggtttcttggaagatgagcaaggaactgtatgattgggtgagaggatctgtgtcctagacaacaaagatttgaaagatgcaattctgaaggaagctcatgatactttatactccattcacccaggtagtactaagatgtaccagcatctcaaggaaagattttggtgggcaagtataaagcgtgagatagcggaatatgtagcagtatgtgatgtttgtcagcgagtcaaggcagaacatcaaaaacccgtaggtttgttgcagcctttgaagataccagaatggaagtgggaggaaatcggtatggatttcattactggtctacccagaacgtcatcgggccatgactctatttgggtgatagtcgatagacttaccaaagtggctcatttcatcccggtgaggaccacctattccggaagtcgtttggcggaattgtatatggcaagaattgtgtgtttgcacggtgtgcctaagaagatagtatccgatcgaggtagccagtttacttcaaaattttggaagaagcttcaggaagagatgggttccaagctaaacttcagtaccgcttatcatccgcagacagacgaacaaactgaaagggtaaatcagattttggaagacatgttgagagcttgtgctttagacttcaatagaagttgggataagattttgccttatgcggaattctcgtacaacaacagttatcaagctagtcttcaaatggctccttacgaagcactgtatggtcggaagggccgcactccgcttttgtgggatcaaacgggag

SEQ ID NO: 69337 - DNA, 8711 bp, Oryza sativa
aagattacgtgtggctcagtctcgtcacaagagttatgccgacaatcgccgtagagatctaagttttgaagaaggagatcatgtgtaccttcgtgtcacgcctcttcgaggggttcatcgttttgataccaaaggaaaattggcactgcgtttcgtgtgaccttataagattgtcagtagaagaggagaggtcgcttatcagttggagttacctcaatctttggcaggagtccataatgtgtttcatgtgtcacagttgaaaaagtgtttatgggtacctacttaagaggccaatcttgaacagatagaagtccaagaggatctgacgtatgttgagaaaccaatccgtatcttggagacagatgagagaagaaccaggaattgagttatccgtttctgtaaggttcaatggagtaatcactcggaagaagaatctacttgggaacgagaagatgaattaaagtcagctcatccgcatctgttcgccagttcttccgaatctcgaggacgagattctatttaaggggggtaggtttgtcacaccctaaaaatcccaaatatataaattgttgtttaattagaattattagaattgattttaaaagcctagaagagaagatctaattttaaataataaattccaatataaaattgggccagataaaattttattaaatactttgcttgattctatagttcctagatttttctgggatttatttgagccaaggaagtatttttaataaatggaattgcatttcatgaataatttaaattggaaaagttttaaaaagtcttcttttggctttgggccgaaagtcggcccaaacctctctctctctctcctccccggcccaggtcagcccgcagtcgagcgccgcccgcgcgcgcgtcccgctcactgacaggtggggcccacttgtcagtcttcgtctacctccagccgccgccgcgcccgaaccctaactgagccgcgctgccgtctccttccaaattcattcatccctttcccgatccggtcaaattgatagaggggaaatgatccccgagatccactcaaacttttctcttttggaatcgtcggctaaaatcgtttggaaatccgtggattcgatctcgaatcagattcgtctctctctccgaaccctaacctttccatcgccgccgccggtcgccgtgggccttcgccgccgccccctagcctctataaaaggacccccggtgtctcctctacccgccaccaccctcgcttttgtctctcgtcaccggtagagccctagtgtcacgtcctgataaattcatcccaaaaataaaaatcgttctctaaaaaggaataatagaattaattaaaatttgaaaagaaattggcaaacactaaaatacgtacaagaaaaattcgaatgtggcccagagaatttttgttaaattctccttggtctaaaaggagccctcaaattttgcttgaattttcagagcaccggaaataattattaagcaacaaaaacaataatcaaagtttattaaaaagaaaacctaaaaataatcctccttttcctttgggccaagtctggcccaaagtctccctctctccccctcggcccgcagtccaagtccctctcccctccctttgtttttctctctttcctcccgggcagcccactccctcctcctccttcctcctggcctgcctcggcccagccgcccggcccaagccgcgcccttgcccgagtcgcagcgccctcctgtcgtagccgcgtgcgcacgagcgccgcacgtgcactgaccgcgcccccgcgtgggacccgcctgccaggcgcttcttcctcctcccgcacagctcttctctctctcccgtgaaccctagtttcttgctctctcgaatccgcgcgattcaagcgttggattccaaaattaattggggggaattaatcccctttccttcctctcccttttccccctaatctcccctttaatcgtgcactattttgaccggagcggctgcgccattcatggctgccttccatggccgtcgggcgccttttccgccgccattccccgctcctcccgtcgccggctcgttcccttccgctataaatggaaccccttctttgcgttctatcgttttagccccttcccgagctcccccgcgaccacaccacctctccccgcctcctccttctctttcctcggtgccggccaccctccagccgcccctaccgcctcacccacgcgccgtccggccgtgccgccgccttccccggcgtcgcagcagcctcctctcccccggcctgccctccgtttcgcgcggagaccccttgaggtgcgcccccgccggcaactgtggcgttgccaccactgttccgcctccggccgccactgtcgcgtttcccgtgcgccggccgacgtcgccatcacctccctcgtctccgcgacgctgccctcatccccggcatcacctcctccccgcccgaagctcgccggagtggccttctcgtcggcatccagtacctccccgcctccggccggctcctgtacgtcgccggtacgccgatcgacgttgcagcgttgtcctctcctccagctgctcctctgtttcgccggaacgccgtcgcccgtgctggcctctccatcctcattgtcgctgatgtcccttcggccgcccgttcatcctcgccggctcgtcgtctcgcggcgccacctccgtcgtcggcatcacagcggcgtgttccgcgccgtcctcgtctccgtgcagctgctgctggctgtccctcgtcgcctcctcgccggccccggtcatcgttgtcgtcgtcctctcatcgttcccggtcgtcgtggcgttcgtccctccgtcaagccgttcgcgttcgccgcccgcgtttcgtcaagtgtgcagcagccccgtcatcgtctacgtcctcggctccgcgtcgtcaagtctcgtgtcggccgtgtctcgccttcgtccaaggatcgccaccgaagccatcccctcgccgttcgtctccgttgtgcccgtccgtctccgccgcgcccgttcgtcgtggtcgttcccacgcctcgtcgcgtggtggtaaggatctctctcctttcgctgccccgtcctcgtcctttcggtgtcgcccgtgcccgttgtgcggttgtcgaccccggtgcccgtgtaccggtgtcggtaatcgttcgtgggtgcgtgtggtgaccgtgtttgtgtgcccgctcggtagccgcgtggtttccacgtgtgcagcccgcgtggtgtctagtggagtccgtttgtcggccactcgcctcggttgacacacggggtccgcttccgtcgacccgtggaccgtctctgtgtactcggtctaccgtggtcccttaggttgacatgtggggtccgcatgtcaacagtgcagccttcctgtcttttccaggctagcgcttacacatgttttatagttgcaaagcctaattataataatccgcaaatctccatataacagcattaaacttcggatgatcatatcttggtcatacgaactctgaatcgacccgttcaagtctcctaatgttggttataacctaaagaaccgtgtgcttcctttttatgtattgttattgcttctttataggcttgaagctttgcttgtgtgcttcgcgtagcttctgtcgttccggaggttcccgaagcgtggtttgcggtcgacgccgaaggttcggaaggccgttctctctgagcaaggcaagtcacatcatccttgagcatattgaatcccagtttataaaattattttgatttaaattaatgcattattgctttatttaaattcccgcgttaccattgttttatttagcattacctattaatccttgttatagccttattattgcaattgttattatcaccttgcttaccctaggcaaacaaaaccccaactagtgggtactctattcatggttccactagtattaatttaggtagatgcttcgctgattaattaggcaacattaggtggttttataactctagactttgggaatattcatatcacttgaacactatggaatggttggattactgtggaattggatgcacacctccccctctattcaaaaccctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcagcccggtagtcgagatgtcatggcacagggctggtgtcctgctgctaggggctcaattctgcctgcctgtccgggggttccggccgtaggtgggttgggtcggtactcttgtctatggctaggatgggttggaaactatgtcatgtcttccgtccatatgccgtggtggtatgtggcacgtggttgcacgtgaggaagacgtgtcttgtgggtaaagatgtacacctctgatcagagtaaaacctattcgaatagccgcgccctcggttatgggcaagcctagcaatgtacccaagtttgtgttttaaattcttaaaacctacttaataactaaaatgtggaatggttggcctgggttggcttgggacgagctgggacccagggtcgggttgccagttcggtctgaatcatcgtaggccttgggttaaggcaggttcgtgtgggttcacggccctgattaataatactatgtagcaataggatcgtctttataaaatggctttgggcaactaagtgacttttaaatgctgtttactgtaaaacttaacccctatattattatccccttgcactcccttgcattaattatgcatctccggtgtggcttgctgagtactgtggttgtactcatttttgctcaatctttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgccttttgtatcatgtttgtttggtgtaccccggcttttcctgggacggggattaatacactagcgttcgggaaaaggcaattttctcggtcgcgacaagctggtatcagagccatctcgactgtaggataagccaagtggataaaacctaaggacatattttataaatgaaactatttgcgaaagttcctttttcctcctttcccctgtgctatttgcaaaatgtttactctttcttccttcttcaaatttcaactagtactagatggtcagctttgcggagaagaagatgtcgtcaattgtctgccgaagctccggaagactgcaggatccgctagcgaagtggaggaagcagtgaagctagctgtgaagaagcagtgaagatcttagagaacccgtcgcagaacccaagccaccctctagggtagagtcgttagtcgtgtgtttccttgcttgtgtgtgtagcgcgtggtttgcatcagtggggtgtgatgtaaccatgttaggttgtttgcttaatcaacttgcagaataagtgaaacagacaacacatcaacaagaagagttagttcctttaaggtcctgtctctagtgctggtctattctttcctggcttgttttcctctctcacctcaatccctgtcacagatgtttaacagagaaaaaggaaagaatgtcagcgggtatgcctccagtaactcaagttttcaactcaatccaccattggcctcaagagagttaacaagggcacacccttggtccattccaagcatgctgcttagttcacagctaccattggttggaagtcaagaccaaaatcagtatgtgtttgatcgagcatttgccacccaggtcaatgagcttccaatgccagaagaggatgtccccttttgtcacgattgtagagaacaaggacactatgccctgaattgtccatgggtatatgccaaagaagccccttcctttggtttagcagggcagacatcgctaaaccagcctcctcgcaccaagtcaagcttgcagcctagtgtgcaaagtagagagcccaatggagagaatccattgaatcccgggaaatgctttcctcctagcctttcgtaccatgtggggtcacgtactaagcaagccaaaggcaagaagagtaagaatcagaagagaaaagcaccgatgcgaactgaagaagaagtatgtaagatgactattaccagcaccgaatggcctccggcagggataactattcctagacgtcaaagaggaaataccttccgaggtgcacgacagttgacccagcacctcctaagccatggtggcagagtatctgatagtgaagggtcagatcaagtctcctcggatgatgaagatgagtctccctgacatctcggcgaggaagagatggaatcaaaagcatgcacccgttgtggagaaattggacacgttgctagcatgtgtctcacactctgccctcattgtgaagaggaccatccaccaggggagtgttccactcgtaaggtcacatgttttctatgcgaaggtacaaaccatgtgcccaaggattgccaactcattgtgttgttgaccaagaccacagaaatccaacgaacaaccctacgattgtctcatcagctagtcagctccaaccacaacatcgacgatatcctccacagcaccgatgctcctcctgctgcacctgactctgcaataaatcatagcaataataccttcagcaccaaccattctctgcaccgacagcctcagcaaagagttgtcatcgatggaagaagttgtgtctctccccgacctactccaggccgagggaagggcaatcaacctcaggagggcgataccaagcagaagaccgttatccgcttcaaccagcaatcagaaggaagcttctcctatgaatgatagcaatatgcagtcctatcacatcatcacagaaccaatcaaggatgatgtagtcactagaacaatgccagctatatctctccagaatcagaatgagtagccatgtttgtgattttcagttcgctacttatcactgtaatcgggagtttgcagcaatcatgtaataaataaatatattcatgattataaataatgagcttgttatgtttatggaagattcatgttgaggatgcaatgtaccgatgttaagcaccttccctttttgtttaaggcagggccttgtattcgtgtaataagggagacatgtgtaataaaaacaagttctatgaggactcttttggaagatgctgatatgggattatgtgtataattgtttactgtcaaaggagacctagggtctcatttcagaggaactatgttctaacctcgagttaataaccaacctgaggatggaaaagaaaatcaagtgattaaccaaagagacatttgtttggactaagagtttcagatgtgtctttttcggatcaaaggcaaagacagtcagtacagcttttggcgaaacacttcaaagtttcattgaaaggcagcagaccaaaggacctcattaaagagtaccacctgttagatgtaggccgaaaggtgattgataaaggataatcagaaacatgctctgcatcactcaaaggagacccctgatagtaatcgccctgcaacagacaccttgttattgaggtagaaaaaaaatcgtgagtaagcaagatgacctaggtaaaagtgtttctatgaaggcaaggagtgaaatcttcaactcagtatcagatgctacacggagtgaaaactgcaagcaccggttaccaggcaatgccatgtcttgggagatgatccaatgggaaggaactcatcaaggtcaaaggtgtaaaggaatacggtgaatgctaaataatgacaacctgaagataatagtgggaagtaaactgaatgtaaagaaccaagtgatatgttcgaagatagtctacagaggtcagattaaaatcacatctaacaacgaagcttcagatttggcaggataacgatcagacaataagaagtacagcagtaaagccatttgggaagacgtcaaagcatgtcaagtgggaaaagttggttcggttgagaaacataattcaaaggcaaagttatcgacactcgcatcgaatagcagaagtagctagcacccggagagcaggaaagctaatatgaggcagttggtggcaagttagaagtaaatgacaagcatggtattctcatgatgacaagcatggtatcctagtaatgacgagctgatctcgacgcataacgtgaagtgggtaacttgtatgaggttgacgccaaagatatgaactatgcgaagttctggaactgaagtcccatcttcaagtgccacatcccagtcgaagtcagctagaggtgcaaccagggaaaagtcaggtgaagagaagattccatttgcaacaggagatcgagccaagcagtccagagtggagaagttttgttaggcaagtttgttatagaagatggagcggaagaagtcagacaagaagagaagaccacccaacctatcttcatgctagcctcctcgaatctcggggacgagattcctgtaaggggg

SEQ ID NO: 69338 - DNA, 3240 bp, Oryza sativa
ttatttttgtttgtcaggcctgaagtgcctttgtaataatgtaaatattatcgatataataaagatgtgccttttgtatcatgtttgtttgatgtaccccggcttttcctgggacggggattaatacactagcgttcaggaaaaggcaattttctcggtcgcgacacctagcgtcgtgtaccctagcgccgctgtcgccgccgttcgtccagctgtgcgccgccgttgctccggtcgtcgtcgtcgctcgggaaggccgtcatcgtgatcgtcatctcgtcgccgtcctcgtccgcccctccgtcgtcgccgtagatcgccggagccccgccgtcgttgtcaagccgaaggtcaccgccgcttcttcctcgacgttgtcgccgtccgttgaccttccgccgctgcttcggtcaccggtgagttcgccgtgtcgcccgcaacccggaggtgtcctccgttcgcgccgtcgtgccgtcgttcgccggcgagcatgtgccgtccgagccgtcgccggtgacgacgtcaccgctgacgtcatcgacgccgtccgccgtagaccggtcgtagaccgttagatcttgtccatccgttttggatagatcgatctcggccgtttgtttctgtgaaccgccgccgtgcacccggtccaccgtgagccgagtccgctgacgcaataatccccttttccttttcaaaaataattcatgagatatgggttcagctggatattagatataattacttagccatgcttagaaacattagcacatagttgggataacttatgcttcactattatttaatgatggcttaatgatagctcatgatggttaatcatgattggttaattaattaatttgccaactaaaacctgataatggtgggttgtgagcatatggttttgatggttgtgctcatgacaattaaggaccggttcacgattttcggttgtgaaacatttaccgtgccaaccacaagccagcgtaggcaatggctttactttctgtatagtatggttcatagtagagcaccagactgtgaagtggcagagataagcccacgggggtcgctgggtagtccataccttgtttataagggggtgattatgatccaggaacagtgcactgctttgaattgtattatatagagggtattgtcacaatctatattcgggtacttgttaagtatcgcgacgcatggttgacatgatgttgaggttgtgtcttgtgggtacagtgctacacctctggccatagtttaaactattcgaatagccgtgcccgcggttatggtcgcgtctaacaatgtctttcgtgattagtttcacattcatgcttgtcaggaggtggcaaggatcgccatgggggagctccgcgaaagctacaatgatcggttggccgacaccgagtatcgctaccatcctcgtcaaccccaaggaagtgaccgtggcagctaccttgaacctgcagggattgagaatgatgctaccacaaggcatttggttgagatgctgtgggccatggatgagacccgcggtgagattgtgatagcagctcaggatcgcaaaaccggaatcgcggcaagatttgcaagctggaggacaaggtggatcgtttagagaaggagctagccgcgttgaagggagaagcaccaccgcaaaaggccagggttcatcttaccgcaaggaagagagctctattcgttcctcgctaccagttggcgccaaaggttcgtgtggtggaaaaagaaactatcccagccccagcggatcctccggtcgtcaacgtaagtgatgatgatgaagaagaatccaagcgcacccattccaaggtcgagtggggagcaactcaagatgatggagacgcaccgaacgagccttcaatcaactccgatgcccggaaaacctagaatgccttgtcaagtcgttatcttagatcgttgtgttagtttgcttgtttaagtttggttgtgtgtgtgggtcttgcatgtggtttacatcagtggtgggatgtaaatgcatgcctttgtttgcttccgagtgttaggaagttggtgagtttagtggtgtgagagtcttcagttttgtaataatgaaactcagttaagatcaataaaagttaagttagtaaaaattaattccctgtcctaagtagtttttcccgtttctctttttgtgttcctatctatgccagatgttgcttactcgcagcaacgggaatggccccaaccccaacaacaacaacaacaatgcagagaatcccacgcttgctcaagtcctggctcaacaggcacagcttatgaatttgatgatgcagcaactccagaaccagcagaaccaggaaaacaaccatgcacctcccccaaataagctggcagaatttcttcgcgtgaggccgcctactttctctagcaccaccaatcctgttgaagctggtgattggctgcacgccatagagaagaagttagacctgcttcagtgcacagatcaagagaaggtttcttttgcttcacaccagctgcatggccctgcctctgagtggtgggatcacttccgtctcaacagaactactgctgaacctatctcttggcttgagttcaccgctgctttccggaagacgcacataccatcgggagtggtgtctctcaagaagaaggagttcaggtcgctcactcagggatcccacactgtcaccgagtatctgcatgaatttaatcgcctggctcgttatgctctggaagatgtgcgcactgatgaagagcgccaagagaagttcttagagcacccgcaatggtaaagtaaggtgctctctataaaacatgtacatctcagcaatagactagattaatagtaaaccacctcaatagtatgtctacaacagtatctatagctctctcatgcattgcctcggttttctctatagactatctctaagttagtagatagctttgctctctctcttcatttaatatcttccaaataggaaaatatgctgacatggatctcttgtagagagcctatagataaccattgtgggtgccctaaagggctatatgatgagctttcttacccactcatgactggggattatcatgatttccagaagttagtggataaggctattcgccaggaggacaagtacaaccgcatggagcagaagaaacgccgaattgctcacttcaaggctcagcaggggaatagtcagaggccgcgtcttgctatgggacctcagtcagtgtcac

SEQ ID NO: 69339 - DNA, 840 bp, Oryza sativa
caataatccccttttccttttcaaaaataattcattattgcgttataattcaattaaaatccatataaatgatttaatccgatttaatatttgaaaattcataactaattaatcttagctcggatttagttcgttcaagtctctaaatttttctaaaattgagatctacatgttaaaaatatccacgtgtattgtttatgcttgtttatgtgctgttttggtgattttgttcttttctctttagattccgacgttcccggagagtccgaatttgtaggagaagactttgaagagttccaaggccagcaaggcaagtcacacagatcccaaacaaccctttgagcatgttggtcccgtttaaagctattgtttctattcaactattgcatttattttcgaatgtcattgggtggaattaacctattgttttgttatagccctttttgttcttgattactctattccttgataccttgggttattataacttgactagttgagctttatatatgggttcagctggatattagatataattgcttagccatgcttagaaacattagcacatagttgggataacttatgcttcactattatttaatgatggcttaatgatagctcatgatggttaatcatgattggttaattaattaatttgccaactaaaacctgataatggtgggttgtgagcatatggttttgatggttgtgctcatgacaattaaggaccggttcacgattttcggttgtgaaacatttcccgtgccaaccacaagccagcgtgggcaacgactttactttctgtatagtatggttcatagtagagcgggctgcaggaat

SEQ ID NO: 69340 - DNA, 1502 bp, Oryza sativa
attcctgcagcccagcatttagctgaaccaatccaatatataagtttcatgctaatcaaattataacccataggaaaataaagtcatctacagccattaattaattgggaaaggttcaccacccaatgacattcgaaaataatgcatagttgaaataaaataatagctttaaacgggttcaacatgctcaaaaggttgtttgggatctgtgtgacttgccttgagcttccgcaaacacttcggaaccttcctcgacagaaacactctcctccggaacgtcggaaactaaagcaaaaagactaaaatcaacaaaacagtacaaaaacaaacataaacagtatatgtggatatttttaacatgtagatcttgattttagaaaaatttagcaacttgaaccacctgaaacggatctacggttatttagttatgattttccgaagatttaatctattagaaaaacgggaaaaagaaaaagatgatgatgtcatgatgacatcatcaacggtggccggaccgagatggcgacctcgccggagctagggtggtcggctgcgaatttggagggtatgtacacgtagaggacgacgagacgaacccggcggtactcaccacaacgtctaccgatgaccgacgacggccggcgacgagagggtggcggcggcggctcgggttgcgtggtggcggcgggctacggcggccggcggcaaaggagaggtggcagccgggcttctccacctcctggaaaagccaaaggcggcgacgtcaagcgacggcgacggcggaggcggcggcgcggtgcggatggaggatggccagcggcggcggcgagctaggtggcggcacggcggctctaggagtcacgagagaggacgggagagggggtaaacgaaagaggaggactagggggtcctatttatagccttggattgaagagatcggactcctcccgcaaggaatcgatccgggaaatcaaaaactcggttttgaagataaactcgaaaacgagttcgattcgggcaaaatactcaaccaattgctacgattcttgaggggaaagatagaggaagatgtgaggataaaaacccccctaacaatcggactcgggatggccggattagacgcggatttgagggagaagggggcggctcgggcggcttgcttggccggccggctggctgctagaggttagggaagggtccgacatgtggggcccacatgtcggtctcccgagtggagggggcgacggcggcgggctgggccggctttgtcgcgcgggagagatgaaatgttgggccaaaaatggcccaacgactttagggagggattttagaactttttaattaaaataatttgtgaaatgttgttccaattattaaaaatacttcccttgctcaaataattcccagaaaaatctagaaatagaggaacaagaatagtatttaataaaattttatctagttcatctttatgttgaaaattttcctagattactagagtttag

SEQ ID NO: 69341 - DNA, 1753 bp, Oryza sativa
ctgatgatcttcttgagtccgtatttttggctttgtaatatatatgatgcaggtatgtcacaatttgtccctaccgagctccacatatcagccttagaatagggataaattctggtacattttgccttggtgaggatccaaaaagaaaatatacatccttgagagataagagagaaagtcaatacgaggaaaagagctagtttgcgaaaattcataaaaatcccatgagtctggcacagaagcaagagggaatcgaatcgagatcgttccatttatcaattgctcaagatggtaagatagccattgataaagttcacaggtacatgtatggttgtaaatgattttatatgcctgattcatatcttgaagaaattcattctacactaacctttactcagggatgagcaaagaactaagtgtggggggttttgttggcggctgttaaattttgattctataccgccaacatctgcataaaagtccagataataaaacatccaacatagtgataggtgcttaatctcacatattccacaagtgttggtgtatatttgtatgcaggtgataaaccccgaagttgggaggaaatctagactaaagtgaggagaatcttgtatcaacacaaggatgggttgtgaacttcatcaaaataccagagaatcagcccaaaataccgaggaatggatagaggaggatcaggggaggacatgggccaaaggccaggcctggggggcatggcccaagttcggcagaaccctggtgatcaccgttgatctcaggttttggcatggacattcgagatcactccttgatggcggttgcggggcagttcggacatttccccttcgctaaccgtcatacctacctctatataaagacttcactttactcacttcgacacacacttccaagcttgagctgaattataagaggctctattgtactatattgcatactagaataggaagagagtagagtagaagaagtcggaagaattctggagttgtcgataatcttctctcatttatttattctgttaattactctgaattcaatataatattcttcctgagtaatttagatttatctcgtgagaattatttcttggttagtgcctaaatagcatacgggatcattgatcactatagtttatttatttatagtggttgctttagtgtttgatcggcactagagtagttattaattgcgtagacgcggtgtctgggtaattaatctacagtggttgctgcgcatcccacagtacgtttgaggtaggtgtagaggtggtgacagcactcaagagcacttaagtcctccctgtccgggtacgtagtagagcgacatctaggaagagcgggtggccagtgcccgaagtattgcgttaggattaaaattaagctttccgtagacactgtttagtgtctttggataaaccggaggaagatctgaccacacacgttcccttggattcaatacccttcgaatactctgtaggggaagtgctacatcggtatatccgtgcgcttgcggatcttatctgtgatcgtaagaaataccaacaatgatctaagccctttaagaaaatattttcttcacataggttgttcgaaaatagattttttttcttatctacatgctttaacacactaagattttctggaagaattttctctcgtattggatgtaacatccattatctacatgttttcacttgcccatcgtcattttgccacattgactgcgatcgagaagt

SEQ ID NO: 69342 - DNA, 1244 bp, Oryza sativa
  unsure (1)..(1244): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcatcactccaccaagtcgccctcacatctctcgcttagaccagtgcaacgtgcaacacgagctagctggcttcgctttggtcgtgggtctccatcgtcgccggggctcactagagacacgaacgacatgagtacgtcgctcatggctgtgttgtgatgtcattgctgttgctccgggtggtcgccatcatggactcatggttcactcacttgaatcagaaaagtaagggctaatgggcctttttttttttgacaacttctttaagggctcatatcatgaaaaactaaaatcctaataacctaatatttttgtatttgttatatttttattttacccgttgcatctatttattaaaatgtttaaataataaaaaaattctcgatcggtcccctcttctctgtttttctctttgttcctgtctgctctttttttttaaaattttttttcccctcactgtctaatcgtctttcattttttttcatgtctactaattaatatttgacttcaaatataatttgtaactcaaaacaatactcactctcacaaaaataaaaagattgatttttacgatttgttaaactccacacattttatttcagataacatacacaggtatattcccatagtttcttgtggtgaaaccagtcaatctggattcaaatctttgatttgacacgtgtgcttgaggcttccgtggtgacttcgtcaatctcaatgctcgtgttgtgagagcgtttatgtgtttcttaaaaaaatatatattctcgaaattcaaagtacatcgagtacaaaaattccactcgtattttatcagacttacctactgtggagattatgggtaccccatacccacacggcatggttatccgactagtaataggggataacatatatgtatggaatatgtaacagatcatgacttgggtattacgttttcttttatattatggagcggcctaaagtcctgatttgataatattgtaaagtagatttaggaagccgataccgtgttggttaaggtttctatcttgtaatcctgccccccaccctatataa

SEQ ID NO: 69343 - DNA, 823 bp, Oryza sativa
ccgcctgcacggctggcctattatgccgccgttgttgggcgtctacatcttcaccgacctgcttgccttcgccgccgccgactggtgcttccgcctgcacggctggcctattatgccgccgttgttgggcgtctacatcttcaccgacctgcttgccttcgccgccgccgactggtgcttccgcctgcacggctggcctttatgccgccgttgttgggcgtctacgtcttcaccgaccggcttgccttcgccgccgccgactggtgtttccgcctgcacggctggcctattatgccgccgttgttgggcgtctacatcttcaccgaccggcttgccttcgccgccgccgactggtgtttccgcctgcacggctggcctttatgccgccgttgttgggcgtctacgtcttcactgaccggcttgccttcgccgctggcgactggtgtttccgcctgcacggctggcctttatgccgccgttgttgggcgtctacgtcttcaccgaccggtttgccttcgccgctgccgactggtgtttccgcctgcacggctggcctttatgccgccgttgttgggcgtctacgtcttcaccgaccggccgcctcgtccgccgccgactggtacttccgcctgcacggctgacttattatgccaccgttgttgggcgtctacgtcttcaccgaccggccgcctcgaccgccgccgactggtgtcaccgcctgcacggctggcctgttataacgccagctgatgctatcttcttcacggcggcctacatcgctgtcactactaataggcatcagtatcttcagggctgcaggaat

SEQ ID NO: 69344 - DNA, 5013 bp, Oryza sativa
attcctgcaccccagtgttgtttggtttagataacaatctgctaaaaaattgtttgtttttagataaataatctgctcgatatttgccgaatatatatggtgtttagtttggataatttgtagcttgggagaaaatggatggatgaacaatgcgattgtctttgcccaattggcaacggatgaaaatttgtatgacgaacggaaatatttattttttaggtaggtgtcgaaacatgaattcggcaataataaaacggggtagcgcacgagacctaaaagtggatggatgcagagacaaaggatttagacaggttcaggccctctcaatgagaggtaataccctactcctgtttggggatttgaatccgccgggtgtgtattgatctgacgatcaggttgtctcatgccccctagagggcctcctgcccaccttatatagggtggggggcaggattacaagatagaaaccttaaccaacacggtatcggcttcctaaatctactttacaatattatcaaatcaggactttaggccgctccataatataaaagaaaacgtaatacccaagtcatgatctgttacatattccatacatatatgttatcccctattactagtcggataaccatgccgtgtgggtatggggtacccataatctccacagtagcccctgagaccttcacagtcaaaaagataatcttctcccgaactagattattccaaagccgagtgcttcaatcatctttgccatgatctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaagtatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaaatccaaattaaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccacggaggcgaagaaaccagtcggcggcagtcaggtcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcggagatgtcagggtcgatgaagcagaggtgctggtgatgatgtcagtgacaataatccagcaaattaatgttatagctgtgtagatgcttcacttggaggagagttgatgttgttgtccaactcgtccaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcatgaatgttggagagcctcttgttgtagtaaaataacatggcatcgcatgccgagatgtcgaagctcacaaagacgtcgtggttggtgaagtagcaaaacttgcgaagtagcagcaatagagtttgctggtaccgaagataataaagatgaagtcgctccaccatgatgacaaagttgtgttgccgtgatgaagtgacagaagcaaactggtagtgaagacgcgcagttgtgaagataaaagcactagtcggcggcagcataaccagtcggcgacggaagacgatgatgttcatcagtagtggtagctgtctaaaccagacgtagaggtgagggcactagtcagcagcagacgtagacagcttgtgttgaagatactgatgcctattagtagtgacagcgatgtagccagccgtgaagaagatagcatcagctggcgttataacaggccagccgtgcaggcggtgacaccagtcggcggcggtcgaggcggccggtcggtgaagacgtagacgcccaacaacggtggcataataagtcagccgtgcaggcggaagtaccagtcggcggcggacgaggcggccggtcggtgaagacgtagacgcccaacaacggcggcataaaggccagccgtgcaggcggaaacaccagtcggcagcggcgaaggcaaaccggtcggtgaagacgtagacgcccaacaacggcggcataaaggccagccgtgcaggcggaaacaccagtcgccagcggcgaaggcaagccggtcagtgaagacgtagacgcccaacaacggcggcataaaggccagccgtgcaggcggaaacaccagtcggcggcggcgaaggcaagccggtcggtgaagatgtagacgcccaacaacggcggcataaaggccagccgtgcaggcggaaacaccagtcggcagcggcgaaggcaagccgcggtcgaggcgagccggtgatgatgttctgactgatccattcctggagcgtaagagataagcttaaagccatgaatctcttttatgcatatctggatctggatcctgcagaacaaacatataggatgagtagtatctgatataaatataatactcgagaaaaaatcaagcattttaaaatgtttataaatatgtatttcttctcttgtcaattgtgatttcctcgagcagatgactccttacgtttaaacactctgcccgactagtcatagtccccaagcatcgggagtcggcctaggcacttcccaaacatgcatatgagtgacatgagttcgtcattaatggaacaaagtttcacggattagaatttactactcaggtacttttgcaattattaagagcagaaaataaatttatcttatctctatgcttttgatttattccgaataatacttagcaccttgcgttactcggtccatccaacgagcccccgggtgctaggaatcggctcaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccggccgtgtaggcggaggcaccactcggcggcgacggaggcaggccggcggtgaagtcgtagacgcccaacacggcggcataataggccggccgtgtaggcggaggcaccactcggcggcgacggaggcgggccggcggtgaagtcgtagacgcccaacagcggcggcataataggcggggtgcaggaat

SEQ ID NO: 69345 - DNA, 1556 bp, Oryza sativa
acgcccaacagcggcggcataataggccagccgtgtaggcggaggcaccactcggcggcgacggaggcaggccggcggtgaagtcgtagacgcccaacagcggcggcataataggccggccgtgtaggcggaggcaccactcggcggcgacggaggcaggccggcggtgaagtcgtagacgcccaacagcggcggcataataggccggccgtgtaggcggaggcaccactcggcggcgacggaggcgggccggcggtgaagtcgtagacgcccaacagcggcggcataataggccagccgtgtaggcggaagcaccaatcggcggcgacggaggcaggccggcggtgaagtcgtagacgcccaacagcggcggcataataggccagccgtgtaggcggagacaccagtcggccgtgacggtggcaagccggcggtgaagtcgtagacgcccaacagcggcggcataataggccagccgtgtaggcggaggcaccactcggcggcgacggaggcgggccggcggtgaagtcgtagacgcccaacaacggcggcataataggccagccgtgtaggcggagacaccagtcggcggcgatggaggcaagccggcggtgaagtcgttgttgatatcagcaatggcggtggcgaggacaagccggcggagtggactcgcggccgattgaccggaaagctgagatgccttgagtccatgaccaacatcgttcgcctcagtagtgccgcgtaattatatgcgaacaacaacaaaaaatagcaagaaattaatctgagtttagaaatcaatctaatatatattgattattgataacaaattgaaacgaaaaactcaagtcgagcagtgaggctggatcgtgggtgatagccggcgacgcgccatgcaacatgtataagccccggcaactaactgctaactcgatgttctttcggtatgacgccattatcggaggtagccggcggagcacatcaaccgtcatacatggaaacaggaatcgaacggcacatgtgtacatgcaatagaaagcaattagtagattaattccagtctgcatatacgtgttgattaataaatcaacagatgcgtgtgtttaatttgctcctggcggcctgtgctactccagcaacacgtccaactgcaaggaaaggaagagaggagcactcggacacggcaagggcacccgagcaggcgacgatgatggccgtgtctcgatctcatcgagtatatgaaatgcatcaaaatatcaggaaatcaaacaacgattaaaaatcaatctaataaaaattagattggaacgataaacccgattaaagatttgagccgtcgaaattgatgagattgatctccgggcttcttctgaagttgattccatcgcacttttcgacaggtaattcgacgcatcccctacctggcgcgccaactgtcgaaacatgaattcggcaataataaaacggggtagcgcacgagacctaaaagtggatggatgcagagacaaaggatttagacaggttcaagccctctcaatgagaggtaataccctact

SEQ ID NO: 69346 - DNA, 26909 bp, Oryza sativa
cggctggcctttatgctgccgttgttgggcgtctacgtcttcaccgaccggccgcctcgtccgccgccgactggtgcttccgcctgcacggctggcctattatgccgccgttgttgggcgtctatgtcttcaccgaccgacttgccttcgccgccgccgactggtgtttccgcctgcacggctggtctattatgccgccgttgttgggcgtctacgtcttcaccgaccggcttgccttcgccgctgctgactagtgtttccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgctgccgactggtgtttccgcctgcacggctggcctattatgccgccgttgttgggcgtctacgtcttcaccgaccggcttgccttcgccgctgccgactggtgtttccgcctgcacggctggcctttatgtcgccgttgttgggcgtctacgtcttcaccgaccggccgcctcgtccgccgccgactggtgcttccgcctgcacggctggcctattatgccaccgttgatgggcgtctgcgtcttcaccgaccggccgcctcatccgccgccgactggtgtcaccgcctacacggctggcctattatgccgctgttgttgggcacctacatcttcatcgctggtcgtctcgtctgctgctgactagtgcccttacctctacgtctggtttatacagctaccactactgatggacatcatcgtcttccgttgccgactggttatgccgccgccaactagtgcttttatcttcacaactgcgcgtcttcgctaccagtttgcttctgttgccgccgactcgtgttcacttcatcacggcaacacaactttgtcaacatggtggagcgacttcatctttattatcttcggtaccagcaaactctattgctgctacttcacaagttttgttacatcaccaaccatgacgttgttgtgaatctcgacatctcggcatgcgatgccgtgttattttactacaacaagtggctctccaacattcatgatttctacttggacatcttcaacacatatcttcaatcaagcaataactattcgacgacaagatgctacagttctcgactctatgttcagttgtttcccaactaatcaaagagtcgggggctacacaaatacaaggctcaaaatttgacaaattttatgtcaagctgaagaaatcaattcatcaacccacgagtcaactccagaagtcattatcttcatctttgcttcggagcagacattctacttcaacaacttcaaatatttcggtttagacgagttgggcaacaacatcaactctcctccaagtgaagcatctacaacagttataacattaatttgatggattattgtcactgacatcatcaccagcacctctgcttcatcgaccctgacatctctgctgttgctaatggatgattatgtttttgccgacttattatttcaccttcacggttgacctactatgcaaatgctgatgagcgtctttgtcattatcattggttgctacactgctgttggctggatcaccgacatcgtcatcttcatcatgtcggttgcgtttgtcgtcgtcaagtattttcttcatcttcatgattggtggatttcgtcatcgcctttgatttgcctcgtctgtcaccgactgattatttcgctgccatagctacacaactttattgctgagcgccttcatattcattgctggctgactgctgccgactggtttcttcgcctccacggctgtgcaacttcatcacttttgattggtatcactatcttcactaccaccaatatttttgccacctctgctgggcaatattatctctgtattggtcgtcttgtctctatgccagttgcgtcagctaccatcaatgaacaattgtgactacgtgctcaggggcttactagttcaaacacaagtatcataccttcaatttggacttgctctggatacatgcaatatgaattcatgatcatgggtctattttctatgtttaaagactggactatttattattccccataagggttacaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtatagcgatagggttttgagttatcggctatatgtccaatgtagagtctaacactcgatgtaaataatgatataaaggcactgatcgatataaaggcaatgatatgatagaataagcactgatccgaaggttaaagcatacatcggctggaggtccgatgtcataaaatccacaattttagataaacagtgaaacctttgttgcgatcggctaagtccaacttatatgtatatgcaatccttacaagccaatgcaacgtccatataacttatcggctagcaccccgataaaacattagcatgaacctatcggcttaacaagacatatatattatcaacaacaatctagtagatcgaacctaaccgatgcagcatgacatcggatcccataagatataatagaaactctatcccctccaagtaagactttagaaatcactcgactcataggaatattttccataatttgtaacggattcctccaacgcatacggaaatcccgagctaattctttttctcttgaaatcacttgactcgatctccttttctttttctcttttggaatcccgagctaattcatttggaaatcgtcggattcgatgccgatttggtttgcttctctttccaaaaccctagagctttcctaatccaccggtgcctccatgggcttagctggcgccctccgccgctataaaaagcacccccctagttgtcctctacccatcccctcaagtcccgtccgccgacgagacccgtagcaccctagccgcgctagctcgtgcgccgccgtcgtcgaagggagtacggtcgtgccgtgccgccgctatagtctccaccatcgctcgaggttgccttcgtcgggttcgcaaggttgccgccgtccccatcccgcccttcgtttccgccgcagacagctagagtgccgccaccaccgtcgacccgaagaccaccgccgtctcgacctcgccgccattgtcgatcgtcaccgtccgtcgtcgttcgagccatcggtgagttggccacgtcacgctctacacgttgatgccctccgtttgcgccaccgcgccgtcgttcgccggctagcatgaggtgccgagccgacgccggtgatgacgtcatcgtaatgtcatttgtagaccgtggtagaccggaacgatctcggccgtccgatttggtcaagtttaggtcaattagatctcggccgtcggtttcgtggaccgcttctgtgaacccggtttagcatggaccgtccttgatgacgcagtaaatctcttttccttttcaaaagtaattctttattgtgtcataattcaattaaaatctttataaatgctttaactcgatttaaacttcaaaaattcgtaactaattcattgtaactcggtttaatgtggttcaagttgcaaaagttgtataaaatgaagatctatatattaaaattatccattatttgtgttaaattcatttaatcctttttaaataggcttcaattatattaaatcttgtaaaattcataactaattcgtacgaagtcggaatgaggccgttcaagtctcataatttatctaaaattatgatctacatgtttgtttactttactagcaaaagtgtccgtgcattgcactgggtgattatggagtgtgtatatcaaccaaaagtgttgtttggtttagcaaaagtgcccgtgcgtagcaatgggaagtgtacagatcagaaaaatatgcaattaattaaaatacaaattctctgaatatttgatatttttaagtaggtatgtatataattaaataaatttacaagtaaagcaattgtgagaaataaaatgacatggttaaatttaattttattaaattcttcatgattagttttgctctttgaaattttattggaattttcagagcttaattgctaactttaataatacaaacatcatttaacaattatttaattggaaatctaatttaagttcttgttgggccggccgacctacgtgcggccaatgaggcgtgcgcggcccagcattgatgcggcccgatgatggagaccggcccgacgcgggagtgatcaaagccgttcgttttgatggacggctcatatcggctcctaatctatcaaaaccctcaacccaaataaaccctaaccctaatttcattcttccccttcctcccctccacgcaggtcgcctttctccccgccgccggccgcgccacacccccaccggcgcacctctccgcgcccctccccaaccggcgacgcctctcaacgcccctcccccaccgccgacacctcttgcccccctccccaccggcggtggctttacctaccgagcagcggcgacggcacccttctcccccacaagcggacagcggcggcgcccttcctcccgcgagcggcgacgatggcggcagcggcgccctgccctcccacgagcggcagcggcggcacactccctcgcggcaggcggctgcggcgacgcggcgatggtgacgccgctccctccccccaccgccggctccttctctcctcgtcgggtggtggccgctgcaccactctctcggtagatccgccggtggtgtcgacggcggcggtagccgcgggtggaaccggatgtggtggtggcggtcgcgggccggcggcagctccctcctcccctctcgcctccctcttgcccctgatccggcggcgatggcggtgttggcggcgtcggcgggtgggtccgtggccgacggcgaggtggcgaggagcagtgcgctgcagcctccggtccggctcgcccctccctctcctcgtcatctcgtgttaatatgatgttttctaatgattccgatttagatttggactgggattttgtgtttgatttggatttggattgtgatgatttgagatttggagagaaggtgtgctcaatgtgggattctatttgtgtgatgatggaattccgactgggatttttgagggaggggagggacgaaaaatcaccgtacggatgtggtgacgaaaggaaaaatccgaatatttatattagttatagatatgtacttttcatttggtttttattagtcttttttctcgttttgcgtgttagcttgtcctttccgtcttttcggaggttcgcgagtgtgtcggaagtattccagaaaactaattgaagaccgattattgcaaggaaagtcacacagatcccaaacacaattcatttgagcatgttgatcctatatttaaattctctatttaattaaatcgtgcatttattttcgaatgtcaccgggtggtgtgaacctattcctttgttatggccaatttgcaatgattaccctatttcttgattacctcgggttataatttgactagtcggatttatatatcggttcaactagatgtattagatataattggttagccatgcttagaaacattagcacacaattgggataactaatgtttcactattacttaatgatggatatttaatgatagctcacgatggttaattgtgattggttaattaattaattcgctaactaaaacttgataatggtgggttgtgagcacgtggttttgatggtcgtgctcatgacaattaaggaccggttcacgagtttcggttgtgaaacattaaccgtgccaaccacaagccagcatgggtaacggctttaccttttgtatagcatggttcattgcggggcaccagactgagaagtggcggagataagcccacgggggtcgctggggagtccatgccttgttttataagggggtgattatgatccaggaacggtgcactgtgggggattgtgttatgcgaggggtactgtcacagctcctttccgaggtaccgtggtggtattaaggcgcatggtgacatgtcgtggggctatgtcttgtgggtacagtggtacatctttggccatagtaaaactattcgaatagccgtgcccgcggttatgggtgggtctaacaatgtatttcgtgattagtatcacacttctcaccataataaatgatgctataactggtaataatttgattagctcttggtttggaatggtacattcctagtttggagatagatctgtacagccgggtatggttgttcaggtttggttgggcctgtgcagcatgggtatgctgttcagtgttgattaatatcgatgattaattactttattgctttacaattctcaaatgtttgctaaatgctccttctgcaaatgagccctatattatgccattctttggtatccttgtgcacttgtgtacatgttgtgtggcttgcggagtattccatgtactcaccttggaataatcaatcaaacctcagttgaagacaagttacaaaggagaaaacatttgacttataccccagttgagctgtctgtgggagtggagctgaaacttcgctagattttatttttctgctacagttttcttcgtggtgaggactaggtacctcttatgtaagtatttattgctttagttcttatgatgaatttgtatattaaattgtcagtttgtatacctcggctgatttctggacaatgattttattcacaaattagttcggaaattactagtgattttctggtcgtgacagaccgccaccgcgccgcaagccgccgcgagccacggtcggtcgcgccccgtacggtgccgctgcacgctgccgcgggccgattgtgcccccgcacggcgccgtcgcaccgctcgccggccgcgcccccgcacggcgtcatcgcacgccgctcatgcgtgccgcgcccgcatagccgccgcgcagcgccgagccgtcccctgccgcgccatcaccgcacacgcacgcctggccgccacaccgcagctgcgctgcccgcacggccgcagcgtgccgccgcgtctcgccggcgtccgcgcctcgccccgcatgtccaccgcatgccgccggccgagccgtgctcgcgcaccgcccgtgccccgcatggacaccgctgccacgcatggctgccgaccgggcgcaccattcacgggaagaagaatagaaagagaagaaagatggaaagagattggcgattttgcaaaagggcccctgaattgtctgaaaattatgcgcatatctctcggcatggaaattccttgcgcgtagactctggaatttcagaaatttccattttcatccctccaccgcatggaaacttagtaaagggccccctgtacttgcatatttcgcctgcatttcttatttaagcattttgtttatgtcatataaatttttaatttgaatttcacgaggcattaattaatgttaattggtattttgaattttcattttcagtatttatatgaatacatgcaacttttgccccccttttatgaatatttgtatgaatttgtatgaactctagtatttctttattgaaaattgcatttactttgaattacctgcgtttctttgtataattagcatttcctttgcataagaaatattggaaaaatcatgaaatatttgtattcatatttgcaaccatgataatagcaagtaacacttgaatgctttgtcgtctttgtaacagaatgttagtaatcacgaacaaggagttcgctgaactggccccgtatgaccagaactacctgacctgggcatccaatgtccagattgtccttggggccaaaaagctcctcaagacatttgggatgggcacagtacaagaacctatgccgacacctgatgagaacgatcaggcgatgtacttcctgcgacaccacctttgtgccacactcaagaatgaacacatggcaacgaagggtctgctcactctttggaccacactaaaggagtggttcgagaagcggaaaaacaccaccttgccccaagcagagcaagagtgggcacacttgaggtttgccaactatataaaagcgttaccgaatacaactccgccttgcatcagatatgtatcaacctctccctgagtggcaaagtagtcacggacaaggagaagattgagaaaacgctctccaccttccacctcagcgctatgcatagcactcgtaaccacaggcggatgacatgcaagaagtatgatgagataatcaacatcacgcagatgtttgagtcccatgacaaggttctttgcaagaacttcatttcccatccatccaacaaaagtattgaccttaaggtcgatactagcagttacaagaatcacaagcccatctaaaagaagaggggcaagcaaggtgggaagaaagcacctaagaatatgcatgaaggaactccagatgcccaggtagcccaaaaagcacatgaaagcaagggcaaatcgaaggccaaggcatccacaaaggcacatttggttccaatcaacaacaccccagtagtagatgccatggcaaccctttccatcaccactccacttgacatccccgctcctgccatagtcgtagcgagcaaagaaaatgtcatataggagaagagtttgcaaagatggaggcttccccagactccgtcttagtccttgatacaataatgtcatataggagaagagtttgcaaagatggaggcttcgccagactccgtcttagtccttatacaattatcttatcttggttgcattatgaacttctttgaataatggatatttaacctctatgagagcataacatttattttgtgattcgccatgcatggctagactttatttccaatattatgttgcattttgctatatgataaagttttacttcttgccttgaagtagtgatgttttactttattcacatagacaatatgcatagcccaaggtgaagaggagcattgtggaacaaaagcaccacaaagtgtaatcttgagagacatgtgacaagttcagtctatgcaaagacgtgaactaccttcacaaccgcacgtaatgattgtaaaggttattgtttttcccgtagaaaagtgattacacctcaaatatcttgggaatggcaaactctcgcaccaaaggtcccttgtaggaattagaagatgagagaagcatactcatcacctaagcacgcgagatcaatgtcctcactaagaaatgtaggctaaagtagactatttcatagtcagtttttcttagaatttagtatcttgcaaatgaacatagcacaaacaatctcacatcatctgtcgtatcgcaacaatgagatatttgtcgcacgcactgccttagcgcctcgcgccagacttgcgccaggcactggcatgcatcatacagcatcatgacgcccactaaggcagctactagcaaccccgctgtactgggggactggacgaatcatgccgcgttagcacgcgccatgcaactcctaccatgcaccatagttgcaccggctgcatatctcgtggtcactctggtcgcgcatgccattgaacatcgaatgcgtgtcaaacgccaaccaccacatgaattccgacgtaccttaaaaggtatatcggaacaaattcgtgcataccacatgaattcgcatgcatatttagtcctttaatggatcatccaatgcatactgcgcttatgaaaaagctgtaattgtgtctaattgacactacgctcttgccaaatcgatcctgcaagatcacgcatgttggcatcagcacattaagaaaagcactaagtaccggacgtccacaagaataggactaaaaatgtccactgcaccattattgaaattcccgccacttcaatggactcttagctccaaaggcaatgaattatcaatatccagactattcaaaatgtgttgtccacttaaaagaatactagtgttgactcgacacatgtgcatatcccacaaccataaggtctccctccgaaaaaaattgaaagtttttaacagaggtatgaacgtagcttaaattccttgacaataagaaggattatttccagtcatttagggggacagaaataacccttaaatgataaatgtcaggaaaaatggtcaaagaaaggatggatgcacatttaatcaagcactagcaaatgcaaagtatgaaaagcacactttgtaattggataactgcctatcagttttgtgatttgcagagcatgactaagttgcattacctgaatataatgcaccggaggagggtgaaataccgaggaatgcaaaggtatacctcatattgtccagaggcctagagaagaataatgggacaagaactccggctccttaaatccctagagtaacaggagacgtctggtgaaaacggaacaaaaaggaactctcaagctcatagtcactaaaaataaccccagaatttgaagggagcgagttcaaagctggcaaatggtatggaaccccagaacaagcataccacatcttcctatcaaggaagaaaaccagcagttggagtgcacaccaacgtcggtaaaatgaaagagtcatgcccatatcaaagaatagaagcataagagaattgcatatccccatatatccatggatactcacataagtgtcacatacaaccaataagaattggtaatgagacctgctatgggcaatattctcttcatacagcaaatcattggcagttaacctggagttgaaaatcaactaaaagatcaaaccgcaaagctgacctatagttgacaatgaatggctagagaaattttggattgggcacccgcatacaagcattaaaaatccgaaaccaagttgatgatccgaatatcatcacataaagaaagaaagctcactctttccgaacgagtttgagataaaatagatagaaacctatgttgcttaggctcgtaaacatacaacacatgaagaagtgaaccatagtatatcagaatgtgaaaatacataggttccatgcatatagttcaccatttctagcaagtaacatggttcgaactttatccaaaccccaaatccattatcaagaagataatgatatgtgcgtcgcacaacactaatagactatacgaactatataagtcatggaaaatcatgcaagatttgaccattggagcatcactcgaactatcttttgaaaaggatacaagcaatgagttttgacggttcacacttaaaagagatgcaaaattcaaggggagaattttgccagtctattaacaaaagcttgaaactaaagaatttagtacccaaaaatcgattaagaaaatcgataaaagaatttgggtagattgtactctttttttttccttggataaattttcctgcagtttcttatcaaggtttttaatgaggcaatctgtgcgacatagatacgtatgccatgtactctttctccaatttttcccactgggtttttatggagttttgacgaggcatggacattacgcggtgagtgctcaagggggagtgttgagaaacttttgggcttggcccatgaaggcctagcctaaatacacttattggccccatcaccgaacctttcatatattagattgcactatataaagagaggagggggctactcattgtacaattgattggaggattgaatagtaaagagagtctcacccctaaaatttgtgtttccactttttgtagaattactggaccctcttgtactgctttgtgtagcatgagagttgcgtaataggacaaagtttatttccgattggttacttgcaagtctgtgaggaaatatagaaaccatcgcaaaatctcatgttctcaacatagttatgtagtgagtttttacttggaattgaagtttgacgatacgactcgaggaactaccgtggcatctcgacaagggtagagggatttgatagctttcgtgggagaaaagaacacaggaagaagaaaacggagttggcaagaggattcggttttctcttatcgcataaactcccaacaaccacagcttctcttataccatgcacacgcacactgatgccactgccagtccagcatggcacatcaaacacacactctcacggcccaaagacatggcccgactaaacatttaacaaggcccaatgtcatggcccagctgaacccataaactcacatataagtcaagtacttcatacaccaaaccgatacaggagtcatgacaattctcccccacttaagaatcggcttgtcttcaagccagtgcatctggaaaacgcttttgaagttgtcgcagatctttccaggtcgccaactacgctgacattcctctctagtgtaccagcccttgatggatcagcgacttgcctctcttgatcaaccgtcgttggagcacctcttcaggaagcacttctgttgttgcatcaatacaggggttaggaagtttaggactcaccactatacctgctttgaccgccttttcagaagtgatacatggaccattgcatgaatctggctattcgggggtaattcgaatttataagccattgctccaatcctgtctatcaccttataaggcccaaaaatacctgaaacttagcttatgacaagtgcgtcgagccacagacatctgcacatagggttgcaatttcaaataaaccatgtctcccacttcaaatttcatgttagttctgtgtttatttgcttgatgagtcattctttgctgtgcacgaagcaactggtgatgcagcatttcattgtacaaagttctgtcttgcaaccaagactgcacatctagtgcaatactctatcctaggtccaaggtccacttcaccaaaatgtgttggcttccttgcaaacaacacttcatagggagatttgcccaaagcagtatggaaagccgtgttataccaatgttgtgcctgggtaaccattgtgaccactttgttgggaaagcatgtactgcatatttaaggaaagcctctacacattgattcagcctctcagtttgtccatctgttaagagggtggtaagaagagctcatattcagctctcttccatttccccaaagtgaccctttcgtgggagagaagaagaacagaggaagaagaagacaaagttggcaggaggattcagttttctcttatcgcataaactcccaaccatgggttctcctcttataccacacacacgcacacggataccaccgctagtctagcacgacacatcaaacacatactctcacagcccaaagacatggcccaactaaacatttaacaaggcccaaagtaatggcccagctgaccccataaacccaaaccgaatttgctatatatttgtcgacaaattttcctccaaaaatttgacagatgtaattacagtataatcgtagtgtaattacactgtaacttgtatgtaattatactgtaactcgcatgtaacttgtatgtaactttcaaaaatctctccgtaacatgttatttcggtaaaatggaggtcgtgggaataaatcctttcacatgtgtgtgctgtgatttttttttcttcctcaccggaacaaatcttgtaatagatctaacgattcaaaattacatgaaacttacatacaagttacactgtagttacatgcaagttatagtgtaattacatacaagttacagtgtaattacaatacggttgtactacattctgtcaaatttttaggagaaaatttgtcgacaaatgtacaggtagtcccaacttatcagacaccacacccgtacaggagtcatgacatttgataagtagatggaacaagatagctagatttcagcacacatgctacagaaacacggaataagtaatttatcctacaagaataccgctaagataattttcagggatcgccaacggtctgcattctgaagatcagcagattagttgataatctactgaatcaactggtttctattcacagactcacagtgctagttgctgtggttgccacattttgttccttcttattctccagaaggacctgtgcttgtttcacttgagaaccgagaatgcttactggattcattgcgctctggtcgctgctagagaacatcatgaacgcttccagttcaaacatctctttggaagccttggacagagattccatcaagctctccagctctgctttggggtagtttccttcgagatttatcagtgatatgatcatcctactggcaatcttcagtattctcaggcaattggctgttggttcactgttttcttctaccaacttcttgagcttcccggcaaagctagatgcagaatctcctgttgcaattgcattagcaagttgagccaaatctgtatcattactgatcaatttttcaaatattgccgcactaagtgacagtaaagctgcatgtagtttcctgtccacgattttcttgttgtcgtccttttgctcattgacgttgccactatctttcgtagcaacggcaccttcgcctatttcaggatcttgtgtcacaaacttggttgcgtctgttcctttttctgtatgcttttctccttgcttcaatggaggagagggaagtatttctttgagcatctgcagtggtagaaattatgcttattaattagtaggtgatgataaagacccaaggtgcgcgtggttagttaaataagtatgaaacaaatgaaatgccttcatttgtttgaaattttatcacacaccgtacctttggcagcacatctttcatggcttccgtcagtttcttgagattgtcatcctcctttgtgtaacaaatgtatagatgcttgaggatttccgccgcacttattctgtatccgctcttggtgcgaacgtcgaggagcgttgtcttgagatcatcgacaacggtgtcactcgccttgaagatgatggcggcgttgctttcgctttggtcgacggaaagcattgccagtgcttcacctgccaattgtctcgtggaggcgtccttgttttctttagtgaagaagatgtcgaccagcagcttggtgattttctccttgctatcggctgtcgaagtcgaaggtgcttccatgggaagctgcgtgaggatcttgatggccaggacgtgtagcttctcgttgcattcgtcgcacccgaggatcttctcgacggtgttgatggcgcgcttgttggaacgcagcttgtcgccggccttcccagggagggcgacaaggcggaacaggagctgcagcgacgcggctacgatgtcggaccacgcgtcgtggccgatgttgtggaggaggtcggcggtgacgggcaccatggccttggagacgaggccctggttgctgccgatggcgctgcagttgtgctcgtcggcggcggcgagcttgtggaggatgtctcggcccagcaccatgagctccttgtagtgacccgacggggcactgtcgccgtcttgctgcttggtggtggtggtggtggtggtggtgtcgagcagcgacgagatgcaccggagcccttgcgggaagctggcgaggctgatctcgccggcgagttgcgccacgatcctggcggcgagcacccggacgtcccggtcgagcgggcttgtggagcgaagcgactgcagaagcctctccaagacctggctagccgacgcggagccgaccagcttcctgatcagcgcgtgctgcccctgcagctcctcctgcgcgaggatcttgtccaggatcctcgcaccggagacgtagtcggcggacgacgactcggacttcatcagctccacggcaaacgtcaccaggttcctctccttgacgaatgatggatccttctcgcaaccgatcttggtcttgcgcatgtaatccctcaccgactcgcgcccctcttcgtcttccttgtcgaacccgtagtcgtcggcgactactcgggccagccgtttcccggcgaagtaggaggctgactggtagcagaagagcacgccctggaagagcgccagtgagtagagcacattgagcgccggggtcaggttagcgccgccgtcctcgccgccgtagtcccgctctatgaggcgccacatggagaggccggtgctgacgagaaggccgaacaggtagagcaacgccagtgggagcagtatgatggcgatcaccagcgcctggaggagcaacacaagaatccccaccagtgcacgccagtactggtccgagtcgtcgtcgtcgtcctctttcctgaacaccatggctacagtaaccaagaggccatcgaacgatttccaagcgtaccgcagcttttcgttcaggaaaacatcgaacaccctgtaaatttagttagatagaggcgccgttagacctggacaagggagatacgacgaaatgggtcggagtgtactggaaatgtttctactttttaggaacttgaaacccataggaaaatgctcgatccgtcctaaaatatggctagattagatatgtagattcatagttgaagcaatagttatattcagtctagattcatagctgaagatagctatattttaagatagaggagtgtttgcaatttcggaacaagtagatacggtcaaaattttcaggataaaaaaatagctataagttaagggactgtctatataggatttgatggattttttccgataagttaagccccccaaaaaagaaccaaacactaatcccactacctcaattccgtctgtggcgcccaaaacactccttgcgacctgaactttccaagcaatggtgatgctacccttactagcggcgacgatgggtcaactactcctggagttggcggcgacggtgccaaaaaccctttctatggcttggactccctaggaggcggcgctcctcctgctagcagtatagttggctaaaagacccgttgcccgatggaccgggccacagcatggagatttagcccagcccaaccattgacgatgcctggtcctctttctcggcacaatgagttggcccggcccggcaagacccaataataagcaggcccaaagagatgagggaggtaaatagacatattccaaggacgagtacagtggactggtcgtgccttctggccgacatggcacggcacggcccaagtgttattgggttgtgcctgcattgaaggtgcagcccatagatgcgcacggcacgatatggctagttggtcctactctcgagccgtgccttggtcgtgcccaggctggaccgtaccgaatggcccatttagccatttataactggcggcgacaacagctcagctgctcctggagtcggtgactcagcgtcaggttcttgaggcagcagcagtcatgatttgctccttcatcctccatccttcctttttcactatcttgatatgtctctccgcctctatgggatttgtccctcagcacttcttctgttcttatagtagtgcgcacactgatttggggtcatggaagaagaagatcctgcatatgttggcagggggagacgcatggggtcatggtggtcctggatcgtcagccgcctgcacagctattgtaactgatttgggcaacaatgatggtagcggggtgggaggaaggggatcagcagcaacaactgttggaagaagaacggagagtgccagtcctaaatggatatgagatgtgtgcaatttatcaatttagcgtgatgtaactgctaaataattcagctgcaataagctcatttttttttctggaaatcatgcattatccgataagaaattaagatttgcgtggactaattattttatcccagaaatttccagaactttgaaattttgattgcattttgttttttgtaacaaaatttcatatttgaattcaaaatattcatacgaataatatccaaatttttgggttttttccgaccccccacgacaacaaaaaaacatttcaaaattgcataccctgcaagggagtacaaaagacgaccttaaaattgaaaactttagccaaagtatagttcagtgaattatacaaattgaatacatattatttattacggtacataataaacatcaaatattaatgctaaaagagtaaatgtcgtactcaagcaatcaattgacctcaaatctatctatctattatattatattattaaaataagaaggcatcatgttcgctgtgtaggctagaaattcctgaattaattgaaaaaaaaagaaaaaggatagtctatatagaaatacaattgagaaatcactgaaattcggaataaaaataagcaatattgcaaaagagttcatataagaacccaatacaaaattaatcgaaattcgaaataaaaaaataaaataaattctgaaattaggaaaagaacaggaagagttcaactagaaatacaatttagaaataattaaaattcggaatacaaaataaggaatattaaattaatagtttagctataacacagcacgagattaaataaattcagagtataaaataaaataaaatacgaaattaaaaaataataagagtctaggtaggaatacaattttgacgtaactgaaatttggaaataagaataaacaatattagaagaatagtacaaataagaatccactacgagattaattaaaattcgaaataaaaaataaaataaaataaattccaaaattaaagaataaaaaggagagttcaaataggaatgcaatttaagaaaaactaaaattggaaataaaaaaaggaatatttttttttgacgtgataaaaaggaatatagaacacaatatgagattaaaataaaataaatttataaattagaaaagtaaaaataactaagattcgtaataacaaataaagaagatatcatagaacacacgatgagattaattaaaataaaaaataaaataaattctaaaaatagagagttcgaataaatgagtagagtggtggtggttgataggacactaaaagatataaacaaaacccaaatagaatgtcactgatgattaagtggagggacgatgggtagaccattaagcatcacggtcacgatggcgggacttatagaaagtaaaaaatataccctaacgataatcatattttatttttaaaatctcatgataaaaaagaggggaggcagcgggtggtccatagaggagtacggtggcaaagccgctgacagtttgataggacttctagaaagtaaaaaatgacctaaatgataattatgtttgtcttttaaaatatcaatcgcaataaagagataagtcggtgggctggtcataaaggagtaaagtggtggcatttgacgagacttctaaaaattataaaacaaaacccaactagacaatgaactctaaaaactacaatgtctaatttttaaacgttccaagaagaatgaatataagcagtcatagatcgcatgcaaataaaggagtgataaaggagtaaggggtagcgactggtgtgacttttaaaaaataaaaaaaattagaaacacgtgaactatttaacaaaatttaagaaaaaatcatatgtaaaaagtagataattttgtatgggtgctagccacgcaattgcgcgggtcacccagtagttctattgaaaagcatcatccttttagtattgggttgaaatgaaatcttcctattggggcaagatgggctttgctttactctagaacttagtggattagaaattatggccccgtgtagtcaggcacctcgcaaatgctacaatattgctagcaaattcctttgcactctatctttccttccaaatgaacatgaacagtactagaaattcctgaagaatgatcttatgaaaatctttgttccgaaagtgtgttttgttagccccttttcagagaaagaaaaattatcattgggagcaataaatggtcagaaaagaaaagaaaaaagtgacgaataggaaatacaacaaatgtatagtagaattaagaagtctaacccagctgtctggacaagggtgataatggtgagactccaaaaatccttcttctcaagcatggagacgaagccaccaaggaggacgacggtggtccataaacctactaggaagcccatccccttgacggccattgacaggtaccccataaacagagcataactgttgataccgtcaacttccttccactcggactgatcaggttcattagccattgtcagttcttcctcaagaaagttgggatcatcgtttgcaaagcagcaagccaatatatatacaagctcctcgagcatatgggatgattaactatcaatacgtagaccaatagccgattaatgaaaaatgttcagatcttgactttacctgcacgaagcgatcgaggtcattgtaaagtatatattgttcatccagcctgttcagttttggaccaagcaattagctaggtctttattatatttatgtattagtagatcaatataaaagacctacaaataaattaaagctagtggcctcacaagttacaatacaatattatgcttctcactgtttgtgtacccacactctagctagattactaatgctgggattattattgtttcttgaatgccgggaaccagacgtaattgatgcacatatgtaacacatggtggactggtcgaggagcgttacatatgtaacaggagctgacaacgatccgctaaactcgcaagagtaaactctagaaaacatcatgaagccttccagttaaaactgtttacaactaaatttgacacctagattcgaattatgaacattgccaaaatttgaaaggcgccgagtttccttcacggggccggtccgaccaccgcctatgggagtccaaaccgattttcatcgggtctcgggtttccttacttggaaaggtatttttcgagtttccattggtttccaccccaaattaaacgtggagaagaacatgtagaagacaagaccaactcctttataatagccaaggtcggttcgacctccctcccccccaaatctcaatccatacataatcgaatcgtttttttacttctacttttagccattttttctactttaccttagttttgtccatctttgtcggtttgcgccgtaaaccgtccgccttcactacgagagtgcgattatctctttgtagatttgtcttataaccttccgttcgcccacgagacgggtggttatcttcaaatcaatctaaatcggccccgaggctaatttgatctctaaatcgcctccactagccggtttaatcttcaaagcccatcttgatttagaattctctagatcgaggtggttggtgactccattaacaccacaaatctttaaatgagtcatggttgggaccgaaaagggtgccaacatgaattggcgactctgctggggaacgtcaagaattttggccataccacggccagaaacaatctactatatttgttgcttacgcatataaattgatcgctcagttgattggatcagatcggcgacatcattctcttaccgccgcgccggtctgaaccagtctaaccgacgttgtaggcccggtctgaccggtgaggtgaccggtctaaccggcagaaagcaccaagataagcagcagcaacattgtttccttttattgctgcacactgttactgagaagaaataggaacagagcggccgattttatttaacatcggttaatttttggtatatttgctacagtaccaaataccctgttacgatcaatcaacaaggctaagtttgataaaattggtccaaatacagtagcataccaagaaaactatagaccgtatattaatctatttggtcaaaatatttcagctataattaatatgatcgaaattcatccacaaacatcttcatcaaccatgacgagtgggaaggagatcgacaagctcaccaaggaggactggaccaaggaggagtggcgagactttgaaaaccaaatggcggcgtgtgagaagacgatgctcgcaagcttcctcaagaccgaccaaggcgtcttcaaaagagacgtgacgtcccgctaccttgttaggagctctattgggccgcatgcagtatggaccatgcattctccagagcaagcccaggctagcccaagcgactgggaacaaaaggatggctgctgctcctacaacaaacattgaacagatcaaacaggcatcggcggcttcagccacggcggcaacggcgtcaaggttctaggctagaacctcgacgatctatcttctctaccgatctcttcctacctccagcttccactgctagttctagaagcttccaaaacttgtattccatagtttcttcttctcttttccccctaaaacaattgttgcttgtatggtggatccttgctattgaattggaagaagtgggttcctaacaatctagtatcagagccgctcggttcgtgggatttctcgtcatgcaggtgttgggaaggcagcagtgcaaggtggaggaagatttgggcaagtgaggtgctcatgaatctagcgcacacaacctgttcgatagaataccaaaccaacataaggtgtttaaggacgatgaaaggatatcagagcccgtttccatcaaatccaccatgaacaaggagggaatatccatggacgaatctttagatcagaatcttgggaagcttgagttgatggaggccaagtgcatgcaagaggagaagttcaatcaaatactacagaagttggaggagatagaggcttgtaggagcaaggctaccgaggtgacgattgctgccatcaggacaaccaccgccatcctcaaggcttcatcatctccaacacccatggcaccacctcctccaacaccgaccaagtgtttgacaaaatgccccaacaacaacttcacttgggtgatggcgaattcaagtcacattggtgaggtgcttgctccaacggctgcctgggagctaggagacaacaaggacaagggccacgccccctgcatcgtcaccaacgactcacccaaggtcacgcccgccaagtgctcgaattgttctagccctgacatcatgctagacctcaccgtggctgtgggggtttcatgtgccactacttctatggcctccatggagttgttggttggcgaggatgaaaccagtgtcatctacattgacaaccctcattgttccatagcgacgcatgccaagtgttcgactttgggcctcgatgtcaatggtagcgccaaccaacctgtggtcgtgttccctaccattacagctatgaatgggcatagcatcattccaactctgcctctgaccattatgaatacgtcagtcatccttgttgtcaaatcaagttgtgctagcgacaattctatcagacttatgactctatgttagccactaatggagtatgctgagaggaatccatggccacctcctccttcgaacaagctaacgggtagcatatgtgagctatggccagaaccatggtcatcgtttgcgtgtaatcgatgcaaagtgtggtacttgttccgattggagagcacactattactgtacgtgaatggagttgagcagtttctaaaggaattgccatgctggccaccgcctcaagaagatgtgattaaatctgagttttatcatggagggaatcaattttggttgaggaattcagcttgtgttatttttttttagataatggattcagttgtgttattgcagagacaaaaatgatatacgtagctactgttgtgaggttcagtttgtgctatatgcagatgggtgctatgaaaccttcaagtgttatacaatggttaaatttcccctactgcacatatgacggattcaagcggaagcttcgaggcttgttcacaaatggagccttgtgcatacattcaagtcagtatgatcctccagatgggctttgtgaataatccggttgctatttagtagaactagaaagaaagcccgcgcaaatgcgcgggcatcttattgattgttttataaaaataatgcttaaagaagttacatctcactatttctatttaaatgttataaaataataagaatatatctcagattaaaaatacactttgatcgagtgacatataaattctcctattgtcaccattacttactatgctttaaaacctaataagtaattaatacactaaattatcctctatttaggtttcatatctcattttttttctaaatccatttataaatattataaaaataccaccacttctattcattaatggagtagcaccattaaagttaaacacgaatactactctagtgggtgaagtcgattgtagccaccaagactttctttctctattgccttgaaacatgagtcccgcatcgatgtagccatgctcctgaagaccagcttggagcataattttaatgtatgattcattatcacatgctcatggagtattatattggtaagtagaaagttgagtactattagcgatggtggcctccactggaactgtaacttagtcatatattccattttatacttacgacaccataataaactttgttgtctaagtttagtgtcctttagggaagaacaaagagaagatggaggtgaccaaagtagttttttaaaaatgttttgagtagatttgtggtgcagtgtaaacacaatttctttatggtgttgatcattactactcattttttttatgaaaagatagaatactctcttttgaaaatggccgagtttaataattcgatgatgttttttaaaaaatatagctaatgagacatatcaccacgatagtatccagatcatcatgttattatctatgttttgacaaatatgtatagtcaaatagttctaaaaatataaaaatactttcagaatcttaatctcaaacaaattgtaatttaatcagacctactcgaaaaacacaactaaattgtgttgcttttattttttacatatgcagatttaaattaatgttgtatatttgtgaagtgaaatttccctccgtaaaatatgatgtgatttttttgaaaaattatcatacatatgtcagcctcatgtgccgtggtgtatttaggaccataatataacttttataatttaattaaagaaatataacatgatcacaaattggatatataatttcaaaataatttagaagatggtttaaaaaacatttattgagtattctatgtttttattatagatcttagtttaactatatatatttatattatatttgtgaagtaatatatttcatgtttatattgtggaaaataaccgtccatttttatatatctactagcaaaatgcccgtgcttcgctacgggtaaaggaacggttaaattatatgaagtacatcgttaacatgtatataataatgttccaatataggtaaattgttcattgcgctaatgataatcaagatggataaaaatattcatgtttagctcacatcgcgaaagaaaaaattaaattaaaaaatattaaattctaatttaatgaaatataatttttttgcaatattaattacactctttgaaattatagcaaaagtgctcgtgcattgcaaccggaagtgtatagaccagaaaattgaggaaaagttaagaaaaatctacactatgtaattaattaaaatacaaatttgctgaaatatttaatattttaagtaggtaggtgtaaaactaaattaatttacaagtaaagtaagtgtgagaaataaaatgacatggttaaatttaattttattaaattctccatgattagttatgctctttggaattttatttaaattttcagagcttaattgctaattttaataatacaaacatcatttaacaattatttaattggaaaaagaataaaaatcctcccttttaggtttgggcataatatgaaaaagtttatattacctcccttttgcctatcatatgtatctggactattctttctccgttgaagttcattttacgtcctcatgcaatcacgcagtccgttcggcggcccagtaatgtggtggcccaataggccgacggcccgatgcgggagcagctagagccgtccgatcaaatgaacggtctagattgatcctaacctaaataaatacccaaaacctaaccctagaatacattcccccctccccacccccccggaaacccaaccgaggggtgcaccacccttcccccgcgagcggcggcgtcagcggcggtggcacactatccccgcgagcggcggcggcgcggtgccctcccctcgcgaacggcggcgtcggcggcagtggcgccctccccccgcgagcagcggcgtcggcgacggctcccccaccgagcatcggcggcgcggcgccctctccccagcgagcggcggcggcgccctcccacccccctcactctctccacttctcctcctttctctctgtgtggcggcggcgggagggccggcgacgccctcccctccgctagatcgagggggaggagaggtgcggcggcgggtcggacggcgtggaggcggccggccggacctcgcctccgccacatccggcggcgctgcggctaggacggcgtggaggcggcgggccgggcctcgcctcctccagatccggtggcatggaggcggctgcggcccggcggggcgtgaggggcggcggcccggacagcgtggaggcgggcgatggtggcgccgat

SEQ ID NO: 69347 - DNA, 14805 bp, Oryza sativa
ttgcgtatggacgaaaactcggacgaaattagatgtgacgaacggaaaaatacgaatatttatattagttatagatgtgtaccaaaaaattgacgtataaaaaatatacatgtatataaactttatatacgcgtatgcaaactttacatacgcgtatgcaaagttccatttattatatgcggtgcatgcatatataatggcattgacattactttatacagaaatactaatgaggacacctggctcagttcgtttctttgagttcccaactcacactccccgttttttgcttttcaaactactatattcatctcaaaataagtgcagtcgtgggtatccgtgtttaacgttcgaccttttgttttatttaaaaaatttatgaaaaaaattaaaatattagtcacatataaaatactattcatgttttattatcgaataacaataaaaatactaataaaaaaaaaggcgatcgttggacatgaacagtgtaaaactgcacttattttgggacggaggtagtactaaacagtgtgttttatgaaaaaaattctatacgaaaattgcattttaaaaaaaatcatattatccatttttctaaaaattagttaatatttaattaatcatgcgttaatgaactgctcagtacggagaaacacaactaaggccccctttgattcaaaggaattttataggaattttaaaggatttcattcctataggaattttttctatatagccctttgaatcaaaggaatgaatcctatgtaatcccatgaaattcctatggaatgccacttcccatgcaagttttggaggaaatttagcatgaagttctacctcatgttaagaatcttttgttcttgcggctcaatcaaacggtcattcctatatttttcctgtgttttacaatcctttgttttacacttatattcctgtctaaatcctatgtttctcctatttctccattttttcatttctttatttctgtgattcaaaggagtcttaaatgtgtagatttatttaaaaccattgtttaaatagcattttcaaactgccatagtacgtatcttttttattaaaataagcagttatatttgcttttctttaactgccgatcagaggctcagagcggagagagcggcgtccctgcgcctcgataattccgcccgtcattatctcctcgttctcgccgagctcattcctctcggtgtttctctcctctgccgctcgcccttatctcctctcctccgttgcgctctctttcctttcactccttttctccttctctactcacagctagcgacgccctccatctccgcccttccccctctgccccactgcagcgttactccccgtacccctcagccacggcaccctccctccagccggcggcgcccttcctccggcgacgacgccctacccttggcggttggtgccccagccgcggcgccctccccctggccggcgacgtccttcacccggtgggcggctgctcagccccccccccccccggtcgacggcgctcttcccccggcgggtggtgccctacccttggcggtcagcgcctcagccgcgacgccctccccctggctggcagcgccctctcctcggcgacagtaccctcgcggcgcacggcggtgcccccgccaagccaccaaggcctcgggcagcggcgtcctcagcctctaatgagcagtggcgccgagggcggatccggcggtggtggcatcggcgacgtccgcgggtggatcccgcggcggtggcggcagccgagggcggatccggtcgcctttttttttctttttttttttgctcgagtttattttttatttttttggaatcggacattgggattcatgagctcttagattaaaattggcttttttgtgctgtttttggttgtctcattgttcgatttatttggggatcaagctgggggatttttatttttgaaggacgccgtggcggagggcgaggacggcgacgcggtggccggcgaggaggaggaggaggagcggcggcggctaagcgaggaggagcagcggcggcggccgtgaccggccggtggagggcgccgaggccagtgcccggggcgaatggcaggaggtggggccctgtcggccaggctggcggcgcgccgtggtggaggggcgtggcggaggggcgaggacggtgacgcggtggcaggcgagggaggtccctagggtcgtcgggcggcggggaggaccaaattcatgagctctagattaaatttggtattttcgtgctgttttttgttgtgtcgattgattgatttgggtatttttgaagactaccaaaatgcccgcttcgccacggtgtattgaactaaaaatatttgtttttaagtgaagttattttcacactgctttggtatttttgctcgttagaaaaagtctcaaataatagagagaaatatagtagcttaatagtgtgttgcaacggaaaaaattaatgttattaactttttaaagtaataaaaaaggagcattcacattagctcttatagtttagaaattttcatattaatattatttaattttagtctaaatttatatcatgacaaataaataattatatttttagtcgaaaaataaatccatatcatgagaaaaatctagcaaatttttagttaattcaatttagttggaattaaattattaagcagtaataaataattaaaatggtactaatgctatttctgaatatagaaagatgcttaaaattattgagaattattgagagagaaaacactaattttatcctagcccaaacttgcggaccaatttggaggcccaatagtgccgcggcccaatgcgagagaagccaaagccgtctgattgaatggacggttcagattaatcccaacctatagaaatatatgcaaccaaaaccctaaccttaaatttcatttcctccctgccaccgatccctcctctctgtctcgatcgaatagcgacagcggcggcgcccttccccctcacaagcgactgcggcggtgcccttcccccacttcccacgagcggcggaggcggcgtcctctccccaacgagtggctgcggccgcgccctccgccccgtctcacctccctcattggtggccgctctctccgccccatctcgcctccctctccctctcatctccctctccctctcgcagtggcggcgggttggcggcggacgcaggcggatccgaggatggtggcgacgtcgacggcagttgcgggcggatccggcggtagcggctccctccgccccctctcgcctttctcgcgcggtagatccggcggcggtggcagcatcggcggctggatccgtcggtggtgacgacaaccgtgaacggatccagctactatatttctctctatcatttgagactttttctagcgagcaaaagtaccaaagcagtgtaaaaataaacttcggttaaaaaatatttttagttttaatacatcgtagtgaagcatgggcattttgctagtataagatataaattactattagtaaaagaataatatattgtcaaataataatactgcatatttctaatttacaatcataaagggcgtatctaaacatacggtgaaaaatgggtatacatatataatcatgatctaagtagggtataatttcaactattaaaagaaagtttatttgctcagttggcgacagcatgatgtgcccagaacgaaggtcccagggtcgattcttgtctcgtgcgtagcttttttttattttttatattccatgaacacgaatctcaaagtctatctaatagactaaaaatcgaacatttttttttttagcgtttgcggtggcagcagtgatacgtgcccgcaagaggcgaatctatcccagaaaaatcaacggaaaaaaaaaaccggagccggcccacagtgtttaatccctatccatccccacaccgcaccaacccagccgcgactcaactcctctctctctcgttctctccgcctctccgcctccggcgactctttctctccgcctcctctctccttctccctctacctgcgaccccgcacctcctcctcctctccagccgccgtcttcagcccggagctctccttccgcgggtggcaacgggcggcagcgcctctccgcccctcgcctcctctccctcgccatggggccgcgggagggctcacggtggcaggcggcggcggctcggtatcccagatccggcgtcctggatggctggatccagcgcgagcggaaggggaggggaggtggtggtggcctggtttcccagtcgcggcggcacccttttttacggtttttcgtctttttgtttttctcctttcttgtggatttaatctgtgatgaattggcagcgaatccgtgggtgggattgagaatccgttgatgtgaatctgtgatgaattggatttctttttcttttttttttggaatttttccatcgctaacataatcggattgggattgggattgagattgagattgagataggacggacgaaaatacggacgaaaagagatgtgacgaccggaaaaatccgaatatttatattagttatagacgtactcggactcaaaagacgaatgacggacgaagcggaataagtttttaattaggtatgtcttttctatctatgtttgtatggttttttccttccgtgaacagtagaaatttaaattgcatgtactactcgtatgtcgtacgtacgggagaccggtagcagctttttatctaaacaggaggaagttattattttacaataatagatctaatctaatggtgtagaataatgggtctaccaatttaagtgaaaatcaaaggtgagattagatagtgctatatgatggtttaagagtgtttataggagtgccacgtggcggcttaagagcgtttgtaaaaagtttaatggacttttagtatataatagatagattttctcatatcatcacgaacggaagtgggcaaaatgtgtttgtggcattgtcaaaggtgagatcagtgcaactgttttcaaatggagatagaagggagcaccatgtcagtaatagcaaattctggtccaatctcccaataactatccaccaattcttccatacatttgcaattgttgctttagtggtggctctgcaaacacatcagttcagagaatggaatggaggataccttgttctgatcttacgatgtggtttagaaaatgcaatggagatctggtcacatatggacatgagactaatcatgatgtactagtacagtatactgagtcactatctcaccaaataaaggcaattgtgcacttactgatcaggaacaaggtaaacacatggatatctgaaacaatggggagaactaatcattttggtgctaagttcacaattgcttgtcagttctcaagatcacttgaatttgttcctatcgagagtatacataaacagtggggttctaaacagcacctgtgcattctgctgcctattccagttagtacaaggttacggataatttcagcaaacaagcattattgttttcaaggaaaaatatcaaaattgctggtggcattctttgttgttcttaccacagaggggttaactatggttataatggaaaagaaattgtgtgagctgagccattgctatggtttcctgaattatacaaatgcaatggagggtaggcaagcaattccttttggtggagccactaaaccagatacatgaccaattggtagtgttgacaagattcaccttctcaaaattttgctgaatgactggcttcaacaacactacttccattcgagggttgaccagtggagcactgagtttgttatcaaggttggcattccggaagagtccacttggtgtatcagtttgaggcatttgctaccaagaaaagatgtccatggaaattgcattgtcagatatcttttgtcaatttcctattgttaaccggactgaccataggagctatgaggacaacttatctggtaacatcaggatgtgctccattgcaagctaatcatgggggcttgaatggcgaaggaggttgactaaatgtggctgcaagttcttacaccaagacagataagaaacaactacctaatatgtacctctccagtcaacaattcaaatatttagagcagccatgggatccaggaggattacttcatcggcttgaggacaagccgaaacttaagaggggattgttagaagctctattgggtcgcatgcagtatgggctgttgacggtcgttattgatcagtttcgaccgtcaatactactaaaataggagagaactagtgatgcttacaatgcataaaaatgttagagtaataatattccacaagtattaggttactaaccttttgcagagaatgacaataaagtgaaggagaatcgacgtcaacataaacgataaatcaatcggacgatgtcgacaatcagacttatgtatgaatgggccaagaactcagaattgacacgatgaattgggccaaaattcacaagtctgcggagtggagcaatagaggaggccaccagccgaaattgggctggattgggccaaccccaggttcggccgaaccaatcctggcgccgttggatccaggttttggcgtggacgtctaggattgcatcccaatgacggttggagggcactttggacaattccccttccacaaccgtcataactacctctatataaggacttcaccttgtcacttcactcacacacctcaagcaatagctctctcatttctctcaagcttaatttagtagtatctagctggtggaataggaatagagtagaaattaggagtctggaagccttcggaagagttcggatatggctctagcagcttttcttttctcttttataagctttgtacttttattagaatactcttctaaatacatttatggtattgaaatattttccgagtatatgagtacctactttacattatgttcttgttatactgaatatacggctagcttatctgggagatgctttggtgcgggtataatgtttgcttatgcaattactctatgtcatgacgatgatattagagtagtatctggtagtttagacgtggtgtctagattacgagatatcattatttggggttatatattacggatgagaggtgggccgctgatggtgacagctcagtacgatatataatcctaagttaattccctgaggagggtattcctccgtatttagccccggttgtatagtcatgatggactgtcgtaagaaactcgacagtcaggggtggcttctcgaagtaccaggagggtatcagaaagagggtattagctagtatatcagttaactaggatgtatatatactatgtatattagaagtataggaatagattatcttcctcttttctttccacttagcttagataatatattatgagaatgagcagtttatgcttgtgtgtcactatatccttggattatcttaacccctgtttagaatatgattatcacaagcaatatataaattattagtcatgttctctctacatgatcttcccacgggataagataaatacgatatccttggaatactctcggatgaaatgttacaatggtatatccgtgcgcttgcggatggactctgtaaccataatataccagaagtatttctgcgtcattgctaagaattatatttctagtaatgtcgttaagaaataccaacatgggccatgtaatccattctccaaagcaagcctaggctagcccaagcgacagggaacaaaaggatggtactgctcctgcagcaaacatcgaacagatcaagcaggcatcaacggcttcggccacggcggcggcgacaacctgcttctgggatgaacctcagcgaactctcttctctacctctcttcctacctccagcttcctctcctagttctacaagcctcgtccgcgagcgaccgccgccactcgattgccactcctcccaaatccggaagccacctcgcctccgcgacccaccgccgcctctcctccactcacaccaacgggctccgccacccccacactcaccgcttgttgtgcccccaccgctaggagccaaacagcactaacggtcagtgcaaatccgtccatcccatcccacctcaatcccttctaccaaataaaaactataactatcctataccataaaccaaataaataactgaaaccatcccatcccatcccaaaaataggataggtctaacctatcccattttgtccccaaaccaaacacacgctatgaggtaaaatggccgataattatattatcgccctaagattgcatgctatatgctttttggttctcaagttcaccaaaaaggcaggggacatttgagggtgttagcttaatgcaagagttagcttaacgcgtgctccaagacaaataaatcaaatgtttaagtgagagaaagagaggggagaagaaaaattgaagtcagccttatagcctccatattttaatgtatgacaccgttgactttttgtccaacgtttgaccattcgtcttattcaaaaaatttatgtaattatcatttattttattataacttgattcgtcatcaaatgttttttaagcatgacataaatattttcatatttgcacaaaaattttgaataaaacgaatggtcaaacgttggtcgaaaagtcaacggcgtcatatattaaaatacggagggagtatatgtgttagctttaagatggactaatagtagaaagtgagctctacctaaccagctgcgcaggcgcaatgccaacgatcgattgtgccttcctcttctccacgacttctcctgcttctttcacgagggcagcgaaggccgtgttggcagtcgtgttggcagttatacttgaatccaagcagacgtcggctgcgatcttgtcgaaccgatcagccagaactggatccgtggagatcagcttgtcgcataccgtcacgcagagggacgccaacgcctcctgcacttctatttcctctggagtatattgcttgccattctgctgattggaacaagatgaggcgttgttgcctccattgctaactcgtgaaggatcaccgtctggtagggcttctatgtctgcatctggtggcgagaaattcccagaattgttcgcctgtgtagctactgtttgtctctctggtcgtctccagtcacagccaagtaattctctgaggacctgaaacattaaccccaaggtatttcagcataaaactttttcgttttgtacgtgttaatttgacaggtatcgatcattacctttggtattgcaatggtcatggagttcttcagtttgtcccaatgttcatcgtccgtagtgtggttgatacaaagatgtttcaagatatctgccgcacttgtcctgaatgtgttgtcctcgacatctacaaccatctcagaaaggcgatcgacaacaatactatcatttagcttcaacttcaggatgatcgaggcgttgctttcgctctcgagagacagcttcaccagctcttcgcctgcacatttcctgacggagctgcgtttgctgtcatgaacaaagatgtctgtgaggatcctgatgagaccctgtatgttttcactgctcataccaccagaagacttgtcgagagagagaactgtgagcagctgtgcagctagcctccgaagctctgcatcacaaccgtcgcacctgaggatgctctccatggtgctgattgcaggcttgcagctcgtgatttggcggcgtagcttcacgcgggagtcttggaaaggaacagagacaagctgaccaataagtgttatcgacccctttgccatgactgagagttcatatctatggtcgtcgtcgtggtcgtcctccatggtcggagccggagctgataggtgccatgatcgtggagacaaggcctcgggtgtcgctcatgatcctgcagttgtcctcgtcggcggcgagcttcccgaggatgcgctggccctgcaccaccagattcttgtacttctcgagtgacagatggggaggctcacgctcgtagaccagcctgtacatctccacgaactcaacctcctcatcagggcatggtggtggtctcaattgcagcttctcgagcaccaaatcacggtcgtatggctcggcgaggcggtactcgtcgtcgagcagtgaggttacgcagcagagcgctcggggtagccgttctaggtgaacgccaccggcgatgtaagccactatcaccgtggcgcgctccctcgcctccgcgtcgtgcgggcctcgtggctccagcgtctgtatcagtttcagcatcacgacatggtggcgagaaatgagcatatgtttgatcatcctgtgctgctcaacgtgagtcgtggtacaagcgtagctggacgctatctccccgacgagcgtgctcagtatcctgagcccggagaggtagccatcaggtgagctcgacgactccacctgctcaacggcgtaggtgaccatgtttctccctcgagcgaacgaggggtcctcctcgcatccgatcatggtgtcccgcaggtagtcccacaccgactcccgcgcgtccatgtggtaatatcggcatacatcattcactattgcttctgctgcagatgaatagctgaccctgtaggtgaagatgacgccctggaagatagccaacgagtagaagacgtccaaggctggtgttatgttggtgtccccctctcctgttaccgagtagtagtcccgacgcctcgcgaggcgccacagcgagagcgccgtggagatatatatagatcccgaacatgtacagaacaatcagagggcacattaggacggcgatcaccaccacctgaactcccagctttagatagtgcagtagctaggatgtatgtgatgttgaatatgcaggaacccctagctgtgttgcactccaggtagcttaaaacgttcattagtgaaactgatgtccttactgttgtctgtaacaagcctctgtagccatcccaaatactgctcagcttttctttcatgaagacatcgaagaccctgtaagaaaaaaaaatatggagtatcatcaagttttaatgaactcagtagacaggaatagtgaaggcacaacaattcttcttaattaataggcaaatcttgctacaggatatccaaaaaaagtgtaattagctacgagacaacgcaagaacgtgtttctgctatagagcactgtaaaaaactggtaattatagttgttggacacccgcgggattattttattatatctagaagaattggagagagaaacagctgtgtaagtacggttcaaccctttgattttttttcttttctttttcatttttcttccttatccttttctccctctctcattctttctctatttctgtctctgctctcaaccgccgccttcaacctctcccgccgcttcgcctatcatcacggcgctcgctcgccgccgccactcctcccacagcgtgagcagtgtgttcagcatatccaccagcagcctcccggccgccagccgcggcaccgaccgatagtccgcgccgccgtcccgcatcagccccagcaagaacccctcgtcatgcggcacgctcctcgcgtagcacggccacctcgcctccgcggcgcttctgcaggcctcgctcgcgcctgtgtcgacatccttgccaccgcccccatcgtccacaaccctatggaagtagatgcggtgggattcctcctcgaatgcgacgacggtgacggcgcccgcgcggaggccagccaggaggtccgagtaggccacctccttggctgcattcttgggcagcgcgaagcgagcggcgaggaggaggaccgctaggacgatgggcgcggccgccgcgggcggcacgcgtcgaacggctcaccgcagcgcggctgcagcatccccggggaggtcccgcggcaagagccgctggagccacaggcgtatcctcctccgttccggcttgcggaaccccaaaccgacctccttgtccacctcgtccaccttggcacacaccggtgccctccactgcaatcgcattcattccctccgctaagcaacccgcagccattgctcgcggcgaggcagctcgaagaacctgggggactcacgaagcaaacccgagtgcgtgggacggaggcagcggcagcgcagacgggggacaagcaagccgccaccaccaccacggcagccatgccaatctctacggtacactcactttggattaatttgagccaagggcaaaatggtctttaatgattgtttctctctcctattcctctaaaaataataaaataattttgtcggtgtccagcagctaattaccatttttttacgatgttctacagcaaatacacgttcttacaatgtcccctacctaattgcactttttttatgtactatagcaaattttgcctaattaataatgtatggaaacatccctacatccctcttatcctcctgttactggatacgtgttgatggagtcgaattgtccgacaaacatagtgttgacagccacaattggcacatcccaagcaaactggatggtctggtctgctcatccaaatgaccagtttttgggtagttaaagattaccgttccgtcctagctagttttgaagctaccgcatgtgattgtaaacaccctgaaaatgataaaatggttgttcttggcattattgcttcgttttcttgtagtcaacaagaaaatactccctccgtccctaaatatttgacgccgttgagtttttaaacatgtttgaccgttgtcttattcaaaaaatttaagtaattattaattcttttcctatcatttgattcactgttaaatatacttttatatatatatatatatatatatatatatatatatatatatatatatatatatatatatatagttttatatatttcataaaagtttttgaataagacaaacggtcaaacatgttttagaagagtcaacggcgtcaaatatttaggaatggagggagtaaaatatagcggttgcttatgttgaataaagattggattacttttgcatgtgaaattatgaagtgtcttttttttcaaatgatgttctccctcatattgaaatcattacgtaataaacacgtagttgaaatagttagttaacagtttgcttcctgagatttattctcacaaccgtaattacaatctttttatgcacttaatgcggttttgcgcgtgacttatccaagtcgcacgtgtaccacgtggcgggtcatcgtacgatcgatcgtgcacgcttcttttttctttttttccttttttttcggttgcgcaactgctgtgtttttttttcttttttttctttttgccattaactaccacacgcatctaagagtaggagtcaatatttgaaaactttcaagttaaagatttaaaaaacttttaactcagatttgaaaactttcaagtcaagatttaaaaactttcaactcggatttgaaaactttcaattcaaacttgaaaactttcaactcggatttaaaaacgttaaactcggatttgaaaactttcacctcggacttgaaaactttcaactaaagatttgaaactttcaattcaaacttgaaaactttcaagtcggatttgaaaacgttcaactcggatttgaaaacttttaactcagatttgaaaactttcaactctgacttgaaaactttcaactaaagatttgaaactttcaattcaaatttaaaaaattcaagtcaagatttgaaaacttaactcaggtttgaaaacttttagctcaaatttaaaagctttcacttcaaaattcaaaataatcaacttaaatttgaaaactttcatctcaaaattcaaaacattcaacttaaattttagaaacttttcaactcaaattcaaaactctcaactgatgttgaagctgaaagattgaatttataaaatatcgtataaaaatcaagcgcgcaagtggaaaagaaagaagcgattccaaaaaatctggaaattttaaaaaggaaacgaaaaggtgacgccaaaataggagatctagagaaaaaaagaaacgcgtagggacgcggctagcgcgcgccggctcctttcctggcgcgcacgcacgcactagcaaccccctacttaatgtggcatgtgtgcgcgaggaaatgggagtagcagaacgtctgcacgccatgatgtacttattgtgcacagatgagtttgttgatttattggtttaattgaatactagatatgttaatcttggaagggcttgaagttgcaactaaagtaaggtaaatatgttctattatgtaataaggatggcgatcatgcatatctgttaccgtagataccggcactgtgtctgaggattatctgtactggtatcatggctctgtgggacactttatgcgctctcatgtagtaattcctatctacttccttcgtcccactagtctagatttgttgtaataggatatattatattcagtactaggttgatttttttatgggatgaaaggagtgtgttccattgtacgatggcattggggtgggatgcaagagtttagaactaattgcacatttttacaactgcgaggtcatagcactatggtaaaaattaaaaaaaaattgcatcaactatatattcttatgtttgaacgagtgtgtggtacttgagtttgcgggtaacaataattgtgtactacctccgttttttaatagatgatgccgttgactttttctcacatgtttgaccattcgtcttattcaaaaattttatgcaaatatataagatataaatcacggggtgcagg

SEQ ID NO: 69348 - DNA, 23965 bp, Oryza sativa
ataattacataaattttttgaataagacgaatggtcaaacatgtgagaaaaagtcaacggcgtcatctattaaaaaatggagggagtattaaccagtgtccaaatcattcatggtgcttacaattaaatggtacggttatgcgtattcataggttggtatagattaacgaatatatagttctatgtttcccaatcgactttcgacttggaagaatttaaatatatgcatgcatcctactgccatactatacactttatggtttttcctgattgagttcctgtttcccactttaaataatgagaaattttatggtacataagaaagtaactagaggtattaagattttacgctaaaaattttggtacctcaagaagatacttggtacctgtaggtatttacgctacaagtgtgatacatctcaataccttatcaagaatagtatctaatcaggaatagtaaaattagccttgaataattcatgcgtatgcatgcatcctatcccagagcatatgcatatgagtgtgggagaagggaagtaaagatcaggaagaggaaactaacaaccagatcgacaagagaaactgaaaataactgaaacaatggacaaaataactcgatgtaatagctatggggaggatcgtcggaggcaagacgactaacccggcagtctggatgagggtaatcatcgtgagacaccaaaagtccttcttgttcaacgcagagacgaagccaccaaggagaacaacggtggtccaggtgaacatcaagaaggccaggcccctgactgccatcgacaagtaccccatgagcaccgcatacttgttgatgttgactacttccggccacagctcgtccatgggctgccgctgccgctggccgtggcgatttgttcgctcagatcgactgtaactgatcagctccgactcctcatcacctagctcggacattcttgtttctttccctctcataccagcagaagcagattcgatcgatcgaatgaagcatgcagcagcaatccaatgtgactgtgtatacactactagaaaattaagctgatcgatgaaggcatggatctgcctgctgctgctacttaattagctacctaccatgggcatgggttttttttccagttatatataaacgacctgcagaaattaaatgatagatggtttaccttgaagaataaaatagtgggaaacgagtattgtatatatgcttgcttaccgcatgattgggaaggaattaaaccaaggtctagctaggccagctcactccatgatgggaaagcaaacaccttgttgatcttgcttgtcgctgagctcaacacgttagcagctggctggagaatggagatacaaatagtagtagtaattaacgaaaaaaaataaaacctcgaccactttctcctctgaccacataaacaaatactccctccgtttcgaaatgtttgacgccgttgactttttatcacatgtttgaccattcgtcttattaaaaaaattaattaattattaattcttttcctatcatttgattcgttgttaaatatatttttatgtaggcatataattttacatatctcacataagtttttaaataagacgaacggtcaaacatatgctaaaaagtcaacggtgtcaaatatttcgaaacggagggagtatatcgtttactcagatcgaatcccaatcaatcagcttgccattatatatgtactccacatgatgtgaaagcaaaaacatggatcacttgctgcatgtcaatacctaatctcgcgctcagcataaataaatattccaatatcatcgtttacttcaaatccaatcctaatcgagatcagctcgctattatgtagtcagcttgaagttcaaagctggccctgctaacaacagagctcaattcaatgaaattagcctagtcttttcttttctttccctttatagatttatacttgtacggttttcctcctgttctattcagtgaaattggcactttctagtgccggttccttaaaaacaacaacaatagagctcaaccaatgagaggaagaacagccaaccggaggaccgagagcagagcggatttgggtgtcgtcgatgctaggctgctagtcatggtcgcaagtaacgttttctgaactcgagatatcattaaaggaaatacatcattttttcaatgattttgtaggaaatatacacgtttagaatgcagaaatataacattatcgcagaatggaagtgcgagaccaaggtcttgcgcggcgagcatgcgacactgcacaatctcgcgcagcacaagaccgcgcgaactcgcacgattagttaagttttcgcttatactccctccatctacttttgatagtcatatttcattttaacacacagatcaaggataagtaattctacttatcatctatttaaacatgctactagacattcatcgtaaacaagcgattcattaatatttgcatttctcgatgtccatgtagccaattttatgtggaagaatgaagagtcatgcattaaatttgagaaagttattaagataataggttgttggattgaaatatgcctatctccactacttaaaaaattgaaaacgtttccatcgtccgtaataacgaaaaagggcgaaaaaaaacattaaaacaaaaaaaagaaagtccgattcaatttacttccgtcgtccgtgaaaatcttatcttatcttaatctcaatctttccgaggggactgaccgcgccctccgtcaccacccgcgcgatgaaacgccggccaaagcaaaaaaaagtaattaagcaaagggataaactagattaaagttcctaaaattaaaagtggataaacgatattgaaactcccataactagaaaaaaaagaaataaaatagattgcaatttcccaacaaaattccccaaattcgaagaaccctaatttcgggtaagaaccctaagaatcaaaatccaaatcaattaagctaagggtttgggttacttaccggacttgaagcccctaagctcaccggaactttctgggaagcggcacctccactccttcaccttctcgcagtcgcgtcgggttccccgtgcacgcgctgtcctggagtactcctccaccgtcccttgccgaagacgggaagcgtcggcttggcatcgcccctcccaccgacgaggtccaggccactcggcgcttgtcgccgtttgcgcgcccgcctggtcggaccgctgacgtcgtggcatggctttccgccaccctcgggtccgtcccccatccgccaaagcaggagccgcttggcggtcgtcaccgcacgcgtgccgccttcgccgttgtaccgctcgctcgtcgccagagagaaaggggatcgggagagagggatttgggagctagggttttgcccctctctcccggtcggtgcttcatccgacgcggggacgatcggagccatccaatagatcggacggctcagattcgtccaacatcgggccgctaccaccgctgattacgctgcgcaatgggccacggaagtgcatcgtcgccgcgtatgtgggccgcgctcatgtgctcggcttgtgggccatcgaatggactcagctcgcgtgaagatgggccagcccaagtttgggccggcttgggatgacctgggccgaaagcaaatttgatcaatcaatgtggctcagatttttaaattaaagttagataaactcctaagtagcctcgaaaaataaatctaagactaaagcctaaatccgatgctaattcatcaaattagactcgattctaccgatttggtaatatatcaaattagacttgatttttactgatttgagattctcaaggtgtcacactatcaaacggtgttttttccgttgcaatgcacgggcactattgctagtcaaaaataaatttttcagatttagaaatatgcctatcaaaagtagatggagagagtattgtttatacaaagatttgaaaaacaaaatatcccaacctccatctcccctcacatatgcacattactgctcaccccttcccttctcttgctcgagttgtatcctcttcatttgtaacatcctgaaaattaagtatattatctaagggtgtgtttggttggtgggatatacctggataggacatggccgccgctctttggagggtgtttgtttgctggacgaaagtgggatagggcggcccagaggggaatatacccccccagatgctggatagagggatctggccgatttggccggatgcaaccactcgaggctcgggcgagtcgggcgagtgagtcgcgtgactcgcgtcaccccttaccacgacgacacgagcgaggcggcggatagggcggccggcgcgagcgacgagcatggcagccgtgggtgacgagcgcggcggctggcgagagaggaggcgagctcggtagccagcgcgggtcacaagagaggaaggcgacggcgggaggaggcggccagcgggaggaaggcgtccggcgggaggaaggcggccggcgggaggtggctgccggcgggagtaggcggccgacgggaggaagtggcggcggcgagcccagatctggccctatttttttttcttttttctttttctttttttcttttttctatgtgtatttataatagaggtagtggagtaaaattgtattatgtattaatttgatgggggtattgttaacaacgaaatttggtaagcccaaagttatcatcggcctaaagtcagtatcggcttcagagtcctggaatcggccgatgagaattatcaagccgccagttgtcggattcttgctaaggaaattgatctagtaaagaaagcttatccagaagagaccgagttcaaagagaatgcggcatggcaagttgtctattaattaggaatagtttggtagtttcctttttatctttaggaaagtgtgtttagtgtcctataaggactttatgttttccttttatctttaggaaagtttctttcttgtcctacaaggattagtatctacccatgggtataaatatgtacacgcggggtcattgtaatctatcctcacgatcaatacaattcggcgcatcgccaccctttttacttttacttttgtttctacgttctggcggaacttggcacccgacgcggggctgcatcggtgttcgatctccggctaaggggtaagtccaatgttccgtcggcccaggcaattatatcgtctacgtcggcgtcgttcaaggctgcatcaggacattcgacctcttagattgctctggtttggatgatatacttgcctacctatttatcatatgtctctgttaatctagtcttagcatatcaatttagctctatcggctgcttcttgttttagggtttctgccggtatcagctaaatcgcgttgctagattagattagcttagacatctaccaccctgaaaactcattcaacggtttgattgtctagattgtgtatcttttcatacttaatgctgtatcagttaagtttgatctactaagtcgtgcttagaaccataatctctatcctgcttcttgattgccaataagggtttcatcggggtttcagccggtgagttatctagacgttgcatcggctcataaggattgcatatacatataagttggatttagccgatgacaacaaaggtttcactgtttaatctaatcttgtggattttatgacattggacctccagtcgatgtatgctttaaccatcggatcagtgcttattctatcatgtcattgttagccgattggtttctactggattatattattgttatattttaatatcatcagctgattgtctttgcatcattatctacattggacacatagccgattgctcaaaccctatcgctatcggctagtatcggcatcggctggaatcactacattggcttgtcagccgatcggctatttgatctactgtttacatatcttgtcagttgcaggatcaaactgactagcacgcccgcatctcaacaatctttagacctgcacaggatttaagcagatctctcaggccggtgtgttcaattttttcgtcaacgggtatattcaccatctcaagtgagaggtgaccacacctacaaatccaccatacttcctccaaccaaacaaaaaaattagatcaccaactccaccttcgtccctacaaccaaataaaaaactggatcgccatattcacataaccaaacaaaaaactggaccgccatatcccatccaatcttagaaaccaaacacaccctaaaactacatcgagttgtattccgattctaaacctgcgctgcggcaccaccggtcaagtaccagctgcctatagctagtcccctcacggagacccaccatgcatatcgcctgaatttggatctgcagaaaaagagaaagggaaagggaaggaaatggagggggaaggaagagggtgggagaaaggatggggacagggaaggaggtgccatcgctggcggtcacgccgacggtggcgagtcaaggtggaacagaagaaaacgaggaaaggaaagggagagggaaggaggaaaggggaaaaggggtgggaggcgccaccaccgccgcaccgccgtcgccggtggcagcgacgcgagcggacgtggctggggagcattcgctcggggctgttcgcctccagtgtcgtcgcccatggagagcggcgcgggagtcgctccactttcacgaatatcgggacaacaaaactttctgaacttcccactattccgttttattacgaaaaagcactgatcaagcgatcgatcggttatctcgttgaggccatcgccgccggcgacgcaccggaacgaggcggtggcagggacaggcagtgacgcgcacaggaaatcgacaccgcttcttgctgctgggctcagtcatttcggtagtaccgaaatttcggaaatttcagcattttttggaccgaaatttttgacacagtttaactgaacttgactaaattttgatcaaattcacaaaaatttcagccgagatattgacttaccggggggtccgaaattttgtttcaaaatttcaatcactggctgggctgctggcagctaagaaatggatcacaagatgagactggttctgtttggggaggttaagatcacaggccgtcgccgttgatgtactagtgcagccagctaatgtcatcctgctatctactctctccatggccgctgcaagtacttgttgatggtgaatggactgtatgggttagtgtggttgtggtcgattgtaatggccccaaatggtttggaaattggaagggtggattgaacccatagatgggaaatggtttggtttagattctaaaagaagacttctggattgttgggttggtctggactactttagctggctgttgtggtttggattgggaacagggcgggttttaacctcattggcaggcctacagtcaagctgcatacagttctaccaaaaataaaatacgatacaattatattataagttcataattttttgaacaaagaaagttaacctctagttggtcaagaaagaacattattattgctgaatattttgcattcaatgaccaatgcataggacgcaagcacaaaaaactaacgattttcacacaaatactatatatatgtggtttcatatattaggaaagtccaaatagttgcccgagaatccatctcctaatccaaaaggtttagcgcctgaacttgctagccccccttgttaggctggctgtctaggcgattttggctgtgcggtgtgctgactggacgcactttccacgtcatcttgcctattgtaccactgactgaataagatgaatgggaatagtagacttagagtcatttcttcggtaaagctttcctcattccatctttccctctgaatgttgttttctctgtttagagtcctagatggactcttgggtaaagttcagaggatatttggacttctccttcctgcagagattacatttttttcgcggtaagaaatctaaataataagagaacagaaacaacatcattttccatgtagcattaagaggcttaacatcaacaccgtgaatgcagggcatgtaacactcagcttgccagagagaggaacccaaaaaaaaaagatgttctacaaatgcacgagtaaacataagaacgtagagccagctctaccttatagccatttcattgatagaaatgataagttacattgttacatgattgggaaagagtagaaaaaaagaagagaagaacagcaaaatggaatgtacaaaagtgtaagaaaaaaaatactatacattggcctcagatgattaaaggccgattttcactttgattttattactgaccggcacgagtaatttttaatttcggttttcagatcgattatcagatttccccggcacacagttttccaatgagggtatggattaaaataatacagattatgtacgatttaattaatctgatttcgattgacacagctaggatgctcaattatcacttccatttcggatgcccttgctctaggcaggagttcctcagcttctttcacgagggaaccaagagtctttaggctgctgctacagccagagataaccatgatgtcctcgatttccgacatgttcctcgcagccttcgacagtgatttaatcaagttctctgcttcttctacggtgtaacggcttccatgtctaacgattagtatgaatatctcagtgataagcttcaatgtgttcaatctgttcactatagtcaccttactcttcattgacagctttgtgaccatcgattggagctccgttaagatgctgaagccgttggctgccctgttaattgcatcgataagaggaggcaaatcttcagcatccattaagtttcgtgtcatcgtcacaatcagagataaaactgccgccagcatttgtctgtccacagattcggcacgaagtgttctcacaagcacctgcaacattatgtttatcttcagtatgacaagcgtaacgatccaacacaaagactaattatcaccctatatatgatgctgataaaaataaagcaagtgtttcttttcttgcctcaaacagactatacctctggactcttaacctttaaggcttccttgaggctctggatatattcatcatcatcagtgtgatgaacacacagctgctcgaggatttgcgcggcgcttattctgtattccttgggatatctgtcttgtacaagtatttttgtgagatcaccaacgacatcatctttcacttgtaagattaacttggcatttgctttgccatgggaacatagcgtcgcaagcttttcacctaccactgccaacccaaaaatgatgttggcctccttataaactttgtgagtgaagatgagtaacaatttctcaatgaaatattccctcgtcactatgttagaaagcgtgtgctcgtgcattcgtgtgtaaatgtccaatgcttgcataaacagggaactatcatggaacgatccgagcccacatccttggcaacctagaatcctctccatactagccatggcttccacgtctcctgagattttgcggcggagttccttgccagtctggccaggagcatccacaagccggagaatcacaaccatcgaagcatgcactgttctgaaccacgcactattagggtcatcgttgtggttgagcaggccagaccgcagaggcgccatgatcttggctagcaggccctccgtcttgttgatggatcgctgacagtcctcgtgtgcagcgagcttcatgaggatactcaggccctgcagcatcagttctcggtaatttacagggatgttgccatcacaatccttagggggaccttcgagcagagaagctatgcaatggatcccttgtggaaactgctccaggtggaggtcaccagcaaggtgcgccacgatccttgcagcgtgctccctcgcctcggcattgtatgccctcgtacaatcaagtgactgcagcagtgtgtgcaggccgccatcttggctgtaggatgccgataggaggagctgctttaccattgctttctgctcttcgacctcgacctcaacctcgagaaagaaattgtacttgtacattggcgtattcaggagggagtccaggatcctcaccccagagaggaagccatcaggggatccagacttggttaaaccgacggcatatgtgaccaggttccttcctttgacgaatgacgggtccttctcacacccgatcatcgtctcttgcatgtacgccatcactgactcgctcaaactagtaacaaagcgatatttgttaaccaccaaatccaccagccttttctgctcatagcacaatgtgaaccggtaacagaagagcacaccctggagcaaggcgatggagtagacgaacttcagcgcagatttcaggttggcgccgccattgttgacctcacccccgtagtcatgctgtatcagacgacacgcggatatggcagtggtgatgatcagcccaaacatgtagagcaccgctagagggcagatgatggtggcaaacacgaacaaatggagcagccatatgacaactactactaggttgttcaggtagtaggagcgtgaccgtgatcggccatagaaccagctaatggcacccctttccgtttccaatgtatccgtagctgagaaaaagcctaaaaacgacctccaagtatatcgtagcttttcgttcagaaagatgtcggagactctgtgggtaaatttcattgttccagttagatggtgagataagtaatcaagagctatataggctggtggtaaatctgtgcatttcacacttatcaggatatattacatagattttgaacctatctagcactaatatttttttttggaaaatacatatcaacagccatcggatacttacatttttcatatgtattcatatacaaaataaactttcaaatctctatccttgcaggggaaaaaaaccgatccattataattttgaagtttgaaatggattaatgtaagttttctattcattctggcctttgtgtgtcttcgacacaacagccctgatccattatactaaaaagttcaataataattcaaagttcaaaaaataattattaaaaatatgtatttggcttcaaaattacatgggcaatccatcctaaagtgttctcaccaatgtattaggataatgtcgaccccacgatggagtttggcacttggtgttgcacaaacgaccttgtcagcggtggaggaatttggagcttggcactgaggcactagtggagtttgaagatcagtgcactgcatggacgcactgagtaatggtggaatttcatgctcaggtaggacgatatatagaggtatgttttcctaattgaggaaatgaagctcttctcacaattgagagagattacaagataaagaatacaatcgtgtttggaataggccagattgtgcatatgctcatcgcggtattagtgtggccgtttttgtattggtcatagcctgaagtttgtaccaaaactaataaagttgacaaaaggtcaaaaagcacttacaccaaaagtgagacctttctaactcgcaatgaattcaattgttgaggtttgctagctctagaattcgactcaaaaaggagaattgtccaatactcgaatagttgttaagctattgagatttgctagctctagattttagctcctgatgtcctacatgccagtgactgaatggatatgcccacatgaactttcatcaggggatgtaaactacttgccagtgactgaatatttagaaagtggaactgtcttagcagaaaatatagctccaaaataaatgttttatgcgagcttaaaatataaaattaagatattgagcagtgcaaagagactaacccagcggtctggacaagggtaattattgtgagacaccaaaaatccttcttccccagtatggagacgaagccaccaagaaggataacagtggtccataaaacaagaagataacctagccccttgacggccatagacatgtgtcccatgaacagcgcgtagttgttgatggagctaacttcctcccactctgagtcatcaacgggctccattccactagtcattcttcccttgcagatgtgcagagtggaggtcaactgcaagtctgcaacgcaacaaagccaatatgtaagcccgcatgctcagaactctattcgttgtatactcgtacataataaagcctggagatgcacgccaagaatggaaaaaaaaactgatctacaagaagcatggtcattcttaacataaatatgtccatcctattaaatttaatcagttttgattagcatcaagcaaggtaggctgactttggttttgtcaaaatctgttcagttgattgtttgagaaagtcaaaggaaaaaaaatcatatggtgaggaagcaaaggcctcggctagctggctggagttagtgtaactaaagaagaacagcccagatcagtggatcacagatgttaccgtaattcgtaaacatataatctggttgtcagcataaataattgttggtgccttttcgggccaatacagattcacctaaatatttgttgcaaatttggcctagtgccaaattgtggtggtcaacaataatattccgttttctcaaatcgaatcccaatagatcaagttgacattatatatgtgtacgatgggaaagcaaataccatggcgtctgagctgaacagcagaatagtcaagctaactgttggggactttggaacagtcagtcacctgtttaaaacaagaaaaataaaattgattcgatagcatcaaaatttcacgatttcagttccatatagcacataaagtcagtgatttcagttcccttttccgaattggttgacttgcgttgaccggctcacaaatccaaacagcccatttcgctgcccaataaagcaaaaaaagattatccatctagggagcaacatgcgagagaactgcaataccttctcgtcggcgatgggcgaggagggacaaggcagccgggacgagggacggcggggtgaggctgatgctgccggagagccgcgagcccgcgacggacgaagctgatgcggggcgaggagcacgccggcggacggagatgaacgccggggacgatggccgccggcggtggggatcgactgataaaaggttgtgcagccaagggcagtatagtaaaaaccgagtcactcggctaggtcaacacaagtcaaccaaaacgggtaagcaagcagaatgactgatagggatatataccactaataaagtgaaatgcggagtttgtatgcaataaaactgaaattactacgaaatttcgacgatattataataccaatttcacctatgaaagcgattttgggtggaatttgccgtacgtgtatggcaactttggttaagtatgcgctccctctgtgatcaatctatctatacctctatactcgtattaattaggtactttctacgagcttttacgttaacatgaaagatccgaccattagattagattgatggtatactagggccgtagatttaaactgtaaacatggacttttttaagggaaactacggtgggtgtttaaggcaccagcctgaagttttattgaaatgaagaaacatttacaggagaggggttacaggggatgagagggggagaattaaattaagaattaattacaaagaggtataaggcccacttgcggagctattgtttgctcttaacatttttacatcgatgggaccaaatgtcaatgtcgctagcacaacgccggagaactaacttagcaggttcatcaagagaattgaagaccttgttgttgtgtcgtttccaaatattccacatgacggcaaggaggatagagcgccagactcgtggagtggcgggttgtctgggtggagggatgtcccagacaccttcaagctgcggcagggaggcgatctgttgttcgtccaggccaaaggtgtgccatattgttgccactccggtgcagcgtaggaagaggtgctccacatctttaacagaggagcaaaaaggacaacgtgcggatgctactaatccacatcgagcttgtctctcattggtgaagatgcgcctcttgtgtgtagtacaaaggaagatcttgcatttgacttgagcgtggttgtcccaaatgggcttagcgaaaaggtcatcctataaccctaagaagcttaagtcgtaggctgtttttgctgtgagggggcgatttgtggacaaggtgcgtctgttttttatctctgggtctagctttaggtggcataccagggcttggatattggccaattcgtgtatggccactgtcgacacagtcggggccggagatgaaggagcaattcaggagcggtctgttagaataattgggctaggcccaacttataatattaaatctcaaaggcccataatacatgttgaggataataataccacctctggatttaagcgagaaatatctcaacctaaatagggagttattagaggctccctgttgaccagttgaggtgggggtcggaatgccacacgcgcgcgcgcgcgccgggccgggccgtgggcgaggcgaggcgaggcgtggctggctggcggcgtgcgtgcgtgcgtcacgtcgctatccttttgcagccactaacccacgttcccacgattccctccgcaacagcgcgtccacgttctttctcctgatagataaggaggccgcgagtccgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgatatctgcaccgggtaggcgggtgatcaggtttttggggagtgcctcctgcacgactgctcatcgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgtttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacattccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggtaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgtcatggagcagttctatgactacaagatggttgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcagttgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgagacttttgttggaaaaggttatgacagcggaggcttgttccgcttttctttgaatgacatgtgtaataatcataacgctgtgaaccatattagcgagaatgatgagtctaatgtgtggcattcgcgactctgtcatgtgaatttcggttgtatgatgcgcttagctaacatgagtttaattccaaaattcactttggtcaaaggttccaagtgccatacttgtgttcaatcgaaacagcctcgtaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttctgactgcgtgtcatgtcctgaataaaattccaatgaagcacaaggaagtaacaccattcgaggaatgggaaaggaagaaattaaatctctcatacctacgaacatggggctgtttggccaaggtaaatgtacctatagtcaaaaagcggaaacttggaccaaaaactgttgattgtgtgtttcttggttatgctatccacagtgtgggttatagattcttaatagtaaactctggagtacccgacatgcatgctggtacaatttttgagtccagagatgctactttctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatatttatctcctgacgctgactactggaaggaagcagtacgcagtgaaatggactcgattatgtctaatggtacttgggaagtcgttgagcgtccatatggatgtaagcccgtaggatgcaaatgggttttcaagaaaaagcttaggcctgatggtacaatcgaaaagtataaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacagctttcctaaatggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttatgcttgtatgtcgatgacatactgatctttgggaccagccttaatgtgattgaggaggtcaaagactatctgtccaagagtgatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggaaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaattattgtgtgactgagagaagagacccttgaaaggggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacagccttgagaacatttcttatgagccttgaaatttggtggggattgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgccgggccgggccggggcgtgggcgtggcgtggcgtggctggctggcggcgggcgtgcgtgcgtgcgtcacgtcgctatccttttgcagccactaacccacgttcccacgattccctccgcaacagcgcgtccacgttctttctcctgatagataaggaggccgcgagtctgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctgccgccgctattggcggaggtggtgcgccgccgccgacgccgacaggagctggatccggagctggtgcgccaggaggaggtgccgtgaacgactacaacaacggaggcaattctgcctcaccatccagtggagggccattctcggggtataatcttctccttctactgctgttagcgctatactgtgtgcgctatgttcttggttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacacggtctagggcgtccgtgatagagatgttgggggcgagttgcatgtgagaacaaggcaaggaacagttgaaagagggcgccgcctaaaatccaattatcaaaccagaaggaagtggaccgaccatctccaatgatggatttcgaaacactacggaagtgtgtaaggcccgcgacgatgtccttccagatgatcgtgtcaaggcgcaaaagatcgcctagatcacacgaggcagaccatccgtagtgatcgcgaaagcaatcgatccacggtgcagaatcaccctcgtgcattttgaggagaaatttttggagaagacatatgttctgtgtcttgagattttttatccagcaccacctttcgctttcggagagcaaactatgttacacgcaattttgcaattgccgctgtgacagttttcttcccccgtccagaagaaggcccttcagcgcttgtcaatagtggtaatcacttctttaggaggaaggatagcccccatcatgtatgatgggagggccgagagcaccgaattgatgagggcaagccgaccatcggaagacagaaggtgaccgcgccaaccggcaagtcgcttgtcaatcctagcgatgagaggttgacagtttgcaagacaaagcttggtaacaaacagagagagggaggcataaataaggttgggggaaggaagctatggagcaaccaagaatccccgccaactgaaacgccacgtcatgctgaacgttaatggggaggaaggtgcttttacccatgtcaattccttctttttaccatgcatcccccgttcgttttcccatgattttagatactttttttttgtccccgatcgaatcacagatcatttttcattactgcagttgcaaggatgtggcaaaaaatatcatctagaccagttggttgatttgtcacctacatttattcagatctaataagaatataagtcaacaagttggtttttaaattcgatgtgtatatatctttaagccgacgatatgtatttcagtaatgacctttacccggtgaagcttttttttcttaattggtatatacaggataatagtatgttttaaactctctatcaagaaagagcagctaagctggatgggctctccaatttatgttaatttaataattccctcgataacaagataaatgatctccagtcatttcttgaccattgttctactttacctatgactttataaaatcctgtagcaacgtgctgagtatcacccaataaacataagaaaacacaccatgcatgttctagtgagcatcttgatgctggtaggataactagcgagctaaataaagctaagggtcggatgcgacatgggtgctagcgaatagagcttttctgccttgttagggtgcgtttggaatcagctgttgcatgtccgagcagtatatgagcgcgtgattaattaagtattttcttttttttcaaaaatagataatataattttttaagcaactttcgtatataaactttttttaaaaaacacgccgtttagtagtttaaaaaacgtgcgcgcgaaatacaacggagagggattggaaacacaggattccaaacacagcctgaatcgtcattgatacaaggaaagatgggaggaggaacaagagggagaggagcaatagtttgggggatgatcccctccattaatttctcattctggatctgtgctacttcctccgtttcataatataagtcattctagcatttatctatctagattcattaatatcaatatgaatgtggaaaataccagaatgacttacattgtgaaacgggggagagtagctaggaatggataaataaataatgttatcccaaacagaaaaagttacgtacggccgggtatgtgcttcacgtgaaatgggaaatatatacaatcaatgacgactaatttggcagcaaacatgcatgcatgggccagttaattaattatgctaaatggatagtttgattcgatgagcagccggacgactgaggctttcttttgttgggaaaaaaattaggtttgattgtcacatcagatatacggatatacatttgaagtattaaacgtagtttaaaaacaaaataaattatagattctactaaaaaactgcgagataaatttattaagcctaattaattcgttattagcaaatgcttactgtagcaccacattgtcaaatcatggtgcaatttggtttaaaaattttgtctcgtaatttacacgtaatatgtgtaattggttttttcctacattaaatacttcatgcgtatgtctaaacatttgatgtgacagtgtgaaattttttttttaaatagggcctgagagcaaaacacatgctgcatgaatagtagtcgctcgctcgtgtatcatacttaaagaaagtttaactaggaaaaaaaaacctacttcatatataaaatcacaagaccttttatccaaaaattgaaactttcaactaaaagttcaaaaaaattatactcttggctcaaactttcaatataaaaacccaaaacttctaatccaaaaactgaaacttcccaaaaaaatcaaaaactttgtgctcatggctctcaatctttcgatacgaagttacagaatcatggtagggtagctagctaaataaagggacggatgcgatatgggtgctagcgaatagagcctttctaccttgctgaatcgtcattgataattaggggaggaggaacaagagggaaaggagcaatagtttggggatgatcccctccattgaataatttctcattctggatccgtgctagggatggatcaataatgttatcccaaacagaaacagctagtgttaggtacgggtatgtgcttcacgtgaaatgggaaatatatacaatcaacgatgactaatttggtagtaagcatacatgcatgggccaattaattaattatgctaaatggatatagtttgattcgatcagcagctgaacgactgatcgagagcaaaacacatgcataatgcataatgcattaatttatatatatgaatagtagtcgctcgctcgtgtatcacgcataaattatatatcaatgatcgatcacatgcaacaccggcaaattaaattgacccatcatcgatccatctagctagctatgcctatatatatacgccatatgcatgataaata

SEQ ID NO: 69349 - DNA, 23869 bp, Oryza sativa
  unsure (1)..(23869): unsure at all n locations
gtccggaggtgtgaggtcgtcggcgagatgagctccggcggcgaggaggggaagacgtcgtggccggaggtggtggggctgcgggcggaggaggcgaagaaggtgatcctcaaggacatgcccgacgccgacatcgtcgtggttccggtggggacgccggtgaccatggacttccgccccaaccgcgtccgcatcttcgtcgacaccgtcgccggcacccccaccatcggctagagctagctactagcctcatctgcctgccttcagcatcctgcttatcttaattaaataatcacatgcacgcaagtgatatgtactgtgcatgtttcgatcgatccatcccccatctgaataatgttggttttaccctacgcacgtgttaatgtttttctcctacgaataaataaagagaccttcatttaatgcatggtagccaactactccctccgtttcacaatgtaagtcattctaacatttcccacattcatattcatattaatgaatctagacatatatatctatctagatttattaacatcaatacaaatgtgggaaatattagaatgacttacattgtgaaacagaggaagtacctagctaatctttaggaaacaactacaaatagaacgtcccattttattatttttctttaaaaaaatttggcggtgtttcgcctctcataaactaatgttgtagcatttagtgaaaaaatgttttagttcttaaaaagaagtagaacacaattggatagtcatatgaaacaatttgtttcaacatataaaacaaattttttaaaaccattcaaacatcaacaagatccaagtgaaaatcgaagagaatgaaacactataaaaatacccactaaaacacttcgatctaactaataaaacatctaaaccatttttgttcgctggcatcgtgtttcgcaagcaggcatgctaagacagccgctagcaaaaataccatttttgtaggcagcaaactaaagaggacaatagatgaaaacattttttgggataaaacagttgaaaatcgagatgtcgtcgtatagcggcagggcagggtcgacgatagcggtcggcctgcgagggtcaacggccgtggtccggaggaccaccgctgccggatctacctccttcaccgcccctcatcttcgccgctgatggaccctaagttcctctcgacactcaaggctgttgttggcccgatctttcggtgagttgtgataactacgatttgggagaaacgttaacgatccgactacaaccgtacgagacgttgtgttgcgccttagcgatcgatacacctctccgtgggttgttgatcttgctggtgcagatcaaccctattcctgcaagcaaatcgaagaaacaagcaagaacaagataaaagcaatctgatattgcaaataggaatttaatacaaatgataagttggggttccgaatacaagcagacggacggtctagccgacacgcgcgctacaaggaagtagcaatagctaaactttcatctaaacaaaacctgactaaccctggaggggttactagctatttaagggatggaggaggtcagaagggcgtcctccctctgtttggggcacagccccccttgggccccacttgggccggggtcccagacgaagttacaggcccataggcccattacagacaatgcagccccttgtttcttcaattgcggctcactgagatggaatatcacaatgaggctggatccgttggaaagaggactctgagagctttccatcaagtactcacgggacgaaaacggagctcgaatggagatttggcggccgtttgaagtcagcaatgttgcaggtggccgaattggattccagcacttggaagacttgatcttgatatcttcttgttcatccatgatgtgaacaatgattgtatccatagtagccatgatcacatcagccgcagtcgaatctatcccctacactatcgccacccgtctccattgccactatggaggaggatatatgccaaggggaagccatagccgggaggaagtcgttgctgccagatccccaccatcgtcacctgccgccatcggattcgcgccaccgtgacccgctgtcgccggatccatgcccccgtgactcgtcgccgtcggatccatgcccccgtgactcgctgctgccagatctgcaccgtcacgacctgccgtcgccagatccggaccgagccaccccctcccctccaaccaaatctaggagggggaggggagagccaggccaccgcaactgctctgatccctacagtgcgaccgtctcgtcgtcgtggtcgcgtcctggacggaagcacaccgccgcctcccctccgctgctgccgacctccactacgtggctctccttgcctccgccaagcatggccaagtcgtgctgccgctgccgccgagcgccgccatcattgaccgccgccgctgcaccccttcgctgctactagctagagagagagagataaagaaagaaagaaagaaagaaagaaagagagaagggttggatctgaggggtcgaggaaaaaaagagggagcacgtgatgtttattccctcccacgatttttgcaagcgaggctcccaacaccccgccagtaaaaaatagtttttttttactggctgcatcttaagagcaccacttgcaaaaatacctctatttttgctggcggccctcttaacctggccaccaaggacgatccattttcgctgctggccattagcccccaacccttgttataattccactggtggttttcacgtatggccgccagagaaaaaaataagttgacgccatgaaaaatcaattttgtagtagtgagcgtgaggagcgggtggagagaaacggttgagagagaggaggggaatgcataatatggaaggtgggggtgcgagggctgggcagcgggtggagcgaggcgtggggcgcgggcgcccaatattcttgttcccatcgggcgcccgagtcaaagggttttcgtaatctttaccacatcgggagcagagaagttgtttttatcgaagtaaattgtttactccgataatggtggaagcaggatggcaggacgtgcggtggggtggggagcagggaagttgtttttatcaaagtaaatcgtttactctgataatggtgggagcaagatgatgggacgtggggtgaggtgggcttgggctgatgcatgcttggcgctcggaatactaggagcatgctgcgctcctagtagtatctctatataattcatagatttttcttttgttttgtaaggagtactccctccatttcatattataaattgttttaacttttttgggtttaaccaagtttatagaaatattagcaacatctataataccagattagttttattaaatgtagcattgtatgtattttgataatatgttgttttgtgttgaaaatattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtagggatgaaaacggtcggaaacaatcggaaaaaaggctcaaccattaccataaccatatttttctcagaaacaaaaacgatatcggaaatatcgaaaaaccagaaagggcagctacgctggatgggctctccaatttatcttaatttaataattccctcaataagaagaaaaattatcctcagtcaatttcttgaccattgttctacaattttacttataaccaaattttacttataaccaaatattacttatgactttatagtaataaaatcccgtaggctgcagcaacgtgctggatatcacccaacaaacataaaaaaaaaacatgccatgttctagtgagcatcttgatcgtggtaggatagctagctaaataaagggtcggatgcgatatggatgctagcgaatagagcttttctgaatcgtcattaatacaaggaaagagggaggaggaaccagaaggagaggagcaatagtttgggggatgatcccctccattaatttctcattctggatctttgctagggatggataaataatcttatcccaaacagaaaaggctagagtacgggtatgtgcttcacgtgaaatgggaaatatatatactatcaatgacgactaatttggcagcatacatgcgtgcatgggccagttaattaattatatatgctaaatggattgtttgcctcgatcagctgccggacgactgagagcaaaacataatgcatttatatactcgctcgtgtatcacgcataataatactatactactcctatgtatcaatgatcgatcacatgcaacaccgacaaattaaattacccaccatcgatccatctatctagctatgcctatatatatacgccatatgtatgacatatacgcaagctacatatacactctctccaaagtttacattcctgatatatagctcatcatcagttgatcgtgtccggaggtgtgagaggtcggcgatgagctccggcggcaagcaggacggtgcggcggcggcgggcgaggaggagcggaagacgtcgtggccggaggtggtggggctgccggtggaggaggcgaagaaggtgatcctcaaggacatgcccgacgccgacatcgtcgtgcttccggcggggtcgccggccggtgaccaaggacttccgccccaaccgcgtccgcatcttcgtcgacaccgtcgccggcacccccaccatcggctagcctgcctcatctgcctgccttcagcatcctgcttatcttaattaaataatgatcacatgcactcaagtgatatgtactgtgcatgttccgatcgatccatcctcatctgaatcatgttttacctacgtgttaatgttttttttcctacgaataaataaagagaccttcatttaatgcatggtagccaactacctagctaaaaacaactacaaatcgcacatcccattttattatttttctcttaaaaaaaatcggacggtgtttcgcctctcataaactaatgttgcagcatttagtgaaaaaaatatttcagttcttaaaaagaagtggaatacaatcggatagtcatatgaaacaatttgcttcaacatataaacaaatgatttaaaaagaagtggttataagaggctcagtagcaccataggtcgtggattcgactcctcatgggagcgaatttttcagaatttaatggctttgtgcagccctggattcaactccccatgggagcgaatttttcaagatttaacggctttgtgctttcagtggtaggtaacgtatccgtcgacagcgaggcgcctgtgatgactttgtccactccaggatgaatttgccggcccagtcttcaaaaatgctcatagggatagggtttgcgtgcgtgcgatcataggggtgattgtgcgtgcgttgtgagtgtctgttttgtaccatgtaattctaaaaaaaaaccatcaacaagatccaagtgaaaaccgaagagaaaaaatgaaacactaaaaaaaacccattaaaacacttcgatctaactaatgaaacatccaaaccatttttgttcactggcatcgagtttcgcaagcaggcgtgctaagacagccgctagcaaaaataccatttttgcaggtggcaaactaaagaggatagccaatgaaaacatgttttgggataaaaaaaatttgaaattcgagatgtcatcgtatgagggtagggtagggtcgacgacagcggtcggcctgcgaggatcaacggccgtggtccagaggaccaccgctgcctgatctacctccttcaccgcccctcatcttcgccgccgtggaggcggatccagtggtatcgaacaccaccccagtcagatctatcccctacactatcgccacccgtctcctttgccgctatggaggaggatatatgccaaggggaaaccatagccgagaggaagtcgttgccaccagatccatgccatcgtcacccgccgccatcggattcgcgccgccgcaacccactgtcgccggatccacgcccccgtgactcgtcgccgccggatccgtgcccccgtgacctgctgctgccgaatctgcaccctcacgacccacgatcgctagatccggaccgagccacccctgccctccagccaaatctaggagggaggggagagccgggccaccgtagcttctccctgcagcgcgaccgtctcgttgtcgcggccgcgtacgggacagaaccacaccaccgcctcccctccgctgccgccgacctccactacgtggctctccttgccgcccccaagcatggccaagtcatgtcgctgccgctgagcgccgccatcgttgaccgctgctcctgcaccacttcaccgctactagctatacagagagagaaatcgcgagagattcagagagagaaaaataaagaaagaaagaaagaaagaaagaaagagagaagggttggatctggggggttgagaaaaaaaagagggagcacgtgctgtttattctctcccactacttttgcaagcggagctcccaacaccccgccagtaaaaattgttttttttactggcagcatcttaagagcaccgcctgcaaaaatacctctatttttgtcggcggccctcttaacccggccgccaacgaagatccattttcgctgccgacccttgttaaaatttcgctggttgttttcacgtatggccgccagagaaaacaaataagttgatgccatgaaaaatcgattttgtagtagtgagcgtgaggaacgggtggagagaaatggttgagagagaggaggggaatggataagatggagggggtgcgagggtgtgggcggtgggtggagcgaggcgtggggcgcgggtgcccgatattctcgttcccatcgggcgcccgagtccaagggttttcgtaatctttacctattattaaaatttaagatgattatgtaggcacccaccttttcgtccgttgtgacattagtttactgatttttcgtaacctttacctattattaaaataatcttcctaggtggccatacgtgaaaatgatcttcacctggaaaaataaatgcaccccgtctaagaaaattgtattcataatagtgggtcctcccactgcagccaccaccgctgcccaatgcagttgcgtgccgcggcctgacagagccgacacctgctgcagtccacgtcaggagcagagaagttgtttttatcaaagtaaattgtttactccgataattgttggagcgggatggcaggacgtggggtggggtggggagcagggaagttgtttttatcaaagtaaatcgtttactctgataatggtgggagcgggatgacagaacatggattgaggtggacttgatgcatcaagagcgggatgacgggacatggattgaggtggacttgggctgatgcatgcttggcgctcggaatactaggagcacactgcgctcctagtagtatctctatataattcatagatttttcttttgttttgtaatgagtactccctccatttcatattataaattgttttgacttttttttgtttaaccaagtttatagaaatattagcaacatctataataccaaattagttttataaaatgtagcattggatatattttgatactatgtttttgtgttaaaaatattgctatattttactacaaacttggtcatacttaaagaaagtttaactaggaaaaaaataaacctacttcatatataaaatcacataccttttatccaaaaattgaaactttcaactaaaagatcaaaaaaaatattcttggctcaaactttcaatataatatcccaaaacttttaatccaaaaactgaaacttcccaaaaaaaaaaatcaaaaactttgtgctcatggctctcaatcttttgatacgaagttacaaaatttgggaaaacttccaaactcctcacgtgtcaagttgggatgaaaacggtcggaaacgatcataaaacaggctcaaccattaccataaccatatttttctcagaaacaaaaacgatatcggaaatatcgaaaaaccagaaagggcagctacgttggatgggctctccaatttatcttaatttaataattccctcaataacaagaaaaatgatctccagtcaatttcttgaccattgttctataattttacttataacaaaattttacttatgactttataaaatcccgcagctaggggtgaaaacggtcacggaaattcccaatcgaccgggcgctgtttctgtttaaggggtaccgtttccgaccataacgtttttggctattttaaaattttgttttttctaatttctttctgtgtcgtattaatgtcgatattgagtagtttaaatgataaatatgttcaattaccgaccgatcgagcatcgtttctgaagagatgctactgattccgactgttttcacccctacccgcagcaacttgctggataccacccaacaaacatataaaaaaaacacaccatgttctagtgagcatcttgatcgtggtaggatagctagctaaataaagggacggatgcgacaatgggtgctagcgaatagagcttttctgccttgctgaatcgtcattgatacaaggaaagatgggaggaggaacaagctagagggagaggagcaatagtttgggggatgatcccctccattaaataatttctcattctggatgtgtgctagggatggataaataatgttatcccaaacagaaaaagttacgtacggccgggtatgtgcttcacgtgaaatgggaaatatatgtacaatcaatgacgactaatttggcagcatgcatacgcgcatgggccagtttgattcgatcagcaaccggaccactgagagcaaaacacatgctgcatgcataatgcgtttatatactcgctcgtgtatcacgcatatcaatgatcgatcacatgcaacaccgacatattaaattgacccatgcatcgatcaatccatctctctagctatgcctataaatatacgccatattaagcaagctaattaagctagctacatatatatatatatatatatatatatatactctctccaaagtttacattgctgatatatagctcatcatcatcaatcgatcatggccggagttgtgaggtcggcggcgtgcagcggcggcgagggggagcggaagacgtcgtggccggaggtggtggggctgtcggcggaggaggcgaagaaggtgatcctcaaggacatgcccgacgccgacatcgtcgtgcttccggcggggtcgccggtgaccctcgacttccgctccaaccgcgtccgcatcttcgttgacaccgtcgccggcacccccaccatcggctagcctccctcatctgccttccttcagcgcccgggcccccggccatctttatcttaattaaataatgatcacatgcacgcaagtgatatgtactgtgtgcatgtttcgatcgatccatccccatctgaataatgttttaccgtcaatgtttttttcctatgaataaatatggaagaatcttctcccatcgaacgtccgacgtcccaaaaaaaaatcagacggtattccggtgaccaacgagtgaaacatcaaattatatatgactagtaatatacccgtgctaacgcaacggtgatatttagtagagtaaaatggacgggcggctcttaaacttgtagaggtgtatcatctaggtccctaaactcttaaaatgcatatccaagtatcagaacttgtcatagtatgttctctaggtcccaaatcgctacaaccttctggatcctacatgatactgatgtggcatgccatacgtgcatgacatggcataattttgactgacaaatgagacccatttaaaaaaaattctttttctttttttcttctttcttctcttttatttttcctttcttctcctttctctatgacccaagcagaagaaagaaaaaaaaaagaagaatgagaagaaaaccaaaaaaaagaaaaagaaaaagaaaagaagaaaaaaaagacccatcatgtccatgtggcatgccacattagtgccacataggatcttagaggggctgtgtcgatttgggacctagatgatacactttgataagttccgagacgtggatccattttaagagtttggggatctagataacataaccctacaagtgtaaggaccgtctatgtactttactctgtaatctccaaaagttaatattgtttttagtcaaaaagaagttaatattgttttaattataaagcatagaataaggctgctggatttattgaagaaatagcacctatagaacctttcaactgatatttgtaactattggttctatagaaatagcacctatagaacctttcaactatttgtataataataactttgggatttgaaggatcaaataacagtgacttcacagtcgaagtatgtgctgaaaaaggaaaaatagaaacgttgttgctaaatgaatagaaatgcccaatccccagctctcaaaaacaaatagaatgaaaaaaaaattgagaaaccgaggttaacttcaactgcttctctgtgtcagacttggcgagcgaaaccttcagccggtggcgagcgcacattactcttcactatgtgtaggtatcagctaaataccagaagcgtccgtattctattctaacaaaatacatatattatctaccctgcttatcccttgaaatgacaaattgaactgcagtctgaaaatgagacataattttatcaaaatactaatagtaattagagaagagtggcacttacattgtactcggaacaattctgcaagcctctctacatataaaagcatccggtcaaatatcaatggttgatatacatgcatgcatggttgctttttgcaaaacattcgatcaataaaggaaagggctctttatattttcttcggtacaacatctaacaaaaaataaaacacaacactaaatgctgtagcaattaccagtgtacatattctgtaaacatatacttatagtaatatgcctgtgctaatgcttcaaagccaatcagtaatgtaaattaaaagcataggatgagatggatttaagttagtatattgttgattccatagccgcatgcataaaataaaatcacaatttttatacatttctaactatctacaacacatataaattcgaccagctattaatttatcgtgttcaatacagtgtattacaaaaatatttttcctcacttttattcccagtgcagcctctcttctccactctacatatccatgatatgtacattttcttcagagaacaagtactacagtgttaatcagaaaaaaaaaggaccgtggaattgatatgcataacatcatttggaaaatgcttagtaataggacaaatctgcccgaaaaaaagattaccaatatttgactctggcatgccaacaacgagaagaaatgtttacataatcaattgatactttatttattacagttctaatccaaagcccaaaggtcaataatattagctcgtaggcagctacatatatcactacattcgtcatctgccctcttagccttgaagcctagtcattcattgatggaacatattaccaatctcacgaaccacatagtaaatattcagaaggtaccaagtagccaagcactgattattatcagtttgctgctctatgcaaaaagtaaaatataataaataataaataagaagaagaaagaaagaaaaaggagaatggaagttcaagaaatattaaataccaaggtgcatctttattttttacacatatgtacatgtaatggccaatcacattccagcattttttactgctgttacagcagaaggtgcattttgaaaaatcaagaaattatctggtttcgaattgcactgaacaacacgcaatgcacctgcatcaggtaaaattataacaccgtgtttagtccaaagaacattttaaaggaaatagcacttacatggcaatacctcagattgagggcaaattaccctgttgcaacaaccattagtaatccatcaatttcgtcccaaatcaatttccggagaggaagatatctgatgcattcagatccaattgataagccaaaaccataatgtcttgcttgcaattcctatcaggcaggatcagagaaatggacctgctcacgcgcatgagcttggaagtagatcagccagtggcctggttggtgtcgactcgggatcagcggcgtccgcgccgacggctgcaacgtcaggcggatggatgcctccacacttgcaggcttgcgtttccccaatcttcggaaggggaggagatcgcgttcgcgtgggggagggggaggaaatcacgcgcttgcgttgcggcgaggcgatctgcagccggccggctcagggagcaatagccaggcttggggagggggaggcgctactgcggccagggcgacgattgtgagggacatcggcgctgggagaggggcggattggcggattgcgggatggcgaccgtattctcgggcgtttgacgcgcgtgggaggtggagacgatcctgagcattggatttcacagaggtgatctgaaccgttgagtgatgaatgtaagagtgtaggagagaaagatgagtaaaatgagttggtgaattataaggtagatgaaataaaaaaaatcagcaactgacacatttaaaaattttaccattttcattttcgttccaatcgattaccattttcatatggcttggccggtagaaagtcggaaacgaacatcggtcagctaagaatttccgttaccgttttcatcccagtatcaagatttgacgaagaagttgtcgggtctccttaacgtcgctgaggagtgactagtgaggaagggctcgtaacgcctcgccgagtagagtagcgaggaagaagggaacccgggctcgcccaaatatcactgcgtgccattgggccgtgcttgggccggcacgaagcacgatgggccatgccgtgctagaccggcacggcccaagtccccacaattacctgagtgtgcccaacgctccagatttaatttcgcatgttgagccaatatgctttatggctaatctcaaacacaagcacttagctggtttttcacctatagtcttgattttgagattttatttattttcggctatgaagtaagaaaattatcaatgccttcagtgtccagactttcaggtgttgagaggctgaggtacaaatgagagcttctgggatgaaatatcaagcagtaaaacattatctcaagaaatgcaagcaccaaaaaagatcaaacgagtatcccttagcctcctcatttgtgggttgaacaccaatacggtgacaatttcataactgctgatcaagatatggctcatcagccaaatgaactctgcaactctgcacgagttcacctctgctgggagctatagtacaacagtgacaatcagtcatcggtcaactgcctgagataattttgaacgcattcatctgcataatgacttggaagttggagctttgctggtattgttctgaaccaattacagacatgccaggagatttgacaacagagagtaatcggtcaaacgcaaaaaagggaatgttgggtattacaaaaaaggggaatgtcagggtgtacagtcatgagaaggccgagctttggtataagctactttactctgctgatctgaactcatacataacccctcaaatcaagaacaagcactgcatccagttcttgcactgatctgggagcattactctacaagccatggtgtcagaacagattcccattcgcagagttcgccttctttgaaccatagagctacagacagaaaatgtgtaatgagtttatcatctgtttgtaaagaacaaaatagcaggtcacaataaagttaagtccaagctaacaaacatgcacgtctctaagcacatagtgctgctgaattattatttttaaaaaaaaaaaacatgatcctaatcactgtgtcaactacttcattcttcgtagtacttaaaactcatgattctatgcaccttatattgttataccatgactactgggaaaaggagtagaacttaccgatttcacgcttgccgttatcaggactgtcacttccatggacaacattcctggaaagcagagtccataagaaatttaatttctttgacagagatatatatgcagagatatccgctaaaatgtgaaagatgtggtagatataataatgttaaaacatgaaaggttgtttgattccaaccttcctgtttgaactgcaagatcgccccgtatggtccctggttcagcttgaaggggattagtagctcctattaacttgcgagctgatgcaacaacaccattcccctcccaagccttacagaacagaacaacaataaatttaattgaaaacagtttactgatcaaagtgcagagttacaaatatgtttggttctttacaaatatatataccatgcaaacaacagggccagaagttatgtactcgatcagaccgggaaagaaaggtttttccttcaaatccttgtagtgctcctgtgcacataagagagaattagcagctcgttgattaaacataatatactcctggtgattcccttcctatgtgaaaacaaagataatactgtatgctctgacggtgagcagaaaccaggtttaaccacaaatttcgatggcatttctacaaaattttctccagctgcttggatatttaatggatcacttttcgttggctgaatacaagaaaaagtgactcgaaagaactatctcagcagtcagcaaagaatgagtactttggatgatcaaggctgtcctgaaataacataccagacagacatgctatttatcatttattcgattgtgaaatttccattcacaacaataaaactgtgatctcctcaaataagtccattcaagtcttggcaaattgcccactaccaagaaaataaactgggcatgatattttgtcatgccacgcaaccatggtatattttgaaatggcaccattgctctccaacgatgattaaatggtgagtccccagatggtggaagaaaacactttacttttgaagaaaacggtggatattaagaggcaaacctgtgccaagtccttggggcactgaaaaagctttaagcccttcaacacaaagcctttcttctcgaaacgggaaataatctcgccaacctatatgaacgaatcgacaggagtgtttatctgagctgaaagaaactataatggaactacagtattcagtaatggaatatattacgtcaaaaaaaagtaatggaatctaaagttagaaaagtaagtaaaatgatataccaggcctcgctgaacaccatcaggcttgatcataatataggattgctcaacctacagaaaaaatagatttaatcttatggttgatcaggaagagatcacctaagtggagagttctcaacttctaactgaaataacagaatattgaggtaatcagaaatgtctgacatctattatataataaaagtccattaaacttcctacaaatgctcccaaactgccacgtgtaccctacaaacgctcccaagctgccacttggcactatgataaattatagaaattcttaaaattctaaaaaaaaagacaacacccaaccgttgattttcatttaatctggtggacccgatatttttaaccattagatcaatctataaagaaaaaataatcctccaatccctatcagtattgtacctacgtggagtcgtagtaggtatacgtacgtacttggacccgtatgcctcctctcttcctcctctgttccctctcttatttcttattcctattcttatgcaatattaggtagaaagcacaataggtgagcacaattgacaattaaacaaatataacatctaaactgcttatatttaatctttcaaaaagaatgtcatgttttggttacaatttctgacttttacgtgccatttaaataattccaaaatattatgaaaaaataacgatatagattttatcatcaaacataattacacaataattaaattagaaaataaattactccccggtaagtcaaaataatataattatacgtgtcttatattatattatatactataaacgcttataaattgccacatgactctttaataaattagaaaaattcctacaaattctaagaaaaaaagaaaaatatctttagcattgattttcatttaaaatgttagaccaattaattttaaccattagatctatataaaataatataatggtgtggaccatgcgtacatcgatctaatgtaaaggatatgagaatggttatagcttcgttcgtacacttacggaagaagaaaacattatatagtagtctaaaaaatcgagattcatttttctttctgaaacttaaaaaaatactaaaagtccattatacttccaataaacattatcaagccaccacatgcatattctacaaatgctcctaaatcatcactttacgctataataaattaggtaaaatcctataaattctaaaaaaaagaaaaatatcttaccatcggttttcattcaaatcggtggacctattaattttaaccattagatatatataaattaatggtgtgggccatatacattgatctaacgcaaaggaaaagagatcggttatagcttcgttcgtacatatagagtacaagacattggatagtagtctaaaaaattgagattcatttttttttcttgaactgaaaaaaattaagactttgatcggtcacaattttgcccccatcgacattactcaggacactgtcagcgtgagggggcaaattagcttgggactacatgtatgtatcatgcatgaccgagctaaaagctttatctaccaattattttagaaacttaaaagttaaaaactatttagtatttaaactaccatggttgtataaatggctaattctttcaaacaacaaagataaaataggataagcattgtaggcttcatatttaggattatgcaatataaacataatcactaaaggcctaatgcatgttagctaagataaaatcacaaagtgattgtttgcattatgtaaaatcctaatgtttaatcataaattttagagtaaaaatatttaaatcatgacaacaatcataccacactacataataatcacacatgcggagttatttttcgcaatgaaaattatgttcctgctaagctacatggagtctcacacactctacacgaaacaataaactatctcctacgctgcaaaatcaatttagactcgagaaggctttttatttgaaatatatattgtgtcacgtggaccgaaggcatccattaataaacaatgagacaatcaagtatacagagaaaaaaaagcaagtgcatctcagcaaaggatacagtaagttgtaaaatatgtagccaatttgctacataccaaaaggaacaccaaaagtaactatcaagttcgttgattgttggcaaacaatgatatcggcacaaagatttatatataccattattttcataaccaatcaatgtgaaatgacaactttaagccacttttctaacgtttttaattgaatatacaattatgttcatcacattctaaacaaatgatttccgcgagaatattgttctcatgttcctcaaatgtgcagcctcctatgtgatgagccttttgcctcggactcatgggctacctttagaaataacttttgtaatgtgtttacatataactactttagtggagtacttaacccagaaggtagagttgaagcttttacacagtgaactattttagtggagcacttaacccgcaaaagtagtattgaatcaatctattccattggttacagaggaaaaaaaagttcattttacatcctaacgatattttattcttttaaactttttttcttctctacatacaagtcatatttcactttgacacatcaggagatgaaggtcaatgataattaaacgaatacactaaattccacgacctgcatgtaaatgcctctaaggtgtcaatacaaaatcaataagcatttcgtataacgatatgattagaaatttcctactaatttttattttaagactcatattaacttggtatttttcttaaaaatactgtaggatcctacgcataagaatcactatcttacatatgtatatttggtcaatttaaaaaggtgatagcaggttagtaaaaaatatatatttatgagcaattaaagtttctcaagatttttaaagaaaaaatacaatgaacattcaattaagaagggaaacacctcactttaatttaaacttattttgttagacatgttttcgaaacgaaataaaaacatgcccgcgcaaatgcgcgggctaccttcctagtttcataaatagacagatccacacttattctgtgaaaatagaagcgacgaactcaggttccatacttaagctaagtcaaacagcatccgtaatacctctcagatataggcatatatcgtgccatgaaaagaataagtggacataaaaaatgaaacagttctacaagttctgctgatctgcatctttgatttcagggattaaatgcgtaagattaataaaaccaacattgatgcactaacacgttactgagattagcaaacagaaaatggctttatgcttgaggggaataatgaaaaactacaagaataaatttggcatcccttcaacataactcaattttctcaactatgcataaacagatttagattgttctacagtaccccttcactgtgtatttaagacattgcaagttgcaacaactgtcatgctgcatcgcaaaatgagattgcctaaggaaacttggacctgttcaagtactggaatttgaaacacgttgttgaataattcaaacaatctcacagtagaaccacagagatcattgcatttattaacaaaaagagtaaaaaaaatgaagaccaaattttggaattctgatgggcacaaaaattctacataatgacatatatagcaaacatcttcaattgtactgcacgaactaggcagcaaattagatggttatcagagcatccaaaataattgccatgaccatttccatatgcgcatcacggtacaaaagcaactcctacttggcaatcaacacaatgtagcatgcctaagtgccatattttcatcagtactgtctgccgctgacagcagcaaggcaaaattcttactttcagttcaagttcgcttcctttttttccaataacttatgtcaataaccatagaatattccagaaacgggtactaaaattttagactgactcttctcaacaaaaaaggaaattcagactggccaaagcaacgtatgaatatgtgggacatttcagtgaattatctgttcagtttttgcaatcaatagggagccaaaaaaacgattatcttcatctgtgctcagctagtagcatgtctttttcttccccaatctatcaaaaaaaatacgactcgggccaatacaacagtagagtaaaagtctgaaaccaacatcacaaccaaaccaaattgcccctctcaacccacaaaaaaggaactaatcttttcctgcaatttggaccaaacgcgagtaggtaaaaacaaggggattaattcgagaggtgaccaaccgacgacgcgacgatgcggccggcggcggagacgcgccccctggccgccctcccgccccacgcggcgctcagcgcgacgcggccgcgggaccccggggaggcggcggcggcgaaggagacggccgccgggcgccgggacaccgcgggggaggtcgcggcgaggagggtcggggcggggcgggaggtcctcgcgagcacggccatggcgtccatcccggtagctgcttctcctccaacgtccgcgcgagcgagcgagcgaccaaagcagccgcctttttttggattagggagagcggagaagaagaagatgatgagcaggagcagagcagagcagcggccatcttgtcacatttttcaagatttgtttattctcgagttgtgaagtgccgaaaatacccctgcctctcattttcctcctgcatgggggtgaaaaaatggacctgatttgtcctcatttcgagtcgctatatacctcgttcgtttatgaaaattatattaggagtagtctttttaaggttagctgaacataaaattaataatttctatgcaatgtcgaagagtcctcgtttagtgggattgttcatattgttacaacctctagcatatggtcaatgatttgttgtcataagtttgctcgattgaatttagtactaagatgtttgaattttttcaataaaagtactttttcgagataaatctatttatattgttttatgttttcaaactaaaagttatcccgattattgataggccaagcaataaaaaataaccagatttatcatagagcacaaatatttgtgatcacagggtgtacgcacccttgtttcaaacagaaatgaatgtatacgtgcttcatacaccactatcgactccttgattgatctcgcctctaccatgtacaacatgttattagtcgttttagattgtttttcctagtcccgtttctctctggttgaaatcaataaggttaatatggtatgagtttttgatatagccgtgttctatatggttttattcatcgggagataccattcttctataaattaaggtaagatgtacaccgctcttctacactatgctggtcctcgaatcatcgctaaacggtgatgcttaccttcttggcatggtacatgtatatacatgtgatgtgatgcttattttacaagtatatgcattgatacttggagcgaagaataacatacttttcttcaatgttcacttcattagaagagaaaaaagatgcctctccatccaaatgcccaataaaccatagctgcacaatgattgactttccttacaccccttatggttgcatacttaatcaacaattgccatccaaaaaagtgtgattccacaaagaaaaattgtgagcatctatcataaatgtatatctacttcatcctagtatcatatatgtacggcaagtataataaccttagtttacatgcaaacgttatcactcaagccatatcaacctacatcctacatgaatgagaaagaagtaatcatatgttcgttgagtgtgagcgcatagccaccaagtactagctgttgtgcatgagctagtccaaagtaaaagagaaagatttgagactcggtaaaagataaaataatttttaaagaaagcattgagaaatattgttgtatatgtatatggctttcaaatttaggtgattattctttagagccaacaaaaggtcatcttattggctgttgccaatttgaaagtgagtttagcttttgcaactcgttcgtttactatgagtatgtttcctaaattattagacggtgtatttttaaaataaatttttatataaaagcttattttaaaaaaaatcaaacaaatctagcttatcgatttaatacttaattaataatatgttaaatgtttttatttcacgtgcagaaaaaagctaagtcaaattgttgccactgcttcctccacactgcccacttgtccagtggttgccgaggtgcttattcctacacctaatttatggaggtcaataacaaaattattattgtaatatacttttttttatatagtactagctcatttcacccgttgttatgtaaactctttagcccatattgtatatgtggcatctgacgaccgtccagtataaaaagcatgaggcctactggcctacttaccgtaaaaagtcaaatgatacactttgtattcaaaacacatgttaccggtgtacacatgcatagaccaaacggaacacctcattttagtaaacctagtctgacgctttctatacagcaacgcggtacctcaaggtttacgccttcaggcggatcacgcacggtggagacggacgagcgcgagaaaggaacaaaccgaacaagtggacccacccacccgtgggcccatccacttcgtccaccacaccgcatcgcacaaaccacacaacaccggttccgaccaatcacatccgtccacgtaccccccaaacatcccccggccccacacaccgaatccccccgcacagcgcgtaagccgccaccgacgcgctggcactcccacgttcaagccctcctcaccaccctcacacctcacagacaggtgggaccaacaaaaaccagacccacctgtcagtgacgcggttcggacgaatcccccgtagccgtaacacgatctccaactttcctcgtgggctccacgtggcagtggggaaagcacgggtcccgatgatatcgcccacacaccacctctctctcttctctctctccccatctctctctctcctcctcgactcaccgtctctctctctcccctcccgtctccggcgatctctccggcggcgtctccggcgaccgggccaccgccgccgccgccaaggagcgctccccctcattccccagatcggtagctgtctcgtcgccgtccccgatcctcctcctcttcctttcccccagatccacaccccccccctcgcgtactcgctcttagcctccgcggcgggaggtggtggtggtgtgggcggggggtgagctcgtgagtcagatccggtgatctgtgcgctgttgcggttgccatggacgacttccagggcctcctggcccgcgactttgggctgcgcccgcaggggaaggcggcgcccatgtcggccgcccgcgccgccgcgtcctccggatccgcctggtccaactccagatccgcatcggcgtcctccgccgccgccgccaccgccccgcccgcgcccttgtacgatgacctcttcggggccgcggcgccctccgccccgccgcccaaggccgcgccctcgccctccctcgacgccatctttgactccttcaaggagccctccgccccggatgccccacccaagccgaagcactcgtccatgccggtgtttgacaagccggtctacgatgacgacatcttcgatggggttcccggggtgaagagcagctcctcggcgcggtttgacgatgtattcggtggcagccacgcgccgccgccacctgcgtacgatgatctgcttgggggatttgggagcaagccggaggtgaaggaggtgctgccggaggagaagaggaagcctgagccggccgcttcatcggctgggtttgatgatttgatcccagggtttggcgggaggatcccgatgcgtgccaggtgagcacacctttttgcatgggaatttcgggcattatgttgtctacatgtgcaatctaggagtaaatttagtagtagtttggatcaagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69350 - DNA, 865 bp, Oryza sativa
cggtcggtgaagacatagacgcccaacaacggcggcataaaggccagccgtgcaggcggaaacactagtcagcagcggcgaaggcaagccggtcggtgaagacgtagacacccaacaacggcggcataatagaccagccgtgcaggcggaaacaccagtcggcggcggcgaaggcaagtcggtcggtgaagacgtagacgcccaacaacggcggcataataggccagccgtgcaggcggaaacaccagtcggcggcggcgaaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcggccggtcggtgaagacgtagacgcccaacaacggcggcataaaggccagccgtgcaggcggaaacaccagtcggcggcggcgaaggcggccggtcggtgaagacgtagacgcccaacaacggcggcataaaggccagccgtgcaggcggaaacaccagtcggcggcggacgaggcggccggtcggtgaagacgtagacgcccaacaacggcggcataaaggccagccgtgcaggcggaaacaccagtcggcggcggcgaaggcaagccggtcggtgaagacatagacgcccaacaacggcggcataaaggccagccgtgcaggcggaagcaccagtctgcggcggacgaggcggccggtcggtgaagacatatactcccaacaacggcggcataaaagccaaccgtgcaggcggaaacacca

SEQ ID NO: 69351 - DNA, 14663 bp, Oryza sativa
  unsure (1)..(14663): unsure at all n locations
tgactcgtgggttgatgaatggatttcttcagcttgacataaaatttgtcaaattttgagccttgtatttgtgtagcccccgactctttgattagttgggaaacaactgaacatagagtcgagaactgtagcatcttgtcgtcgaatagttattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtaacaaaacttgtgaagtagcagcaatagagtttgctggtaccgaagataataaagatgaagtcgctccaccatgttgacaaagttgtgttgccgtgatgaagtgaacacgagtcggcggcaacagaagcaaactggtagcgaagacgcgcagttgtgaagataaaagcactagttggcggcggcataaccagtcggcaacggaagacgatgatgtccatcagtagtggtagctgtataaaccagacgtagaggtgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactaatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgtgcaggcggaagcaccagtcggcggcagacgaggcggccggtcggtgaagacgtagacgcccaacaacagcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggacgaggcggccggtcggtgaagacgtagacgcccaacaacggcagcataaaggccagccgtgcaggcggaaacactagtaggcagcggcgaaggcaagccggtcggtgaagacatagacgcccaacaacggcggcataatacgccagccgtgcaggcggaagcaccagtcggcggcggacgaaggcggccggtcggtgaagacgtagacacccaacaacggcggcataaaggccagccgtgcaggcggaaacaccagtcggcagcggcgaaggcaagccggtcggtgaagacgtagacgcccaacaacggcggcataataggccagccgtgcaggcggaaacaccagtcggcggcggcgaaggcggccggtcggtgaagacgtagacgcccatgaacggtggtgtgaccaaccaaccgtataggcgagggcaccagtcggcggtgacggaggcaggctcagggtgaagtcgtagacgtccaacaacggtggcataataggccagctgtgtaggcagagacaccagtcggcggcggtgaaggtaagccggtgatgatgatggccaccaatattgacagggtagtccagcccgttttgtatcctagattaaaggttgtctgtcgtgttccagtccgagttgaagagaaacttgacaaagtcgtcggcgacatatatggcccagactctcgtagcaaaaatcatatgcatgtgcagatcttctgttggtatgtgtttatgcatacaggtacatagttgttccaggcacgtacaaacgcatgcgatgaccagtaattgctggataagtttgagcattgatatagctcgcgtgtgcccgcagccatacgtcttcattaaaaaatactcgagctgaccaagtgaaaattgctgcttgtatgtactgctccgtgtttttgattttccatgttgagtcagccgagtccgagattgatccaatcagctgtcttatgcaactagccagccgtggtatcggtgacgatgacggtttgaagcttccaacttgatgacacagatctttgatcgccgttctctcgactggttaaaacccaagtcggagaaagagagattgttgaagtcgtcggcagcgaggaagtgaaaactcacgaatcgaagacgaagccgacgaatcatgaaattgattccatcacacttgttgacaggaaactcggcgaacccctaccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgttgccgccgactggtgcctccgcctacacggctggcctattatgccgccgctgttgggcgtctacgacttcaccgccggcctgcctccgttgccgccgactggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgttgccgccgagtggtgcctccgcctacacggctggcctattatgccgccgctgttgggcgtctacgacttcatcgccggcctgcctccgtcgccgccgactggtgtcctcgcctatacggttggttggtcacaccaccgttcatgggcgtccacgtcttcgccgaccggctggcctctgccgccactgactggtgtttttgcctatacggttggcggactccgccgctgttaatgggcttcatcatctacaccactggcttggttccactggcgccgactggtgttttttgtcaccattgatggactgctttattcccacatcggctacttctgctgtcatcgagggaatacgacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacacaatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccaaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctattatgccgccgttgttgggcgtctacgtcttcaccgaccggcttgccttcgccgctgccgactggtgtttccgcctgcacggctggcctttatgtcgccgttgttgggcgtctacgtcttcaccgaccggccgcctcgtccgccgccgactggtgcttccgcctgcacggctggcctattatgccaccgttgatgggcgtctgcgtcttcaccgaccggccgcctcatccgccgccgactggtgtcaccgcctacacggctggcctattatgccgctgttgttgggcacctacatcttcatcgccggtcgtctcgtctgctgctgactagtgcgcttacctctacgtctggttatacagctaccactactgatggacatcatcgtcttccgtcgccgactggttatgccgccgccgactggtgcttttatcttcacaactgcgcgtcttcaccaccggatttctacttggacatcttcaacacatatcttcaatcaagcaatgactattcgatgacaagaagctacagttctcgactctatgtttagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttggacgagttagacaacaacatcaactctcctccaagtgaagcatctacaatagccataacattaatttgatggattattgtcactgacatcatcaccagcacctctgcttcatcggccctgacatctccgctgttgctaatggatgattatgttttcgccgacttattatttcaccttgacggttgacctactatgcaaatgctgatgagcgtcttcgtcattatcattggttgcgacactgctattgactggatcaccgacatcgtcatcttcatcatgtcagttgcatttgtcgtcgccaactattttcttcatctccatgattggtggattttgtcatcgcctttgatttgcctcgtctgtcaccgactgattatttcgctgccatggctacacaactttatcgctgggcgctttcatcttcattgatggctgacctgactactgccgactggtttcttcgcctccacggctgtgcaacttcatcacttttgattggtatcattatcttcactaccaccaatatttttgccacctctggtgggcaatattatctctatgttggtcgtcttgtctttatgccaactgcgtcagctaccatcaatggacaattttgactatgacaaaaggacaagctatatgctcaggggctcatcaactcaagcgtgaggattatatctccaatttggacttgttccagatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttacacggattttataccacatatgccatatattttcaggtgtggtggaaccatgtgtcttttagggacttaagcacatctgttaaagcagtgtgcgcatggcgtatgcccaatactttggaaatttctttattcacaacatacaagcttctttatagctattttgctatgtgaattttcaatgatgtagccaactttaggttacactcatcatattttacaaagcagtcggtatatcacttggatcatattattcgaggattcacaccgcatatgctatatattggtatcaagtcacttggttgactacgattatcaaaaccactcgtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggtggattcaaatccccaaacaggagtagggtattacctctctttggagtagggtattacctctctttgagagggcctgaacctgtctaaatcttttgtctctgctgtttagatatcttgtcagttgcaggatcaaactgactggcacgcacgcttctcaacaaactttggacctgcactaaagctaagcagatctcccaggccaggcccgtgtgtgtaacaaactttggacctgcactaaagctaagcacgcccgcttctcaacaaactttggacctgcactaaagctaagtagattctcaacaaactttggacctgcactaaagctaagcagatctcccaggccaggcccgtgcgtgtaacaaactttggacctgcactaaagctaagcacgcccgcttctcaacaaactttggacctgcactaaagctaagtagatctcccaggccaggcccgtgcgtgtttttcgcatcaacatgtgacagcccagcccagggtccagaaacggcattggtcccatctcatttagttagaccacacctaacactgcaactcactgggtttttcgtcctcgctttaacgcaaaaattccagaatcggagttgtagtgactgggctgctcatccttataagctgctccctctcttctcaaattggcgaggtgggaactaaagctagctagctgtgacttgcttgctcgctagctgatgctgctgcacttgggccaaaggcccagctactgcttgggctgccggcctgctgctgctagctagcctttttttgtttcttttttcttttttcttttttttagggtgttacacaacaccatcatcaatcccatttaaattggactagggctattacctgataaggggcctgcaccagtataatccttgtcttctgtttcccaattctctaatcatctagtctacaagtatcactcgtcgataatttgattcatttttaaatatatacttttatgtatatatatagttttatggagagccgagggtggagaatagacacagtatgtggtctcttatcaactcaattagacaattctctaatctgccgtggctcgttttgggggacttcaacgaggccttgtggcagtttgaacacttttcagtgagacaaaggaatgaaacacaaatgcaatcctttcgggatgttctgcaaacgtgtgatttacatgccttgggtttttccggagtgccctatacatatgacaacagaagagagggaaggaacaacatcagagttcgtctggacagggctcttgcagataatgactggagggagatgtttggtaatgccagggtgtctcacttaacttcgactcggtcagatcattgcccaatatctgtttgtttctctcctgaggattgtcggccgtttcacacaaaatgtttgcattatgaaatatgctgggaaagggaaccatccctacaggaggtaatcactgatgcctggtcagagggtgtttcaaagtcagatctcggtgaaattagtactgccctccatagagtgatgacaaggttgcattcctggagtaaggtgaaggtcaagaatgttgggaaggaactagagaaagcaaggaagaggcttacttctctccttgtttctgatgcagagagcagtctggttcgtcaggcattggatcatttaaatgaacttctctatcgtgaagaaatgttatggctgcaaagatcacgtatcaactggctaaaggagggagaccgtaacacacgtttctttcacagcaaaggagtatggagagcgaaaaagaacaaaatttctgcactccgggatgccagtggcactgttcaccatttgacaaatgtgatggagcaaatggcaacagactattttaaaaccctgttttctgccgacccaaatttggaccactctagagttacaaccttaatccaagagaaggttacggctgagatgaatgaagctctttgcaaggctttctctgatgaagagatatcccatgccgttttctagattgggccgcttaaggcgcccgggccagatggatttccagcacgtttcttccagcggaattggggtcttttaaaggaggaggtagtgaaggcggtgaaggaatttttcaatacgggggtgatgcctgcgggtgtaaatgaaactgctattgttctcatcccgaaagttgatcagccaatagagctgcgggattataggcccatcagtctgtgcaacgtactgtataaagtggtctctaaatgtttggttaacagacttcgaccgattttagatgaacttatctccccaaatcaaagtgctttcgtccctgggagaatgattacagataatgcgctcattgcctttgagtgctttcattcaattcaaaagaataagaagttgtcatcagctacttgtgcttataaattggatctgtcaaaagcctatgatagggtcgattggaagtttttggagcaatcaatgtacaagctgggtttcgctcattgttgggttaattggataatgtcgtgtataacctcggtgagatattcggttaaatttaatgggaccctgcttagcacatttgctccttcaaggggtttgcgccaaggtgaccccttatctcccttcctcttcctatttgtggtagacggactttcgctgttgcttgaggagagggtagcccaaggagccttgtccccggttcacatctgtcgtcgggctcctggtatatccaacctgctcttcactgatgatacccttctctttttcaaagcaactagtgagcaagcaaatgtagtgatgaatgttctagcagactatgcctggtgcactggtcaactgattaaccaggagaaatgctctattatgtttggtgaagcttctcctcccgatgtccaggaatctgttagaagtgttctgcaagtggggagcaccagctttgatgacaagtatctgggttttccaacgccggaaggaaggatgaataaaggcaaatttcaaagcttacaagagaagctgtgcaaaagaatcatgcagtggggtgagaattttctgtccagcggagggaaggaaattttgattaaggctgttttgcaggccataactgtttatgttatggggatttttaaactcccagattcgatctgtgatgagctaactaagctcacccgtaacttctggtggggatctgaaaaggggaagaggaaagcacattggaaatcttgggactgtatcaccaaaccaaaacattgtggtggcttgggttttagggactttagactgtttaaccaagcgctgttggcaagacaggcctggagactaatagaaaatcctcacagcttgtgtgtgcaagttttgaaagctaaatattatccgaatggcagtctgatagacacttctttcggtggaaacgcttcctcgggttggagagcgattgaatatggtttggagctgttgaaaaagggtctcatctagcgagtgggaaatggcaggtcaatcaaaatctggcgagacccatggttgcccagggatttttcacgaagacctattactccaaaaggaaattgtaggttaaaatgggtggctgatttgctagaccaaaatgggagctgggatagggatgtcatctctcagcttttctggcctttggatggtgaaataatcaaatcaataaggctctccagtcggcaggacgaggattttatcgcttggtatcctgataaaatgggtcagttttcgattagaagtgcttatatgttagctgttcagctcgcaaatgctggggagagctctagctcctcaggaaatgatactaagaaagtgtggaatcatgtctggaagtgtaatatcccccaaaaggtcaaagtgttctcatggagagctatctcaaactgtcttcccactatggtgaataaaaagaaacgaaacccggaattgtcggacgtctgcagtttctgcggcctggagcctgaagatgtggcccatgctttgtggcgttgtccgcatgccaggcgatactgggacctaatgagctctgagatgcaagtacaacgtatcctgtatgggtctggggagggttctgattggatccttgactttctggaatcaatttcagaggatgatcgtcctgtctttcttatgtcactgtggcgaatctggtatacacgaaatgagattactcacgataaagcggcgccacctgtggaagtttctaaacgctttgttcggagttatgtaaactctctgaaggaaattaaagctcggccgaatgcaaacttgggatctgggaagcatgtaattggggaagacaggcccaagtgcaagaagcaatctgtcttggcaaaatgggagaaacctccaagtggatggatgaagctgaatgtcgatggctcctatcaggaggataacataggggaaatcagtgctatcctgcggaacagcactggagatgtaatttttgcagcctgtggctttgttgagcagtgccagagtgcgctggaagcagaaattttggcttgcaaggaaggtatcggactggctctccaatggacccttctaccgattatcattgaatctgactgtgcggaggcgttacagctgattctttctgaagggaagctgcgatcggtgaataagtttttagtcagggagatccaaggcatggtgaagggggctagggagatgaaactgaagaaggtgaacaggaactgtaatcacatcagccatgttttagctaataaaggcaggtgtgagtcccttatggacttttggccggacggaagttgtaactttatttccgaagttatgtctatggacagctatggctaagtaataaagttcctgtttttccccgcaaaaaaaaaacactaagtccctatttatatctcaccctaaaatttttcaccctgtcacatcgaacgtttgaacacatgtacgaagtattaaatataggctaaaaaataactaattgcacagattgcgactaatttgctagacgaatcttttaagcctaattgctacgtgatttgacaaagtgatgctacagtaaacattttttaatgacggattaaataggcttaataaattcgtctcgcgggttactgacggattctgtaattagtttttttattagtgcccgaacaccccatgcggcacattatataatacctaatgtgacacgccgaaacattacacccctagatctaaacaccacctaaatgtgacacattctagtacaatgaatctagacagagatatattcaaattcttgtagtaataagatatgtcatatcgttttgttaagacggagagagtacacagtacaattgcgttttttcattgaaaaattaccaacttgttgcttgaagatgcagctacaaactactcccgctgtcccacaaatattcaaaccctagattccgaaggtagaaagaaggagaaggacaatggacaaaaatgtccctatttaatagataagttatgttggtggataggtagttgaggggtattgaaagaataaaatttcttgatttataagtcgatggtagataagaatataggagttgatttattttgggacaaattcaaaatctagaagttgatttattttaagatggagggagtactatacaacaaagtaaacactagcataagaacaattaatgatatagaatctctaagagacttgggagttgggagttaggacagataggtttagggtctattcactgcaactagctgtagccgctacagtgactacattgtttttacacactgttactgttggtgtagttgcagttgctgctgcagcaagctgcacgaacagggccttacacgtgacaaacaggtttggtgacgatccaatcatccaatggaagaatcgttccgtagaattgttaaccgttttaaaatcccttgtcgatcgccacaaaattaaggacgagccagccaagttggctaggatatgcacatacaacttcagttcaatttgggtggtggctactatacggaatcgctaactttcatttaatagaactttcaggtactacaataaatccatcaatctcaagtccacaattaatgtcacgactttatttcttggagtttgaaatcaactatacataaaatactcctagaaagaaaaacataaatacaatgtaatatgtttacttcctacatcctaaaatcaatattttagttacctagtaacctagggcacacgagagtactatcgaaattcgtaatactagtttaatagtatagccaactattagctccaaatcatctatagtaatttaatagcaaattcatacaatagttgtttattatactattaatacatggtcctacttgtcatacacacattacgtcttagagtctgtagccagctgcttttctctcttatcttttatctctttaaaatatttttatagccaactaatagtctgctattgtatctgctcttagttgtattttgggcacttgtattttagaatggaggggtagtatcttatttagtgtccaaactagctagactgataggctagatattaatttgaaaaaactttgtgtacagtaggtcaattttttttttcattctcagtgtattattttccaggttgtctatcaacaactacaacgctgagcttgtgaggttagggcatccacaatgtatcactaaagtgggcattatgcaataaatgcagctctaaggacaggcaatatacattgtggaggtagtccatatggcattaattgctaaagcagtctttagctatatgggctggccacaaggaaataaaatacaatactttttcagttcactgtgtacaaatgaatataaaatctaaagcagttggtgctggtgcgtgagcagccgagcaggtgtccgttgaagtagccattgctgctgggtgttggctctccttctccatgctcctataaaacagaccaacaagagatttcagtttgtatctcttcatttcatcaggagatggattcatccaaccaaaaattcatagatcttctcagtcaagactctccaaaccatgcagaaaagcctagccacaactcccctccccaacaattccccaataattttccccaatctcagtttacccaaagcttcaacccacattttttacacaatttctatccatttcattccccaagcaactatccaccatatggtcattctcctcccagctttcaaggtactcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69352 - DNA, 23736 bp, Oryza sativa
  unsure (1)..(23736): unsure at all n locations
ttgcacccctccatcaaacaagaggtctttgttgctctgaaccgttcactacccgttcctgcaggtcagaagttgatctcttcaacctgtttctgctatctcactgtacatatctgacaaagctgagatgataacttgatattcttaacaggcaaagaagggatgttagaggatggatcagagtgaaagctagcgaggaaaggaacatgctgcatctgctgtgacaggcaaattgactcgcttctttacaggtactctttcagaaactaacagtagaatgatcaatgatgttattcatgactgacaaattaaatgaacaccttgttgtacttgcatacgatgatcagatgtgggcatatgtgcacctgctcaaagtgcgcgagcgagctgctccacggggtgggcaaatgcccactgtgccgtgcgcctatcgtcgaggtagtccgagcttactgcataatgtgacacacagttacttcaggcctaatcataatatagaagaagagaagatgatgaagatgatgagtactagctttgtcggactgaagcctttttgagttttggatgctggagttgtactactttactacattagtaggggtttaatttaggagatgctactacgagtaattgtgaaactttcacaaatagtatgttttaataattctagtgcctgacagagcatccatgctaatgtaatgtgctcttgtaggagtaataacttgtaatccattagccttgcaaactcattaatgaaataagtgacccttgagatcgatcattagcagtattcatcacttctccgttgtagtaccatattcatcagggttctgacttgctttacttttggatctgcgttagatttctttttttttttaagaagggtatgttttacctggcctctacatctaacggatatatgcagcctttttaaattctcttatgtgaagatttaaactcaagaccgagatgctatttaggtcactgcatgtttactgcgttggatatatattagttatatctacaccttattaatttgagctgatggttgctaacagaataatggcctattattatgtactatactactactacataatgaaataagtgatccttgaatccatcattagcagtccatcacttctctgctataccatcatcacttattcatcctcacttattcatcagcgacaattggtggccttcctccagggttaactacctgggcatctccgagccggtttcaactccttgatgctcctggtctctgggcagctgtggaaaaaatggaactccagggttctctcttctgtctatgtggtcttggagtctattctttcggatggtcatatgtggtccttaaacggggttgccgcttctagggttttcttgagagtgtagcatggctctacccctttccgctgttaggagttgctttttagccgctgcagtacttccgaagctttagtttaagttttttccctttcccttggcataagccggtctggctgattgctttaggtaacgaaaattctttttcttctaatatattggcgtgtaatccttttgtgcgtttgtgaaaaaaaattgttctttttcttgtgaaataaggttgattgatatattgattagtaattaattaattagttatggatatatcataagttgccgataatgccgggattcacctgatccctgggctgtgggccaagctagagaagagacttgtacttactgcgcaagacgaggcgattggcgaggcagatgcagttgcagttgagaattgagatgatgcaaggcctctcacgctgccgacgccctgccaattgccaaagtcggcggcttcttcttcttcatcagctctcctctgccttcatcgccactccaatttccgcttccccggtctcttttcgctgcctgcctgcctccctcctttatttccttggtcttcagtgttcttcttacttgcttcccaaattcgtgccttgatctatgggggtgaactacttttggatctggatatatggcatgtttagtgtttactacgttggatatataatactagtgtataattatgttttttgttgtgatagatttgcttttataccctgctccagtaacagcgtgcaacgctactcggcaactaaaactgacaagaacaagagcagcgatctgatcattcagcctcaaattaacgacgttacagaggagagcaaccagaggcctaccgatagcagtgagatcaaccctactgttggtgtttttggggaacattatttgttctggactcaacacatttgtcagcttagcagccaccgtgaggcaccatatacaacaaccagctttattggaaaaataattatgatatcgatgtcactaaccgtgaagagagtaagtgatattattattttaacctcgctcttctcttatgctatagtgtattatacttcctccgtcccataatataagggatnnngactntttcttgcnctgtttgaccacttgtcttattcaaaaaattttgaattattatttattttatttgtgaattactttattatctaaagtactttaagcacaacttttcgttttttatatttgcacaaattttttgaataagacgagtggtaaaacagtgcaagcaaatagtcaaaatcccttatattatgggacggagggagtatgtattttcttcttaattgccacatttaccaagcctatatatgtgatttacaaacctgatcttaaggtaagttgcatcatttttgttccattatttttactggattacatgccatatgctcggcccaacgaagccacatgtacaagaaaaaaaaaactcttaacaagaacaagtcagttttccatgcatacatagggtcattagacaattttgcttacatagtgatcttctttgctgaagctccggtggagccaatgaggtactcagtggccacacgatgcaatcctgatctggaaaactgtctatgcatgacatgtcaaatggtgcagattttctcattgaagttggctcacactagtataaatagtggtccaacacagttatatggatatattgcagcacgggatcatgtcgactcaatgcttaattatgttttcaatcgcagcagagatgatcccatcgccgtgaaccaggtatatacatccatacttatctgcaatcattttggattacgttctgaattctgaatgtgttgtaacaaatatacctttgatttcagtttgttcatagagctattccttaataatatacatactgttcaattttacagggttctcttatcgaaatgactggccctaagagaggcattgcactgatccccgaatgtctgtttgagtttgacatgagaatcaaaactggggagaaagaagaagatgatctacagctgatcgacggaatgatagagttggacgaaatgagaatgcccgagacgccgtacacaactcgcatcaatggcgattctggctccgtcgacctgtgtttagcgaatgtttctaacggagtagaggcaacggtggaagttgtcatatcggaactgatggtgaatggttttgatctatcgatcagctgtgttgtttcaagttcaaggtacgaatacgatgaaagtaaagagtttcagatattcggtggcagtattggtgaggcgtgtggcctaagaaggtttgtgttggctgtctacttggacactgatgcagctgaagttgaaggtagatcagaaagggtccaatggtgttgagcattgctgctccttttcatgtaagctgcatggatgcgccagcgaagatgtaaagcttgaggaggtggcttctatctcggtgaaggtgacctggtcggctttgattgaatgaactcccttgtgttactgttttcatttgttgcatttcagttttggttgcctgcagtctgtacccctaaggggatttaatttggatgatgctattaccattttgtgagggagaccacccgtgtttaattcttgtactattacctgacactgacagagcatattcctacatgatagtagagtagtacatggtaatgtgggatgcaggtcctctgcagtactgcatgtgcagtactgctcactgacatgtgggccccacagcatctcggtcccacatgttagtgagtagtactgcagaggatctcaattgggtaatgtggtatgtggtcttgtaggcaggatcgaacaactttgaatccagtaagtaggctcgcaattaatgaaaaaaaagtgatccgagatggagggatggatggatggatcattagcagtatgtgcgttttgtgtacttgtagcactcctgtgtgtcaatttaattcgattcctttttttttagaaacacagtacaaacgcaggcactcacaatgtgcgcacactcacacctatgaacgtacacataaataagatagcattatgagatggaaaagtgtatatgcaaggaatgtttggaatcaagtatagtagtccgtagatagatgtgtagtgtagcaattagtagtaagttgatcctacatggctacatgaataaaagagtgagagaagtcgtactagaagaggatgataccagaatgcgaggagcatggggattgctcttcgatctaagtggatatggtcgcatcgcacttcctaggagaagccttggcaaggcctttccatcccatgttctccgaaagaacagagtttcgtagctgcatctatggcttgccagatcggtgatggcacgacggctcttttctaggaagaccggtggctagatggatcctgtatccgctcactagcgccggcactctatgatcacgttcccaagcgaacccgacgacgaagaacggtagcagaggggctactcagcaggacttggatccacgatatacgaggaaccctcgaattgcaggccatcgtagagtatctcaatctctggtcgttgttgcggaagatagagctctcagatcggcggaatcaatttatctggaagggggagagttcgggcctctactcctatcactctgcctaccaagcattgttcctcggtcgaatcccattccaatctacgctgatttggaaatcactggggccgctgcgatgccgctactttatttggctagtcgcactcaaccgctgctggacggcagactggttaagcatcagaggcttgcctcaccccagcatgtgtgtcttatgcgatcagcatgaggaaagcatcaatcacattttggtcgcatgcccagaatcaagataactctggtggctattgctttcggccatcagtcacccggaatgcttacccgtcaatgaaatctcattccattcctggttgtgtgacaagagggaaaccttctccagctctcaacggcgcgggttcgataccattactacactaacagcatggataatttggaaggaacggaataacagggtgttcaaccaaaagcagagaaactggacagaagtggcaagggcaatggcggaagaggcagcgctgtggcggctcgccaatactgccatgccggccatgcctttagggcacttaggtcgcaacattgtgccgcgagattagggtttaatgttcttgggtgacttcctgtaatcacgtctccttctgtttttctctttcacctgtacagacttttactcctcttaatacaaagatgcgctccttgcatattccgaaaaaaaaatgataccagaatactatactaagtactagaagctggaagggtagggtgatggcagtagcaagcaagaatccaagtgcggagatcggcggagtacagctgcatcgccgtcgccggcgcccggccggaatggaatactatactaagtactagaagctggaagggtagggtgatggcagtagcaagcaagaatccaagtgcggagattggcggagtacagctgcatcgtcgtcgccggtgcccggccggaatgggatagatcagcagtggggccgaggctgagcacagagatgggccatgggcttcaaatggagtggaggcccaagtgtgccttccttcctcaatcaagcacaaaagacattcagcagtagcaccttacctcaccgagaaatttaggcaatcaagcacaaaagggcatgcagcaatagcacctcacctcaccgagaaatttaggggagggagggccgccaccgccgccgccgcgccggtctcccacaggccgcgctggtctcccacaggacaggacagggcgccgtcctcttcgatctgtgctagccgccgcaatatatcctgtatgtgcatctccctatctagattagattagctcctttcttattttgtccggccttactcctcatcctctttaatctttctcttcaacgttgattactcttgtctctagtctctcttatgtataactacaagtatattctcttatgtataactacaagtatatccatttcagtttagttcagttcaaacacatttggctactcaagtcactccatccatcccttttcttttctcttcctattaaataatttgatgccctgccccctacggccctacctgccatcggcccatcgcacatatcgcaccactgattacattttcactcctcaaatttacacccttgtttacacccgtatcgtatatccatctgccctctaattctgcccaaatgttgatttatattccacctattttttcttcctttttcgaaaatacataattagtgccttgatagtattataaatgcctcataatctatctgtcgaggcagtgacagacgtatgatgttatagatgggtgtacgataaactaatttgtttataaaacaataaaatatttaattgttatacaatattatttctaaagaaatgtaaaaaaatccaatacatcataaaaaccagattagaaataaactaaatcttatttttatttgtagatctcattgtaatgcataggcatgtaactagtaaatagtgaatatcacaactcacttgaacaatatatatagtgcattatgatcattagattcataacaagtgttgatcactagtttatccaaaaaaaattatatgactatatcgtttaatattattaacctttatagcattctagattatatttagcaaaaatatctttctcttaaaaaaactagccaggtaccttttataaatacaatatcattaacaaagataatagttattattcctcatgtaaaaacataggtaatatatattacggagcacacacacatgagctagctgcttagtattcttgtgcaagtaatagtgttgtgttgtatgtagcaatattattataaaaaataaataagaatgagaaaaaaagaagaagatggaacaacagaagaatataagtttaaagtttttagtttcacaccattcactgcaaagaacaattttaataatattagtatattatcgattaatgtgactatataccataccatggatgtgagcaaccaccctcatgtgtttgggctagtgactaacctactctttttcttacttctttcgaagttctctgaacgtatttaggtaaaagatgttttattttggataaaaaagaaacaatttaactagattatttttagagagaatccatcgtgtgccgctgactttgttcttgttctataatatgccattgagtttattaagttctacagcatgtcattgtattttgcttaaattctataatataccatcgccatccatttagattccgttagtactgtataattttgtcctaatgattgaaatatccctaggacaaaaatttccaaaatttggccgaaaattccgaaatatcatattataaactaggtagagaagttgcccatctcaaactctttaagttttacaatctgtgtgataaaattgtacaatgctaacggaggctaactagacgacgatggtatactatagaagttaagcaaaatacgatgccatattagaacttgacaaacccaatgacatattgtagagtaaggacaaaatcagtgactcacagtggattgtctctgttttttatggttgttcagttaactacctatctactatgaagctgcatttttagaaaaagttaaatcttatactataagtccatatcttacacattaaattacatacacttataatataattttcaaattataaaatgccctattctcattttataggagaactatggaaaaatgatgtattatctatttaattatgagaaatatattagtccaaatcaacatatatgtagaaaataaaaaacaatatgaaagaattacggaaatacgtactaatgtagttatcatatataatacaatgagaaaagaagaccatagtcaaatgctttattattgagcaaaaatgatggtattatttttatcatcttttagaggaatctatctaaatatagttaatcagcccgtgttagtagaagcatgtatcgtcatgcatcaacatatcatgagattattagttatagctaagtacaccggcgtaatcatacttagcatatcacgagactatcgggtaatggacaattatctttaattgtgctagagaaaaaatatcatacttagcatatcacgagactatcaggtaatggacaattatctttaattgtgctagaaaaaaaaagtactcccttcgtcccataaaaaaccaacttaggactggatgtgacacatcctagtaaaacgaatctagacatgcatatgttcagatttgttgtactagaatgtgccacaccagttctacattcgtttttttggaacaaaaggagtaaattacaatccatactatgtattctaaaaaattcttacaaattttcatataatgttgtcctttaaccattttcatttacacaatagctaactttacattttaatttggaccaccatattttatccatctccaagtccggtgactcagtaatcacgtcgcacattaactctctctctctctctccattttcttctttcatctgacagttggataaccgatagatctagcaagaaagagcccggatatagcgccttcgctcttcgtcgggtcagctcctgccttccaaagtccctgcaagcccgacatctccgacctcaattgcaatcataacaatagtgtgcatcatgataggggaggagaaaaagacttgtcggttactagaggttaaggctgcgcatgtaaggcaaaggggaggaacgatggtagctcatggagaaagagcggtgatggcggtgcgtagagtgacagttagcagttgcaggtggtatgaggaatttgtcgtcgacacaatcttttaatttttttcctaagtattgatgatgcgtgggtcaccagttatataaagaaatagcttttaaaatattagcttgccctaaaataagtgtcaaaacttttgaccgtccgtctttgaaaagtttatgaaaaaattaaaataaattagtcacacgtaaaatattattcatgttttatcatctaataacaataaaaatactaatcataaaaaattttaaataaaaaaaagttaaacgccggatgtaaaccgtaataaaaaactacacttaatttgggacggagggagcggtaaataaaaatatggagataagggcggagtatcgctacttgagataaagaaaaagaaagagaaaattcgatctatagcacagaaaacaagcaggtaccaaaaaatagcacataaagtttacactttcgattagaagcacatgtcatctatttttcttcgatccgtagcacttccgtcacattttgagcaaacggtgttagttctagcgtaaagaaatttcatgtcggactaatttgcccagctcatctccttccttctcatccccatctccactcactccccaaacccaatttcctccccgtcacgagcaaggcgcgagcccggccgcgagcgtcgagcaagcagcgctccaccatcgtctcccctccgcccgccgtgtctcgatcccctctgctcgtcgcatgccgctgtaccaaacaaaccaccatctgtcaccgtctcttctcctccccgcttcaccaatcaatccaaaccctagagcaataccccttgctggaatcgctcgcaccctagagctccagttcccaccccagccacggcggatcaggggcagtctggtctgctgccgcagcgatatcgtgcgccccggatttgagagttccaatgccgatttcgtacgtggtcgtggtccctgggtggattattggacagtgagattcttctctactgactttgatttgttttctttgattttgcttcccggatgatgttggatgtggttcgtgttcaggaacctttgcgccaaggcttcggttttgcgtggttcttggatccggttagagtaggttgtggtttgtgtcggccgtcacgccatccgtcctcatggtcgcgcaaaccagcagcagttgttgtcatttttccgctgagtgtgatgcctcttctcacggccaaaccagtcacgaatgctatacagatagaaccaagggcaaatcggtctttctccgtacgaactcacggctaaacacttgatctgagcagcagcagtgacggaagtgctaccgatcgaagaaaaacaagtggccaatgcttctagtcgaaagcgggaagtttccatgctattttttggttaccgacttgttttctatgctatagatcgaattttctcaaaaagaaacctctcgttgtctcctccgctccttgcctccttgcgccgccgccaagacgagtggcggctgaacaagggagggccgggcggcgatctccatcgcagcggaggggaggggatcctggtgcgtcttctttctgattcatctctctctctctctcccaccccaccgggactggaatttgcgggattgcgttcgtaaaccctactagcttctcttctagatcttctcctcctccttaatttgatagccttaaacctctcttaaataaataattcaagtaataacagtttgtttgttcacccaaaagtttgggggttcaactgaacccccatgtcccaagttggatccgcccctgtgtcgaggtcttggtggtggtgggtaccatttcagaatcaaacctcatttcccatgcataaaatagtatgtatagtgtgtttacttaattttaggagagaaatagaatgctccattcacacatactagcactcattttgtcatcagtaatggagatgtcatcactactactccccatgccatgcaaaataaatatccatattaccgtttcattgcccacattatgatctttaattcggaaataataaggcattgcagcgagaaatccatggcatggggaggtctcttcttgagcttcagccgtccctcacaggaccaacagaagtcatgcctttcagctgctggtggtttcaactatgatgcgcctctccatggtgcctcaagaccaaaatcagtagctaaattgactgcgggagatactgaagcaagtgacaaagcgcttgtcgagcgcggcttcttcgtgaaccgttcacgtgttctggttggctctggcactaccaccttcaaccatgccaaatccgcgcttctctcctggaagtaaagcccaagaactacaaattttgttatgttgttcatctggtctccataaccaagcaaactggtgtatatctaggcatttggcactaggctgggcaaatgtggaacccgacacaccggtgaaggctggaacaaggttctgcatttgttacaaggagctgatcccttgggtcatgttgcccctccagattgcctatgtgaccgatggcaatggaggcaactcctcaggccatggaaaaggctgcgtttttgcttatggtagcggcactctacaaggccatctgctggtacgcctgcctcctaatctcatcaagtaacaatgaaacattgtagtactcactactcagtaatgtaaaatgttcagaatgcagtgcagagttgcaggtgtttttttactgaatgagttggatgatcatattttgatggtttgcaggcaggggaggagaggttctcggtgcagctggacgaagacgatcaggtgtggtacgaggtgatgtccttctcgaagccagcacacatcctgtccagcctctgctacccgtacgtgcagctgaggcagaagcatttcgcgcatcagtcagggcaggcactgctcaggcatgttgccagccgctccagggacacacggtgatcgacttcgtctgcagatttgatcttttcttcaggagtagtcttcgcatgttgtgagtgagcctgcttgtatgttcctgtatctatgtccgaatctgctcctgagagcattattagtttgtagtttgaatttttgagctcagggtaattatttagcatttgtgctttgttgttaagttttagatcaaattgaggtgttatggtgatgtaaattcagatttccatggtttgttactaaatcaaaaggaagaatgaaagataagcacaagaggaaccccacagttccacggaacaggtagaagagacgtcttgcaccaggcaaacgccccttgtttatagtgatgagagtatggattatctgtttgtcccctttaccatggtagtagagtactcaatggattagcaactttttccatgtctgtcactgtcactagaagaagctttgctagtgcaagtgttatctgagttgagcagacttgcagcagcaactgctgcttgattttcatttcattttattgccttcattattggtcagcttagcgttaagcattcaagcatagcctctgctcatcagaggaaagagaaagatgatgtcaaaatttatgcatgtttgctggcctgcacattagtgcactgtatattgttctgtctgtccacccataaagtttaaatacaaacttcagtcctttttcatcacattaacctgttatacacacataacttttcagtcacatcatctttaacttcaaccaaaatctaaactttgtgctgaactaaacacagccaaaaagaagaagaaagcgtcctcccctccacgcaagcaagcaaaaaataaaaaaaataaaaaattccgcgcacgcttgccgcaatcccgctccgggattccttgcgtttttcacattttcttttccttttctttcacgcgcaccgctccggttatcccgttcctggattattattactactttttttttgtttgccttctttatctgggagtatatcttaattaattatggagatactctttagtagtattttcattttatgcgcacggttggtgtaatgaaatcccgtttggaaaccaatttctgttctttttctattaacctcatcaggcgtcccacgttggtggggatgtcgcgttccgatcccgatgcacaaacacaagtaatcaacggcggagaaacgaagccgattggaattatcaggtttggctggtaccctcctggtacttagctggctcaacacaacagacacgctgagagggagtagttatgtcgtaatcttaatgcaacggttatgtaactgtttatcaattttagatagagatttacaaacagaattcaataattgtgtactctttatctttggttggtagtctttagtttgctttttcttcacagttggtgtcctcttttttgtgtgtcaacctttttatttttgtgtgttacgttgtaataattggttgtaactcgttgagtaaaggccaggatattctatttcattataaaaaaaaagagctgcaagttaataaacagcttgagtatattttatatatatttgagaaattactgtattgggatttgatagaatatatatatattttattttgtattagtacgtgtggaatgagtaaaaaataaaggaaggagtatttaggtgtgattaaatggttaatgattgatgaaaaattggcaggtgcaggtgtcccaacccaagccaagcgaacgaggatgatactctagtacagtggagtatctggcaggattaggcaaagtacagtggttgtcgatgagaaagacaaataaagccggccgcctgtatacttgcgattgtcgccccccgcaccgcacctaaattgattgattattaatttaactgccgctcgctaaactgtagtgctccgtaacatgtagtttgtggcattttcctgcaccgaataataatactaacaatagtgatacactatcattagtacacctccagatgggttagtcctacatgagcatgggatgcaaagcagcagatggttttgtgaatgcagtcatcatataataaataaacgtgcaataattgaggaggaagcatgcagcttcctccttcctactacaggaaagcagatagacagacggcgaggcccagtttgcaggttgcagggcaaaacacacaggttcgctgacaagtgagatcgatcgtcggtgaggtgccgtgggtcattttttgtgtctgtgagcttatcttcttgtccagcatgagaagcttagctggacctacatccaatccaacaccacaccacaccatttttttactatgtactcatagggttattttgttttctgagagagggagagaatgagaggagacaagcatgttggcaggacaccttttagtaacttttatataaaaagttgttttttacaaaatacactttttagcaatttagaaaagatgctaacataaattaagataaaatttgtatcttaatgggaggaaaaaaagggtgttagctgctgaaaagttcctccttgcttactttaccttctgcttcctttccttgctagggaagaagaagaagaggaagctgtgggtcaggtgggtttccgcccatgaggagtggggtctctcggtttccttccttccttccttccttccttccggtgcactgcacgcgtcttctccatttcccatcacatttcacacgcccgcaccgccattcccctctacaaatacctcctccaccttccccttttcctcccttctcacactccaatccatcctccctctccaccctccaggctccagctatgtccgcctcgcccgagttctacaggccctcgccgccggccttctcgccctcctgcgccgccggtaccagtaccacggaggtcgacgagtacagctgctgccggacgccaacgccgggaatcagggagccagccacctgcccgccggcgccccggaagcccaggccggtggcctgcaggaagctcctcttcgacccagctcagcagcaggggaaggggaaggccatcagcctgcgtctcgacgagctggagcgcctcttccgccccatcaccaataatgccaaccttcacctccaaaccaacaagcccacccatacctgacctcactgcacttcaacttcattcatccgagtgcatactagtactattatatactaaatgcttcttcttcttcttctttggataatcaatctcttttcgctttaatttcctcttactactaggattagtagtagtaggattttagtctaggagtaatcgttaccgccacgagctgcagtgttgtatttgtatgtatgtatgtatcagcaatcaagccaagcttcacgtaagatcgagcagtgatttcagtcagtatgtatgctcaaaatgatttagttgtacaatgaatcaaaagcttaatttgcttacacttatgtagtatactcctgtctaatgataaaattattactattaattggactacttcccttcttaagaccaaatcttgggcgtccccattccatttccaattcattattacactgtcaaaattacttccttttacccctttcggcccggtcaacatagactccccagccagccagccagctttgacttcaaactgggagggggccccggtggcggtgaggcagccaagaacggatgactttgacggttgacttgcactcaacctagtctggaccttttgcatttcagcagcatttcaacctggtggattgcacaccaccaaacctgatgctactccagctgtggattaggttgcgggggacgacctaacccaacaaagtggttcaattctggtcatcaatcatcatgggagacccagagaccgacctcatcacttcgggagcaactgtcccaaacaaaattaatttgtcttccattcacgagtcagcattaataacatatatgttacacaactttgtaacctgttatgttaattaacagcccttattacagtctaacagccttattaattctaccttgttatacggccacagtgttactatgagcaaacgcatattgctcgtcttatgcatcgtttgtttacagcgacgactcgtgattactcatgagtaaaccatttacagggttgatttgaactaattaattaatagtattgacatggcgacccaagatgataacatttggaagctccgtctactctgttcatcgggaagctccatgatctgttgttgatcatcagcaggtcttccctgttgcacagcgagcccaaaacgagtcgataatccaatgtcaattctgcagattagtgcagtccaatccgaatgatatgttcatgcataagcataatcagcaaaacccctgcaacacaatactagtagtctgaataaatttcaacttacctctatcgctcaacgtactgttccaagtactctctaatcatcagcctttcctccttcgtaagatcgggattttgaccagtcaaacgctcccttaattctctctcttcatcgctggtaccatccctggagacctgcaatgaagacgtcaagttacgttatcctatccaacacgtccacagatacagggaactagggagctgggaagtaactcacctggacgtagttattcacatggccatcagcatttgctttggtcttcttctcattgtcattgcacacccatttgccgtccactatatatttgtattcataccttccttccttcgggaaacacaaggcaaatgtataaggaaaagtgagtgtgaagttagctactgtaaaatcgagtccaactgtgtaacagatatggcaaatcaataactgtaaagggaaaggaccaaaacgattgcctccagtgtcaacatatgagattaggatatcccaaatacggttcaaactaaggttctctagttacagtctttcagaaccctcggttcaaatcctcaagtattcctcaaacgtaaagacttttagatgatccaactagaagttacacgttggtggcatccggcatctactatacaagcactagaatgatgagtgataaaaaataaagtctagaaattgataatataatgctgattttgatactcacaggcaactccctctcaagataccaagctcttttctccttgttgtatgtcaaaggaattatctgagtaagcagaacaaatgcaaatcataaacaggaaatcaattaagaatgccttctgcaaaaaaaaaaaaggtgctaacaccacagttagcttctattacactggaaagtaaacttaaaaaagttctttaaaaaaaactccaccgagtggatgagttttcgacattaatatatctaccatagttggcacaaaagcatacctgtccccacccgacatcaagcccagaaatttcaacagaagaacaactatcactttcccacttcaaagtgatggaattctttgataagcctgtcagctaaacattaagagagtcatcacttagcacaaaattgtacaagcagtgccttttatcttaaccatcataactacacactgagggaaaaaaaaagaaatattggtgagtgttcacttacaatgtcagcagtagccaatttaatggcttccaactttggaaagcaagctcgtttactctgcagaagaaacatatgttcaggggaagcaagtagcatagtaacataactagtagcaatgtggtaacaggacaccagaccaccaacagactttactttgtaagatagttgtgagagatgtacacacaggcaacctgttggtatccattggtattaccagtgcacacaaattataaaaacaaaattattttcccacacacattgttttgtactgttctaaacagtataagatacctgtagtagctgatgcccttcattaagactgtagccaagaatccagaacatatacgccaactgaaaatttatataatggtatcaggatcagaatattgctgctctcaagataatggacaccatcaaatcatagaggatcctgatactataatcatcaatccagcgtgaaacttggacaggcatcagcaatatcatgagagtgaaagtcagttgtgatactattggattatttaagtactataacattgtgcaaatagaacaatttaccgactatacctgtgatgattatgttatagtctaggactcactagacactagttaatgttcattatttgggaatgtatatatgtgttttccatttttcttccctttttgtgggtgggccaacaactaactgaacaggaaagaagaagacaatattataatgtaaacctaaacctattataagaattcttgggaaacaaaaaagaaaagaccatggaaacctactgtcacagcaggagctctcccaagtccagcggtacagtgtatatatgttaccccaccattatggttgacaagcttgtgcagtttgctaatcacagcaggaagcctcaatcgcaaatcaaaagcatcaaaatccctggtgtaattaaacattatgccactttaagactttgaaaatatggacagaacagacaatggaaaaggcattcaagtcaatgcaggaaaagttacatttgacaaataaatgctgattcaaggaaagatgaatcatctattccaaaaatagaagagcataggaattataattggaaagagaagggggaaaagagatagacgttcagatcatgccatcttgtagacattattaatgaaaataaagggatttctattgcatttgacatagactacaccaaatcaccaaaattcttagtttctcaaagtaaaacgaagttatagaactttaggtacctaatttcggcacgacagtgctctatatctttacattgtagacaatattcttgaatggcacagatgtcaactccaaaatatctgaactggttaaggatggaatacaactattcactgaaagaacacattgggcagcaatggaaacaacaagcaactatgctgtcagtataaaatagaactatttttatgagatgtacaatatgcattgtgctgaatatcatagctgcagaagaagtacagtagcagggaagtgaggagcaaatgtaattgttcaatagaattatggttattgtccaatagcacagtaacataattaggaagaaggcatgctgacataaaagcactccctattccaatagttattttgataaaaagccatcaccagaattttataattctcttcgatatagttggtgtgattcacagtaagtgacagcatacatttcaagaatcaagaggctcaaattctctaaaccaggcaacataattggcatgctcctttctttttataagcatgatgagaaaaaaaaatcaataatagggatactcaaggtctggatcttgctgcaggcagaatactgtttttacaccaatgtccctaagtttatcaacatcaagtgggctctgcacatgaatgcagctaatcagacagagttaagaagtgtttttttttccttctgtaaattggttgagatagatgatatttgagaacctgtaagcaggagcccacgatcaagtctgggcgtatgaaattgtagttcattccaagctcatgtctatacgtcaacactagaaatgatttagaaaaaaaggaaatgatctcaggagtgatcaatgatagacagtaatccagtaaaagcttagtgaatagtacaagcctgtccataaatatggtcacaaccattgtcctcaaagaaataatatttcaactgttcggtgtaaactataaagttgtatgaaaatcttaagacaatggacaagcaagaatacttttaagataaaaatcagtggcagaacaatgtttgtacacatgactaatgcaccctctgcaaggtcaattgttggaagaaggggaaggtaagagtaagaaaaaaaattgtgaatgcgtcgtgacttgttcatgaggaatggagaaaaatgacacataaatgctacttcctccatttcacaatgtaagtcattataacatttctcacattcatattgatggtaatgaatctagataggtatatatgtctagattcattaccatcaatatgaatgtaggaaatgctagaatgacttatattgtgaaacggagggagtaagtaaaacaagcatgtgagtttgcaccgacagacacaaaaacacaccggtggcacaacactttgatggtgacatctacatgatgttagtgcatttccccatttatcatctgggtaaggaaccattaaagtcagcgagcagcaggtcgagtacaatccgacaagtcgtggtacagctaacatgtagtattgattgcaggtaaggcataatgggtctttacctgctcccatagcttgcgtcatgttggtgctgtacgtatcggatttctccgtgcccgcctccactgcgccactctcggcgctagaagtagacgccccggatgcctggaatgtttacaggacaaggtttacacaatggggtgaaacatgcaggctgcactgcagcggattctatcatatgataattattattgtcggggatttgacgagttaactgcctctaatctcgggtagatcaattcatatgcaggtgaagggaatgcttacggttttgacagtgtttgatcggcgactcccgccacgaaccatcgtctagtcatcatggacatcaaaaagaggaacaaataagggagccgatccatcaataataggggaaaaaacaaggacgtgaatggaatggaatggaagaggggtcaccagattgagcggcgagggccgcctcatggacctggatcccacgattggaggctccctgggcgaaaacgaggaaatccagcagtgacgaacaggcgaaacaagtgtcgaatcgaatcgaagcggggaggaggaggaggcgccggggcctcggccaccgcactcacttacttgagcaggttctggaggcagttcatggcttccctcccgtgccctgcccgcgcgggcgcgacggcgagcgaggacgccgaggccgaggagcccaaaaatatctcgcgttggcgttggcgtaggcgagtcgagaaggaaggaaggagatactagatggctttcgcagtcgccgcgaagaggagagaagaagggggccgggggcgagacgagaggaagaggatgtgaggtgaggtgggtggacccggtgtagtgggctggtgttgtgtgcgtgtcgcgcgggtgatgggggcggtttataggccgtgtccacggagttgcgatgctgcgatggggatggttcgacgtggacctttggctcttagctaaatcgagtgggccccacttttagccttttcctttttgaccccttctacggaagtgatcggacggcgacgcctcatgcacgctacggcaatccgacggctagcgctcgggacagctggcgcgacctcctccgttggtcgggatcacatctccatctcatcggtcatcaccattcaccaacgtggttttcttgggacaccggcgcgtgagcgtgacggcatccatcatgtccctcgtcctaccattttccagaaaggaaaaataaaaaacaatcagtatcgtccgtgtaaattggtttcgtgcactcgtcatctaatctaagaggggtgtaaagtattagcgtgtcacatcggttattatacagggtatcatatggggagttcagacactaataaaactaattacaaaatccgtcagtaaatcgcgagacaaaattattaagcctaattaatctattattagcaaatgtttgttgtagcaccacattgttaaatcatggagcacttaggcttagaagattcatcttgtaaattagtcgcaacatgttcaattagttattttttagcttatatttaatactttatacaggtgttcagatgttcaatgcgacaaagtgaaaaattttagggtgggatctaaacatggcctcatttattaacgcagttgtttacacataatgttataaccttattaacacgctcatcaatagttgtagctaatgtgacgtgtcgtgatagaggaaaagataaagacagtacgtcatgtgaacgtacatcatataactaatggtataatgatttttttttattatgaaaaaccatggctcaaaagaaatatgttatgcctttaaactttaaagctttaccatttcacaacctctcaacaaacttaagttacatagtagtaacatgtagttagagaagctacctacatcatgttcgataacagacaatacaacgtgatagtatttggtggtaatggatgcaccactttacaaaggctaactactccttacaaaattcttacaaagtttacgcttttatgttatttgttgtatgtgatgacacaattgagctactacctctagtagaagtttgaattacacgtagttatattagttgctacgactacatagccacaaccaatataaagtatcaacgctgctagaaggctgtgttcagatgagatggttgtggctgcatagcgcaactgttgtagcacttgcagtagattttgtgctgctagtactgttgatatagccagcagcagcctaacagttgcaatatatagcgcaagcaaacacatacaaagttaatatttactccctccgtttcaagtcataacacgttttgacattgctcaaagtcaaactggtttaagtttgactaaatttatagacaaatatagtaatgtttataatactaaattagtttcatcaaatcaaaaattaaatatattttcataataaatttgtcttgggttgaaaatgccattaatttttttttacaaacttggtcaaacttaaagctgtttgactttgtccaaaatcaaaacgtcttataatctaaaacggagggagaaatagctaaggcacaatttcatatgtccatgataggtattccgttacaatgaactatgtaagtatgtgaaaaatctactagagtaataaattcacatatagattaccaaataaattctctaacaagaataggtgttcggaagatgtgaactcatggacgaattttatccaaaataaccgcggacatattttgtctaaattactcctgtggaataaaagattaatatatgtgatgcattatgaagatagcataataaattaagatttattagttgaaaggacttgttaaatgatcaaaagattcatcggaataactagtggtagtggatttgttatccgatactccctccatactcgtaaaggaaatcgtttatgataatgtttaagtcaaacgttatgaatataaatcatgaataactctcaagttgttgagtttgaaaatataatagttatatgaatagatttgtttgaaaaatactttcataaaagtatacatatatcacttttcaataaatagttttatagatataagaggtcaagagaccgtgtcgctgtccaaaacaactttctttatgagtacggagggagtacgactttttttacgagtacggagggagtacataataaagatgaccagaggctggaattatgcatactagta

SEQ ID NO: 69353 - DNA, 37962 bp, Oryza sativa
gccgacgcgcgttgcgccacccacctcttcgccgccgaggtcgcgctgcacgaggcgctgctggcctacgctggccgcgccgcgcgtcccgacgacgccaccctcttcttcgtccccgtctacgtctcctgcaacttctccaccgacaacggcttcccctcgctctcgcacgcccgcgccctgctcgccgacgcggtcgacctcgtccgggcccagatgccctactggaaccgctccgccggcgcggaccacgtgttcgtcgcgtcgcacgacttcggcgcctgcttccatcccatggtcagcttcgatctcttctccactggttgcgtctgcgttaggcggactacttactagatgatgcatgatatttcttgagcttgtaagatgcaagttgcttgcttgcttcttgttgctatctatctaaatggcataggagctgttcgtgataatccactttgaattaggggtcaatgccaagtccaacctagctctagggcaagtaatccagttctttgatcccaaattcaggccaattgaagattcataggcatcggctcttgccctaattgagcttggccgaacatatttctcaccccaagcatcaaaattcctcttttgctgtcaatggagcttagttcgttgggattgaattcaacacagaagttcaccatccattgcattgcatgcctaagaatcaactatgcaaagtcttcgtctatgttctcacttgtcgcaactcacaatgcaacttagttgtttcagaattcacagttttgctgatcgccttctgattcaacgaaaacacccccaccaaatgaaatttcaatctatttgatcaggaggacgtagctattgcggatggcataccggaattcctcaagaggtcaatcctgctacaaacgttcggcgtacagggcactcatgtgtgccaggaggcggatcatgtggtaatcccgcctcatgtgcctccggaggtggccctcgagctacctgagccagagaaggcacaaagggatatttttgccttcttccggggcaagatggaggtccaccccaagaacattagtgggcgcttctacagcaagtaagcatatactgcaaaccctcatttcggttgcttcatctagcaattatcccaaatgggctagcaaggagatcgttttttgtttgtgtgttcctcaggttctgtctcactttagttgtgtcttctaaaaactccgatcgcatgttgctgattttagacttctagatctgttcataacaatatagctcaaaagcagtcagtactacacagggctaataataaatatcatggttctgcaatataaaatgttatttctttaactggttggcaaaattcaaagacaaaccttaggttgaggtatcatccataaccactatagtttcatcagttccacatatggatagctgaatcctgaacagaaaatcaaacttcattaggtcacagttactagctcttaccttttacattcaacaggaaagtgaggactgagctgctacaaaagtacggaaggaatcgcaagttctaccttaagcgaaagcggtatggtaactatcgatcagagatggctcgctccttgttctgcctctgcccactaggatgggctccatggagcccacggctcgtggagtcggttctccttggctgcattcctgtcataattgccgatgatatacgcctgccgttcccttctgtactacagtggttagacatctcgttgcaagtggctgagaaggatgttgcaagtcttgagatggtgctagaccatgttgtagcgaccaacttaactgtaatacagaagaacttgtgggaccctgtgaagcggaaagcactggtttttaaccgtccgatggaagaaggagatgccacatggcaagtgctgagggagcttgagattttgctagaccgttctcaaaggaggcatgttgaatcatggaagaggtgaagaccacagaggggagggatctttccctacttgctgaaatgtggcatgtgatcagtcgcagctgtgacaacaatgacgtgcagcttgcacatgccactcaactgacaaaacaaatcaatatttgatcgacaccatccatagcaaggaccttctccatgagaaattcagaatgccagtttctcacattcaatcatattcttgaatggtgaactgtgtagttggcaattgactaagtaatttgaatgtgcaatcagagaagcgcattctaggctaacaagttggcgagctctgtgcagggaattagtttattctttattattgggagaaatgtgaatctcctttttttttcttgagagagagagagattaaaattgtgttatagaacgatgatctgtgaaggtcttcggatatgtttgcaatgttgtactattgtatacccaattcttttaaaacagaaaggtgttcttttgaacacatggtatcaacaaaacatagcaagggatccagcaggtcatcagaattctggacttgaagaattctaaactctgattcaacacatgatctcaaaaattgttgtctgaacgctttgtttggacaagctgggccaaagaaaacgattgggatcggggaaagaaaatcggtaggcacaaaggcacgcgcttcgtgtctcatgatttgataattccaatttttcattggcaataaccacataaaaccatgtagcaaaaaggcacaaatttcttttgctaaactcagagcagacaataacctgaaaatgtgaaatctgtgtcgcgatcctccttcctctcagcctttatacagtctacagtttttagtcacaactgagttgcaaaacacacctgcaaatcggcaatgaacaacaccggataactgcctctcaggtccaaacaaagctgatgattggatacttttgctgtatgtgatcccttctatttcaacatactgttggattctacaaagtttcttcccttatcagagagaagtataaagcattactgcttgaacacctcgccgaattctgagcaagagaactcttaatcacgatagtaacaaactaagtcttgcgcaataacagtgcatacaactattcccagccagtgagaaatccctcaacttcatgcgagcgatatctatatcagagcaatgaagttgcccgattcaagcaagcaaagttgtggtcaaaataaaatgaagcagaaagtgacactagtctgaaccctgaatgaacattcgtccattgtagccaggaaaaggaattcaagtcaacgagtaactgaaacaagtgttacaaatgaaagatttgtgatagaaaaatgagtccagtataccgaagggaacacaaaattcagtacaacttcagctaaaagacacgacatggattgaccatagaatgattatttggaacggaagcagaagattttcaataattaccaatgtggttttcagtttacatgtcgtgaagtgacattaacggccactgaattgatagagccacataatagcacaattgcggatccaccaaagtgagatacacggtttttaatgtgctgtagtgaccataaagcataaatggctaccctgaagtctgcaggtagcaaccaaatttgaaatgcacaggtaaatgcatagtttcatatggatactcaagagcacacacccttgcaaggagcgtccttgcagcggcaaacaggcctccctgaaagttcccatccattaaatccacgttcaaggaccatgatgttctttacatctgaatcttcatcagcctctgacaaatagtccagatacatttgcgcacaagatgggccacgcacctgcaggtttccaaaagaaaaaaaaacagtggaagtgtcttaaattttggtatgaaagaacacaattgaccaaaatccgaatataggaggaaacatagcacatatggcttggtttaggtttcttattgcatttccattgctggacaaccgtaagtgcatttaccaagaagcatagttaagagtacatcatattgttttatgatgaaaaattgcagctcttttcctgcttaatacactgatatgcaagatttttacctacctgtggaaaactattgcaggaactcaggtagaatatttaaatggctagattactgttttggctaggagataaggatgaaacatctgtattagaacccaatacatccacaccagcgttttatgagtatttattactactccctccgtttcaaaatgtttgacaccgttgactttttagtacgtgtttgaccattcgtcttattcaaaaaatttaagtaattatttattcttttcatatcatttgattcattgttgaatatactttcatgtactcatatagttttacatatttcacaatttttttttgaataagacgaatggttaaacatgtgctaaaaagtcaacggtatcaaacattttgaaaggagtatatagttgcaacccagaaagagggaaataaaaaccatcctcatgccacttgctgctacaaacaggagatcaacagaggaggaaaggatatactgtttgttcaagagaaacagaatgtgcaagagataaattagagttgttcaaatggaaagcaagcaagcaacaaaagataacttgaggacttgagtttccaagccctttgatgtccgctctaactaaatcagagagttcatgaagacaagttcaaccacaggcttgtgaagctcaagtgggtggttgcatggcaatggaacattttgtgagatacgaagccacctgatgctgagccgcagattgcttacaagtgatgttgaataatacgaaatgaagaaaaaacaaaagaaaagaaaagagaggagagtagtgaaccttgctgagggcacagtggaagacgagggtttccttgcccttggtggcctgggccagctccggcagccgctccccgaagctgtcgctggcgtaatgatgcgagccggcgatgtgcgcgtcgtagatcctctcttcgtcccttccgcccaaggaattaaccccaaaaccaagtcaagtcagcactggaaagcaggcgcacagcgatcggcagcatgggtacctgacatcgacgacggcgatccgggggtcccggagcatggggacgagctgcgccgcggaaacgtaggagacgcccctcgccatcgccgccgccgccggccgtgtgagcgatggcactctgtgtttgatgggccgagatagatttgagcccacgatgtagtagttatcttcttcgtcgaaagaaaactcggcccgtttaatgaatatacgtagatactacatagacgacgcaattaacttttacacatacgtttattaaaaaaaatccgacccattatcaaaacgaagccttaattagcaaagcatcatccatacgtagttaccgaaacgaactcgtatatttgtatttgtatagatatagaggtcgaaaatgtaaacctattcggaatgtaatcatcttctctctaatctaatacacacagtacggtaaccttaatcaatttgctgtcaaaggaagaaaagtaattagagacagcaaattaagctatcatataggagtactttgcttgcagcttccaagtagtgtattattgaacggatcggagggcaaaaaaaacaacttgtcctctctctctctctaagttgttggagtccgaaacgatatgccgtcgccgccgtggatggaggcggagcagcagaaggacgagacggcggcgacggcgacgatggaggagggacatggtcttcgtcgtcacaagcggcggcgactcgtcggccaacaagctgctacgacgcagctggttgaagaagttgatgatcagcagcagcagcagcaggaggaggaggcgccgacctgcagcatttgtctgcaaccctggacctgcaatggcgaccatcgcatctggtatactccctccgtttcacaatgtaagtcattctagcatttctcatattcgtatagatgttaatgaatctagacatatatatatctatctagattcattaatatcaatataaatatagaaaatgttagaatgacttatattgtgaaacggagaaagtatattatacgttcctgcatgcatgacacatctcaattgatgagctactcgatcgattgctaattagtagtttgattttttttagtaattagtaatttgataagtaatcaatactatatgttaactgcatgcatttcctctttcagttgcattccctgtggacatgtttacggcagatcgtgcctggagaagtggctggtacatgttcttcaacgcggcactggacaagcaaaggtagtgattactactccactaattaattagttgtgcgttgccagcaactaatcagctagtgactatactgagcatgcagtgtcctcaatgcggtgaagagttggagccgcaccgcattaccaacctctacgcgccaggaatcaatatatgggacggttgctgcaaaaaccatgcgaatgttagttacttacttatataagtactccatataattattaattactactttatttatatatagatattgtcaatcaattagagtaattaattagttgttgtgcacgtacgtacaggaggtaggagagtattacaaccgtgagtacgaggggctgaaaacacaaatggagtcgacgatcgctaaacaaggcaaggatttggaagaattggatgtgctcgtgaaatcggtgggcaggcagtttgagagccttgaatcaagtctcaagacattcctgctatcaatgacggagcggatgaagatgatggctacacagctgcctgcagccatggatctcgttcaatatttggagaaggatgtccatgatatcatatccgcgctctcccaaaaacctccatatctagctcgtctcatgcatccatctactgatcgatatatgcaagcatgtttttgctagcttcgtgtggtggggttcgttaatttaatttgtagagagcgctgatgtaagaaaattacttgcaagtgaattctcgtttggctctataattggctaatagctatagcctgggtgattttcgctcctccggcctactctgtttttattacttatataaaacacattataaatacagacactcacatattaatttatacttcaataagttatattatacttaaatgatattattgtcgaaactatatatacttagataatatattattgcaaaactgtatatttatatgggttttgcatccgagaagtacgatctccatcatcacgcgcacttcctttaaaagaaacactgtaaattttgtgatatttcgtttcagggtgtatcttgtctatcaacagaaaacagacaatatgccactcaattcgagtggttttgataaaaagccacttagtagaacgtacatgataaaatttcactcattatattgtctaccaattaaaatgccacttttgagggctggacggccgccgacaatgggatgacggggtggagggaggagtaggaggcgacgaagcaacagtgtgggcgtggactgccctccgccctctgtagcttatgggaggagtatcaagggcacggcctccagtgttgcccacgccacatgtcacccgcacgctggagagtttgctaagaggtggtgacagcaggagagataatgggggtgaaggtaggaggagaaagcgatgacacacgcgggcgggggtgggaagatcgcgctctttggctccctagaggagcaacgagggcgtggcttctagtgccgagtggcctaatgtgcgaaggttcgcggggagaggagtcagcaaatgtatccggatttccgtttctggttcacgcgggattttcttttctgttcatccgtttactaatggaaagtttatccgtttactaatagaaagtttatgagcagtaaatttggctttttaatttagatatttatatgtacaaggttttatactgtttaatactttttgtgatttttttaattcatttgaaatttatatatgcaaagtttataggtgcaatattttatatgtagaaactttctatgcacaaagtatatacgcaggaaatatctatgtataaagtttgtatgtgtaaactcttttacgtataaatattttttagagagagattatatactgttgcatttgttttaaattgtatgtacaaattttacatgaataaaatttacatgtacaaagtttcaatgtataaagtatatatgtttacagtttctatgtataaacttttttatacgtatagagtgtagatgtaaatgtgttttgggcttgccaaggagtggttcggctaaggcctgataaaaaaaaagaagaggaaaagcagatagaagcctgtggattggcttggcccagcttgcaactttgcacgtgaaacaaatcggaacgagaggctatctcgaaaacagtggctgatgaaaccgttcgtcgtctgctaatactcgcatactagactcacccctctagtgccgctaccctctaactctctctccacacacactagtcagggccaccttggtctgaaaaccctccatagtggcattttaatctgtaggcaaggtagtgaataatattttggcttttatcttgtgcattttattgattggcttttcatctaaacgaatagagtgacatattatccgttttctcatctatcaatggaaataaaaaaggtattttccaaacaaaaaagatggaaatgaagaagggcaatcgtagtgggccgtatttgaggatccgagttagattcggcccatgagtttgtggtatcgaattcccactcggcacgcaggacgcagcccaacctttttacgctgttcatctctctctcccttcgctgccctgcctgcctccgtcgagaagaagagaggagtagttgttgcggttttgctttgcccgctctctctcctcctccgccgccattgccaccgatttgccatggcgtcgcgcccccgtggaaggcgccttcctcctcctcatccgccgctcatccaggagatcctcgacgacgacctcttcgatgtagaggttaactacagcgacgaggaagaagaggaggaggaggaggaaagcgatgaagaggagtcggagtcggaggacaacgaaccggaggaggtggtgccggggcaggagagtatcggggagggatgcgggccggccatacaagctagggtttccggcgccgccgcggagaagaacgcctgccccgtttgtatggaggcctgggcctcccaaggcgctcatcgaatctggtgaggccaaatttctgccttagaccttgtctatttgttcgattcgtgtcatgtgccttgcatcaatccaagaatatatactcgcactgtatgctttgctagttgctactgtagctttacttcccaatgttcttttgatgcaaattgttgacaaggtgcattctatgtgtagttgtattccttgtgggcatatctatggaagatcttgcctggagaggtggttgaggcacaagggcaacactagcgcaaccgtatgtatgccaatcgatcatactactagcttttaataacaatttttcacaatggacaggttctcatgcttaaccaaatcgtctcttgctattgatttttagtgccctcagtgtgggaaaaggttcagacctaaggacattaccaatctctatgcaccagaggttgcagttccaaataatgatctggaaaaggttcgactttattttgttgctagttactgctctcggacaattcttccatcatgaaccggaccctgtttcattcttcaggaagtattgtatctaagggggaaagctgaatcccttggggaaacggtacaatttctttgggtcacctcacctgcatgctccttttctctttatagttggaatcaacaatttttattttttcattgaggataggtgatgaaacatgagaaattgatagaggagatgaatgagagattggttgagttgacaagtgctcagaaggtatgctgtctcctattcaaactctaaatgatggcaatcgtgtgcactgattgttccggcctcagataatttatgttgtaattttcatttcactagaatcatgttcatatatttacttgttatgtgtgccttgcagaggcagattctgtcagagcagagattaatgaacgttggtagctcaaagagacaggtaatgccatctaattttaaattttccaatggttaatacctgaacattctcatgaaactattttattccaccgaagaaattggcagagcatttggctggaactacatatctggagccaccaacctcagtcacagcagattttaactctagcaacagttgcgattttgtctttcaggttgattctctttctaaacttatgtatgttataataattcaaggtgctcttattcttttgttctagtttcctttgacgtgcttttgacattttgtgtacactgaatattttacttatccatgttatgctaacttgaaacatactgtatggtacctgtagtaagttcatgatgtaatttttcaaagctaaaatggagttcagtggggacttcatgattcataatttttcttttctgaatggaaccactaccaggcagctcctatcagtttaaattttatataaacaaaggggggaggttacaaagaaacaatgtacagatagaacacacgctctagtgtataagactctaatccttcatgattcatgattccttcccagcttctatgacatgtaaaatggacaatatgtgtcaatattgattgattactctggaggaagtagtacttgtaaatctacatcttatgtttttggaaggttgccaaaaatcttaaattcatagcaagcatgacttaattttgtagccattgctattattcttttcttttaagaaaattagacaatagtgatagcatgggaagctatgtttttcaccttttaggtatttataatagtttattataataaaacagcttattatgttttatccttgaatttttgtagtgtcaaatgttggacaaaaaaaaaatattttgtggtgcaactgaatcctgcatgcatttatttcacactgaagtgaagtgttccattcttttcaattgataaccatgttttgtagaaagaattcttcatggatggacttcgagtcatggccatagatgcatttaaccaaacaattcttgcttctggaaaagcaccaggcataggacaagaacatgttctttataaggtacattttttaaatcggtagctttgccaaattgaatacatgttatttgtgcttatcaccaccaacttttacaatattcaccttattgcaattcttgtctacagtttagcatggtttcccatcacgaagctcggaatatacaacttcctctggatactaaaactgtcagggacatatgtatcttacctagtggctctgctatttttacatcactgggcaggaaactatcgtcatttaggtttgtcttcaatttagtagtctgttactttgtattagttctattttttttataacactgcataatattcttaatccagcatgacggctgaccgtgtcgttcttcagtgtgatttgccggtaattatttaaccctgctatccttatactcctgagaagtttgcagtgaaaatgtttgtttcgtccttacttggttagcctgtttggaacattgataaatgaaagttgtatctgttttcagaaaacaaaaaaaaaaaggaaacaaaattgtaagtagtgaagatgaagtagcctaatgcagttctgctacttaaatgaggatgcattattggatgaaaatgattagaatcatccatagacaaattgatcgaagcaccttcagacaatacttcctgttaataatattgctttctctattacaataccatgcagtgtcctggctggtcatgttctgcggatgaatcttcgcgtcagatttgtgctggattgcaggttaatcttttagtatctcctgatctgaagatttgttcatgtaatcgcaaagtttgacatgaaccgctttcttatgtactgcagaatggcaatcttatcatctttgatatccgtcaaacctcaagaccgttgcattctatggtgggtttatctacacacccggttcatactctccatacggtcattgataacaacggttctagaaagtttctctctgcctcttctataggcccctgcatgtgggatactgatggtattcaaggcaggtatgcaaaaaagtggcagtttaaaggcattaaactcctattacagcattactggaggcgtttttttttgtttttttttttttgcctttgtgctttgctgatcctcgaaaatctgtggaaacatgtggtttggtgggctgtggttctcatgtttgcctttgggctcggttgcaggccaaagttgctattggggacagataatcaacgggtgtgcatttctcttgcatgtgccccttcatcaagtgatctattggtagcttcctttcggccaaaggttgaaacgtccgaggatgctacagcatctcaagtgtatctatcacaaacaccaacaccctctggtggagggaaattagggtatcattccttcatcaggagggcggggaactcgtcatccttcaccgaagataggacatgcagcacacttgtgagcgaaattcgcatgtcgaaatccgcaattataccttatggaaacaaccaacatctgtttgcttatggagatgagtcgctgcgtggggtccggacctggcgactaccatcgtttgagatgcattctgatctcagctccctccagcaaccggtcctggatctaaggtatgcagaaagttcatccggagggaggtatctcgggtacctgagcacggaaaagttgcaggttttcagaattaggtagcatgtcaggagggaaacttaattttagtctagcttttgctcttttttccctctgacctttttgtagctttgctaaacgctaacgaacataaatagtttgtagatatgaaagctagaaacagggccttttgctatgtacagtcttcctgaaagcagagagcagttgtggaatggtaacaaccatcgccctgtgttctgaaaactgcagtaatgccactgatatgatgtgcaatacacctgtcgtttcctagcttactaattccgtgcttgcaatgacagtttgacagttgatgcctgtaataagcaaggttttacattgagtgtggaacttaacctaccgagagtccaataccatgaaaattttcagatgtttttggaacacatgcttgcattgcaggtcgaagtgaaattttgggtgacacagctgcacacctcaatccaatcgtacacaataattatgatgagggtaatagtagatacgtgttggtgctcgtactacgtggtgcacacaacacatgaaacgatgtgaaactgaagatgcatggctcaaccactagcactcggggtagttggcgtgattcctggagtagtcctggcagtagtagtagaccatggacctctgctgcgcccacctcatggccgccttctgctgcgcgctgagctcgccggtggcgcccgacggcgacgccggcacgggctggcagctcgccggcgcggcggcctcgcagccggcgatcttgaggtctcggtagcgcgagacgaagggctggtagcggtagtcggacttgtagcggccgccgtcggtggcccagtcggaggcgtcccagatggagccgtaggcccacatctggcggtcggggaatgtgttgccggcggcgcgcgggtaacggcggacggggacgtcgtcgacgaggaagacgatgtggtcggggttccagaggatggcgtagtggtggaagtcggcggtggggtcgaaccagaggtggaaccgcatctccctcccgatgatggcgccgtcgccggtgccgtgcacgtacacgttcgtctgcagcgtccacggctcccccggcaccgtccccagcagctctatgtcgatctcgtcgtgctgccccgggtacagctcgttgttcgacagctacacatatatgataagtagcttcatgaattcacagctagcaatggcgggccgccggccgccggcaatacgatcgagaagacaatatcttacgtagaaggcggtgttgacgccggcggtgtagccggaggggaccttgatggaggcgccgaagtagccgttgcggtaggagcgcttggacttgaagccgctgccggagctccggtccatccacaccgtcagcgccgtctggtccgccgacagcgtctggtgctgcccgccccacaggttgtcgtacccttcgccgaacgccatcgatcggatcgtcttgctcgggtagtatcccggcgatggctgcgctcctgcgccactaatcatataattactgcacgccaccaccaccattatcatcatcagcagcagctgattattattagcagcaactgctggtggcttctgctccatcgataatcgtccttaatttctagctgctgcctacaaataatgtctcttcttctactgactagctcctgctggtctgcagcatcactgcatgaggccggctttatataggatcagctctccaacttgcaagaaccaaccacaggtacgtagctcctgctttaattaataatcgtccatgcatgcatatatgcatggtcacttacattacgttagtcattagccgttaggcacaggtggagacacaaaatgaatgatgaaccttcccttcccttactgtgggggctgcccgtgttagctcagctcttaattatttaatttgcacaaatctcacatcttataactaatcaacacaattgatatacatcaactgcaaggattaaggggctgttgattgatgccattttcaaccataccattttttgataatattgtcaaaaaaaaagagagcctacatttagtttgttgccaaactttgaagaaatcttgccaaaattttaataatattgttaacttgctaaaatttggtaaggtttattttggatacaatccgaacagccccttaattcattcgttaaaaaagtggacatctttcaatactcgttttaatttattttgcatatatatgtatatatgttgtactccatctgtctcataaaaaaacaacgtagcggatgtggcacatcttattactacgaatctggacaagcatctattcaaatttattttcatctaatttaattttcgtttttttataggatatagggagtatatgacttgatttcagagggcctggtctgcccatccatcgtcatgttattgtcggagataatatacttttctagaagtggcagaaatggctaggtttcgaccacactttgcctctgctgggcggttagggcattcctcctgatcatccgctttccatcggtgttagttgcagctcatgttaatgtactgtaccaaccaggagtgaacctgccatgggcttaattaagcactgaattaaagcagctaatctaaatcttggactttgccacatccaataaacacgtacgtacgtacgtacgtcttccctttatccaccgtcctgcagcacgcgtgaagccagtacttaactggaatagatcgataaatataatttcagtcatataagattaatcattaactaattataaagtgagtattagagtcatgtatacatgcttgcagtcatcatgcaataaactctcaactaaatttagcttcagcgccaagctagctagcagggtagttgcgttacaaatcgtgcagcagtcagtgtcaaagcatgcatgattgatctcgtttcgttgcgcctttgatcgatcgattgatcactttgttgacgaattaatcggagaaaattaaaaaggagatgatggagactgaaacagttgagagcggttactggctcgtacgcacggcccttcgatatatatatatatatatatatatatatatatatatatatatatatatatatatatatatatatctccttttcggtttgcatcatatcagtactacgtactactgtaagtctgtaatatcatatcacctagccttcattcatctagtggttcaatgctgaaaaattttatactacttgagaaaagtatattgtatatgtaagtatgaaaactttgcgttaaaaacttaaatatcaagttttacacttaaaaaatatgatacctttgatatcttttcaagtaatctgtaatgtaattatggatcggataatgttaactactacctccgttttaggttataagactttctagcattatccatattcatataaatattaatgaatcaaggcacatatacatgtgtctagattcattaacactcacgtacacatatatgtgtgtaatgctagaaagttttattataatatgaaacggaggaagtagctttgacggactctcctaacagcaattaatagactaagggaaacgaccgttgcatgatatcgggtgcgaaggaagctatggtccatctcatatcgcccagcagcatcttggtggaggcgtgttaccgacaaactttcatgcgaactgaatatatatgcagataagacgtatatatgtaactgaatatgattacacatatgtatacataaggttattatgatcaattataagatcgacgtgggtctcatgaattaatgcaaattaatcatgtacgagtatgtatatatatgacataagtagtggaattagcatggaaggtcagtcagaccgaccatgcatgtgccaatggccctaacttaactaacaacattttgtcaacttatgcatgttttgtaaggtctgatccgatccttttccttgctccaatataattagctgagaaaaacacataaaccatgcaagcatgcatgcagaaacagatacatatgctgatatgcatgcatgttttgatccacatgtactgtagtagcaatgcaaccacctgcatgcatgtacggcacctagcagctaatattgctagctcgccctttcaatttggacaatgacctctctcctaattaaagttaactaacaagactagctagcctaaatatatgaatctgctgatttttgaatactacgtttgataattgttgatagttcgcttaaaaatttagtataaatatacaaatttatcattcggtgataaaataattaagttgcaacaaaaataaatacttttaataagatgaatggtataaagagatatgtaaaagttaacaacgttgtatatttaggagatgatacaatcatatttcttttttgacggagggaactatatatatgtttgcatgatatggcatgcatatggacgcgacattgatcgatcgtcggaggcatggcaagcagtacagtacgtgtgcaatcatatggcgacgatcgatcgaaccgcccggccggtgagcttaattaattaattatcaatctctttcatcagtttctcgttgatctccttcaattaagcagaatgtaatgcagaggttgtacgatccagtcatcgaggctgccgcagtatgtgcaggaggacaaaaattaggggatcgatcaaatcaaattaattggtggttctagttaccttagcttcctgtagatgcatctgttggtacgtacgtattcgatggatatataatgaatcatatatctcgcgttggctactagcttcaattaatcaattttgtcctcccactgtttcatgaaatcgagctacatgcatgcacgccatgccaaactgactgttagtgtatgttagttagtatacagttggttggtacatgagaatatctatattttttaatggaaaatgagcaaatcagttttgattactatgcactactagataacaatcatgaatggatggcgcttgaccggccagggacccatgccacatacagcataacaacctccctaatttggccgcattgtccgacaaattaaatcaaatataatatccctctcaatttcaatactggcttctacatgcaaactaaccaaaatttgtttaagaggttataagtgcccgttactccgttaaacagttgagttggtgtggtaagtttcggtctgggccataataatgggctaaaacaaacgaggcaaacagctaatttcagtgggctttgtggcccatgataagaagaaggccgagttggaatggaggcccaggctgggcggcctaacccagcaagaaggaagcagagcatctgcgtgcgtcttccccacgcagtcgtctgctgcttccgaattccgatcggagagcagctggactccggtgagggatcatggaggcggtgaagagcctcctcaagcccaagccgacgccgcagcagcagcttcgcgagtggcagcgccgcctccgcaacgagggccgcaacatcgatcgccagatccgaggttggggtttcattcttccattctctcttggatctatctgcccttccatacagcgatgatgctgatggttgaatccggagctagcgcagatgtgcagagggaggagaagaaggtggagaagtccatcagggaggccgccaagcgcaacgacatcggatcggccaaggtacccctacgcttccatccattcgattcgattccacttgtttgcggtttgctgatgcgcattcgtgttgggttttggtcaggcgctggccaaggaggtggtgaggtccaggaaggcggtcaaccgcctctacgagaacaaggcccagctcaactccatctccatgcaccttggcgagatcgtaggtaacgaatcacctctcatatattatatctcctcacacacacccatcgtccttatgcccaactgtttgagaatccaatcccccattttgcaatgcgcttgctgaaaattagcataccagcaaagcccttgttgatataagttaggagaatattactaatacaacggttaagctatatcttgttgctgtaggctctagtgaaccaatatcagtttgggttgtgattggaagcaggaattccactgagatttggatttttttttcttcttttcagtttgcaggaaagaatacaatcatatgagcatatttaggagtacatgttacaaaaacatatgtgcatattatatttctccccctcatattacattttgtagagtatcatttgtaagtgtattcctttcatcttccagactgatgtttgtacttacaataaattgcaacctatcacctttcagctactgccaggactgttggccatttatccaagagtactgaggtgatgaaacttgtcaataaccttatgaaagcaccagaggtggctgccaccatgcaggaattcagcaaagagatgaccaaggtatggattatgaaatgatcacatctcttccaaaggtttttcttgtcctgtatgcccatactagttcttacttcctgattgctgtggtgtaggctggtgtaatggaagaaatggtgaacgatgctgtggattcagcgctggacaatgaggacattgaggaggagattgaagaggaggttgacaaggtcctctctgcaattgctggggagactgcctctgagcttccagacgctgtcaggaaggaaaaggagaagatgaagcaaccttcaacaagtgaacctgcagaggtaatgtccaacgattcaacatatccttcacattttgcaattctagggattcttccatatctctgcgtgtttcaaaaataatgtactgagttctgaaataccttacccggaacttgcgccaatgtgcagagaactgctattgcggaagccgtcgatgacgatgacgatgacgagcttgaacagataagggaaaggctcgccaaagtgaggtcataaaagagtaatgatgaaaagcaatcactggtttgttttactgtattatactccacttcagaatgtatgtgtgtcatatcagaaatagaaaccccttcttgttattaacaaactgatatacctgcaacctgcattcactgatacaaaattgttcaatctcagttgcaagggtaattgtgtgccctgaaatttgtctattcgttgtgcgtacatacgggtatgttgtgacatctgttataatatcgcatatcttccagctcatatatccggctgagagcctgagacttggcagtaactacttacgaaatacacgtagtactgaaagctaaatcttgtgattgttgcttgaattatcaatgcttatgttctagatctccttaagaatgttgcaacaacccaccatgaagcattggcaagtatttattttattttttgaattgtttactgctagtgtttgctttggcaagaggtcaagagcgcagtagataatgacagctgactagctgagtggtgatccacacaagtctcaactctcaattgggccagatcgattacaccgaggctacatgccccagtcatgggtcatactcatgtggaatttccatctttaattgtaggatcaagcatagttccataagcgaggggcatgatgaaaaccttgttattgacaacagggaatttccattcaaagtttggttatatgctgcatgacacagattattttcctgtgtgagggctgtgtagaaaacttcagatgctgcatgagccaacctgcctacaattgcagttggtctctaattaatcttgtttcccgttgccgaatccattttcatctcctttctcaacgtggtttcctgccatctccttcagctattccataaggaggacaaatagaaagagagagagatagagcgttaggaatatgacaaatagcaacaagtttggttgtttaagtaacttaaaattgataacgacgacgtttgttttttccccttgtctaagctctaacaaatattctcatctagtaaagacaacggataattaattgaagctagatgtgaaagctcaaaaactgcttgtagagctactacctttgacaagcttgccttatggtatctgtagccctgaaacgaacacgagttaactttgatgtcagctatatataataaagttgtttaattgcaagggtttagttactgctaaaacagagaaagttggacgtagagctagtgcagtgcgtactctgtcagtcccgtagatgtaatcacagaaagtgaagacagaagagaagttgctctggctgtgtcctcccacgaaatggtggtagtcatggtactccactcctccatacaacgggatatacttggtcggatcgaacggcaacttgaacctgcttcaagtagagttttcggataattaagctaaatgctactagtctataaactaaggactagtaaatgttcattagctatataaatacgatctatgtctcaatttaatatgggctatattttcttatacgatctttagtgacatattctctccctattctcccccctccccttttctcaatgatgttccagcgagataaggaagacttgagtttttgcagcatccacgctgcatctgacacgacgtcctaatagtcattttgaaacggagggaatagaaatatatacagcgatgacgaggtttttacagtgagtacccacccgctgtggatgtggatggcctcgaggtggcgaagcacgaaccagagccagaaggtggtcatgtggcacggcacgatggctgggccggcgaaggccgggaagccgaggatgaggatctcggcccagtgggcgtacggggcggcgtagcccatgggcgcggtgaactcgtggtggactcggtggatgtggtggtaggcccacggcgtgtgcagcaggcggtggatccagtagcccaggtagtcctccaccagcaggtacaccgccacctgcgccgccgtctcccccgccgacggcagcggcagccccgtccgtatccccaccgccctcaccgcagggaacgacgccagctggaccggcccgacggcgaggagcagcacgcgcgcggtggcagcgtagcaccggaggaaggcggccggcgggtggcgcacgccgggctgcagcttgtgcggcagcggcaggtggcggcggagctcgagcagcgcgagggggagcggcgcgagggtgtagacgaggaggaggatggggacgttgtggcagtagaggcagtagtccgggatggccgccgagtagcggaaccaggccgcctccgcccacgtcaggccccgccccaccgccgcctccgcctccgccgccgtcgcgtacgggagcatagctagctactgccggcgacgacacagaggatcgatctccggccagccagccggcgagatcgagagctatatatatacgagtatatcgctctatcgctatatgctgtttggagttacggcgccaaattaacaggaatttgagcatgatatctagttttatcgctgcgtctctgtattattgggcgaggagggcagcatacgtggtcggactgtggcctgtaaattacgatcgagatatcgaattaaatccatcatttatcaagtgagctgatcattatctaaaacaaatagagtactccaatcaagtgagctgatcgatgggccagctgtatagtgcaacaaatggtgcagtgcgcgcaaagagaacgtacagtacatgtgcaagtcagtagagtaggcaacgcaaatcgttgtacagtactccgtacttgcaaaaatggcacgacgtacgcaaagtcgtggcgtacgttgtagcacgagtacatagtatagtacacaggaccactggacacattgggctcaccggccttgatattgtagtctaatagagctccaaaagtagctgctcaatagaggagagcagtggagtggtaacaacgcacggtgactcctccttcctgctcgttcagcccctttaattcctccatccatttcgacggctccggtcatcagcgatttggggaagagggtccaagtagtcgggttctttctgtagtaggggttttccctttgtcttctcttttcttttgatgtttttgtgtagtgcaaaagttcgcatgcgacacatttctgttatcccggtggcttgctatggattccggctaaatccatccatggaatggtcttcagatttaccatgaacgcctccaactataagtaaggcaggtatgttttatacaaagttgctccgactatcctgttcatctccaataaggcaatcacagcgatgcatcatccatcatcggtggtggatcttcagcgagaagctacgttgttactgtttttcatagaagccgcaacctccaaacggaggccccttttggatatgcttcctgttacttttatctgtagttactctttgttttatgcgtcaccgttgcatccagcttatcacctggtggagaagaaaggacttgattgctttttctagtttattagaagttcttcgtcctagtttcaagagcttatgttaattttgttatcttcaaggggtctgtttgcaaaactgtttatacttacaatttcttgcggtccccacgggggataactcgtgcgatatgtatctagttatctatattcaataaaatgcatgagtttagagagagagagggggggagtggatttcaggtgatctaagccattgattgattttaatggatcagattaagcaggttacttgcttctcccatctatacgagtgcacaccacatcctaattatttactttttttctaaaatataacaaacgtcaggagcagatcgaataatatgagttgttagatacatatttcctagggaatggagactataatattaccgccggttgtttttgaaaacatggcacatgcatgatacattcattgtgccatttaactttaagtatatagctcatcggcacggtgcacatgcatgctaaggtggtgaccacgcgttggggtttgacgtgcgtgcatcaataagtgacggaattaaggatgtagtaggccatggatggcgagcctagcggcggcagagagccacgagggcgccggtgacaccaacgacgggaacacagatgacaccacggttgtgtggtgcggccggccgccgatgggaccgccgcgcgcgatgggcggcattggtggggcatgacgggctagctcgatcgccactgtttcctcatctgcatgcgttcctagtcaaactcggttacagcaggtaattaattgtggcagcgaaattgtcatggtcgaattaaatccatcatttatcaactgatttgtcggccagctctattatataatgcgaaaatacgttgcatacggtggtgaatgttagtatgcgttggttcgttagaaacggccagaaaatgccatgggatttggctggcacacgttacgtctcgtacaagtatatatcgtacgcaaaataatcgtacgtatagcagctgtgcaaccggcgcaatgtgcgcggtaaaaaacagtatagtacatgcatgtgcaagttggtaggcaaggcaaatcgttgtacagtactccgtatacttgcaaaaatgacacgacgtacttagagtcgtggcacgatcgagtatacgtatacgtacaggaccacgtactatatatactggacagtaaggatcgatacgtacgtacggctcaccgggtttggttaattcaactctgataaatctgcgttcaatttcgttcctgctcttgggaactacttcctctgtttcacaatgtaagtaattctatcattttctatattcatattgatgttaataaatctagatatatatatatgtctagattcattaacgtcactatgaatgtgaaaaatgatagaatgacttatattttgaaacagagggagtactggtaatctctcgctgcgtctctgtatacttgtggagttttatgacgacgacgtggcgtacggacacgtacggtgccaaattaacaatttcacattatatatgcgtgggcagcgacaaagctagagtatattaggggtgcctaggaagccggtcaagaaaatgttttagctatacctcatctattttcacaatatatacacccccttagtataaatttagacacccgtatcaacttaaatttgatctcaagtataataaattaagcaagtggcaccaccctccatttcgttctagctccgcctcagcgtaggtatatatacatgtttccttcgtcgcatgcatgcaacagcattgcatgacagtactcttgactaacttattacttagctccttttttttaattattttcatatttctcaaactgttaaacacgattaaatctttgtatacaacagcattaataatgcaagtcagtaggcaaggcaaatcgttgtacgctacttgcaaagtcatgggctcatggcgttgtcgcacgagtacacacagtacgtacacagggccactgggctcactgggtttgattgaagtctaatagagctccaaacgtagctgctcaatagcggagaacagcggtgactcctcttcaggtgaaacaaaggtgactccttcctcttccttcggccctttcctccgtcgatttcggcggctccggccgtcggcgacaggagaaggggtacaagtagtcgggttctttctgtagtaggggtttttctttgttttctcttttcttttgatgtttttttagtgcaagagttcgccggcgtcacatttctgttatcccggtggctttctatcaatttcggccaaatccatccatagaatggtctccagatttaccatgaacgcccccagctgtaactaaggcaggtttgcttcatacaaagttgcaccgactatcctgttcatctccaataaggctactacaggaatgcaagcctccatcatcgatggtggattaatgtaagaagctacgtttttattgtttttcatagaagccgtaaccttcaaatggaggccccttttagatacgcttcctgttactttcatatgtagttactctttgtttatgtgtcaccgttgcattcagcttgtcacctgattgagaagaaaggacttgattgctttttctagtttcttagaagttcttcctagtaaatttcaagagcttatgctaatttggctatcttcaagaggtctgtttgcaaaactatttgtacttgactccccgtccccacgggggataactcatgtgatatatatatacatagttatctatattcaacgagtcaaccacaatcaatatgccacatcagcacagaccacctctaaaaccgtcaaaggagtcgatttgcaccggctttaaaaatgtgggaaacgttataaccggttttgcggttgagcgaaacgacccaatgggaatcaagaagggagagaaagtagactattccttaaaccagagtggtgacctggtcgaggccagcccgtacaggcccataaagcagacaagcccaaacaccgcacttgacaatatctccggctctccgctccgctctatcgagtatcggataggaaggaaggagacggcggcgctgcgagagatggaggtggcgggtgctcaggccggcatcctccccctcctcctccgtcaccccgcgtccctccggggctccctctccctctcctgcggcggcgcccgccggagctgggcggcggcggcggccacggcggaaggaggaggaggagaggagggtcgcggctacgagagggtgcccatggacacccccggcgcctaccgcctcgtcgaccgggccaccggccgcagcgtcatcgtgtggggcggcaccgacgacgtcagcatgccctcccccgcggtgctctccacgaccacgcgcgtccccgaccgcccaaaaggttccattattcaataccacttactatacagttgtgcaatgacaatgatttttcatcttcaaagtaaatatgttcccggtgcattatgccaacatttggccgtaacaggttgggtatgagattaattttaacgccttttagcaacggaacacgcattccttcatgccaatatgccatgtcatcagacatgaaattcactagattttcctgtattgtgtgatggatgtgttatctctctcagtttgcttagtaagaactgcttcactttcccaaaaatgaggccattttttttacaccacagaaaatgggagaagtacaagtattggaaattttggcagactcaaggcacagaaagttaaagttttagcaaggagatcagctcaccttaagagagaggattctggtcgcataagcaccagccggttcagtgaatctccttctgatgagtctgacgaagatggcacttattttgaaagagatagggcaagaaacacaaggcaaaacagtagatctagagacgacaaaacccgtggtgcgcattctctgaattctgtcttgaggcagtatagaggtgctgatgacttggattttccaggatcagaggctacttctggctccaaaagatggggtaacatttctgatgttacatttggacgacagaatcaaaggcaaaagggccctttagatagtgggtttttcagtcgaagatcttttaaggaaattggctgtagtgatgaaattctaggtgcactgagaagttttggcttccctcgtccatcgcatattcaggtaaataacttttcaaaacaaaattctctacttggggcagacatctcaagcttttactctcttttgttgtgaagaagaacatcttgaattgttgtcataagtgactgtgtatgtctgcacttaatccttgcactataacaatgagctttccttactatgcctaaaaatcttttccttaactagcctgttgcattatttcaggcgatggcatatcgacctgtcttggaggggaaaagctgcattattggtgatcaaagtggatctggcaagacattggcatatctttgcccagtagtacaaaacctgaggaaggaagaagttgaggggctccataggtcttctcctaggaacccacgagtggtagtactgacgcctacagctgagcttgcttctcaggtattttacaccttgaatgtgatcctgccaatgttcagtgattgtttttatgccaaattaggaaaagctggagtgctcattggaacatttttaatctctcaggtccttaacaactgccggtcaatatcgaaatcgggggtaccttttaggtctatggttgcaactggtggatttcgacagaagacacagttagaaagtcttgatcaagagcttgatgtacttattgcaacacctggtcgtttcttgtatctgcttcaagaaggctttgtgcaattaaataacctcagatggtatgccattgttgttcattttctctcattttgcagcttgaacttccatctgagaacacatcaaactaatgagtgaacatacttatgaacagtgttgtgctggatgaagtggatattttatatggtgaagaaagttttgaacaagtgcttcatcaattgattactgttgcaccactgaccacgcaatatctctttgtcactgccactcttcctctcgacatctacaacaaggttgttgaaacatttccggactgtgaactaatcatgggaccaggcgtccaccgaacaagctctcgtcttgaagaggttggccatttcttgctttcttcatttttgaaaaaaatgttcccaggagataccttttggagggtacatatttacatttgagaggttgaactgcagattctcgtggactgcagtggagatgacaatgaggaaaagaatccggagacggcgttctcaaacaagaaatcagcacttgtaaagataatcgaggaatctcctgtccgtaaaacaattattttctgcaacaaggtagttcctctccagtattccagcatacgatctgcaaccaaaaagagtttgcagtgtatctgacagatggattttttttttgtggtggtgttagattgagacatgcagaaaggttgagaatgcgctgaggcgggtggacaggaaggcttcgcagatcaaagtgctccccttccatgctgcattggatcaacaacagagaatcgccaacatcaaagagttcctgaacaagcagacggctgactcgatgttcctggtgtgcacagataggtaaggcatcgatcacctgaagtgaagcgcatgaaatcgattctgttttcaagcgatgatctgattggatttggtgggtggcatgcagggcgtcgcgaggcatcgactttgcgaacgtgaaccacgtggtgctgttcgactacccgcgcgacccgagtgagtacgtgcggcgcgtcggcaggacggcccgcggcgcgtcgggcaacggcaaggcgttcgtgttcgcggtggggaagcaggtgtccctcgccaggagggtgatggagaggaacatcaagggccacccgctgcacgatgtgccatgcgtctagtcctaaaaagagctctacagagcagagacagtttcaggtcaaatttgtgctagcatacatagcaccatctaatattgatgtagatagggtttgtgaaaccggttttgatgcatacacatatgctgatcgagtgaattagcatctgtctgtctgttttagaatggtgatgcatattggttcatacatacattcatagtgctagtagtagtaaatttcagtcgctgaccaactcacaagtggtgcagctgctgctgcttgctgtaaacgatggaatgtgcaattggttactacactactaactgagatgagactgctgctgctattgacttgggtggagctggagggagcaagcaggtcaggtgtggtcgtggcggacggtggcgaggaggtggagctgggcgttgtggaggagggagcgtgcctgctcgttggcggcgtcgcgggcgcgcagctcccggatctcctcctcccacctctccaccctctccttgtggatcctgcacgcgccaaattaattcacaaacaaaccagattgattatgctgtttgtcatcaagcaagccaattcaattattattatttgtgatggatggtggtcttacgagcagaggcggtcctcgaagtcggcggcgaggttcttgaacagcgcacgccccgcctccagcatctccgacacctgctgcgttgcattccagtccagcataatcgatcgatgaatgacaaatggcgaaattaatgaatggagagaggtggtggacctggcgagtgaaggcgtcgatggcgaggaggatgcgctgcacgtgctcctccgtctccgccgacgccgccgccacctcctcctcctcggcgacggccatgtcgtcctccgtctccgtcatgggcgcggtggtgatggtgacggcgaccccggaggaagccgccgctccccctcccgcgctcccctggctcgccatctcttcctctccctctctttctccttctcctccgttgctctacacgcatccatccatccatcccaaaactcagattagattcaaccatcaaattttcgaccgactcccccaaaatcaaaaatcaaatgcgccttaacaactgaactgattgagacagtagatgaaatggaacaagtcgatcggaacggaatcgcgtggccttggttcgatcaaagcaacgaacgcagctgacgactggatccaatccccacaacaaacacccaaaacttttcccaaaaaaaaaatacaaggaaaaaacgcaagcgcggatgaatgccatggcaacctcgccatctagcagtcagaaataatcacccaggagaaggtggagggagagagcagtagccagtagggggtagggggtttaggtttaccatggcggcggcggcggcggcggcggcggtgcgcatgcgcttggtcccggccgcctccatcgtctcgcccccgccccgaacgatccatctgctcggaacggaattacataaagtactagtagaccgctgggctgggctgggctgcgctgggttgggaggacggtttggtcaatggactgaacaaaaaggaaaaagtgcactgaagatccctcaacttatcatcgaattacaaaatcgtccttaaatcgtaaaaccccctgacttacaaaaccagtacaaactaaatccctcggcaattttgactccggttttatccttagggggggccacgtgggtcccacatgtcagccccttcttcccctcccctctcttcctctctcctcttcttttctctccctccgccactcgacgcccaaccgagcgcgacctcgccgcgccgcccatggtcctatccacgccgcgtcaggaggaagcagagaagcgtcggcgagtaggtcgtcggccggccgatggaggcagcgacgatcccgagtcgaaggtgcagtagagatggcaacaggatgaggccgagaggatgccgacagtgaggttgaccggtagggggagtcaagattgtcaggggaagcaatagcggtggccttgggccttggatcccggtggcgaggtcgcgctcggccatcgagcccacccccatggcgccccggccatcgatggccggctccgagttctcctacgcgttcgcaatcgtcgccgatccaatctgtactctgatgaggtagcactctaatacatagaaaataagtgctttgaccattctgtccaccatttatcaaaggttatgtgcttggattgatggaggccgatactgccgatgttagcggggacagggaccctatattttaatagttttcccataacaaaggtcatgacgaattttcatgttagtggggcttctctgcggccaaaaagtctgatcacgtggcatcaccaccaccagctcagtgctgcatgttccccatataggaatcactgctgccatgcttgtttatgggtaactgcataaagaactggcactctctctccgttttaaaaaaagaacaatcctaagatcgtaatgtaaaattagtccggagtaaaaaaaattcccaaaatatcccttcgttattggaaatagtgattggtttgcaacttggcatcagagaaggggatagcgttggcaccttggcagcagcaaaggagaggcgcagtcaaagagagtcacgcacgcagttaggggaagcaggcaaggcgagttgggagaaggagaggaggaggagcgagcaatggcggcagcagcagcagctttgcccaccgctgccgcttttccccacctctcctccgattaatcccctcctcccatttctccgcctcccctacctactcgcgccgccgccgccgccgccgtcgcattgggcggcaaacggcctgatggagcaggtaagcgcttccagcgatctgattcgattcctcttcttgggggactcggggttttgatcctgcaaacctttgcagtacgaggaggagaagattggagagggcacgtacggggtagtgtacaaggcgcgggacaaggtcaccaacgagacgatcgcgctcaagaagatccggcttgagcaggaggatgagggtgtcccctccaccgccatccgcgagatctcgctcctcaaggagatgcatcaccgcaacatcgtcaggtcctctctattaaccaaccctctgctgctcttgtttaggactttggattcacttattaggagtagtcatcacggactgattgattcattgattgatgtgcaggcaatgcattgagctacaacactagctaggcctgattttaggaccattactcatagttttgtgcagtgtagtaataatgctgtcactttggcagcgagatgatttgcattgttgctttgctgataaactctatcactgcgtgcaggttacacgatgttatccacagtgagaagcgcataggtcttgtctttgagtatctggatctggacctgaagaagttcatggactcttgtccagagtttgcaaaaaaccccactttaattaaggtgagcggccctaaatgcaaaagtatcttgtcatgactcacttttattcttttctgcatatggttgaactcaaagcattggcttgagcattattgatcaatggtttgtttataacttggaaacaatgtgaaggtggtataagtaaccttactaaagaattactcttggctgcatagaccaaaatgttagtcttgtatcttctcatttcatctgaaagaattcagcaccgatgttattcaagattttggtgcaaagatgtatgtggaacccgcagtacatcttatgctctccatatttggtgtatggactgttgactagttctgtcgcggtgttacatatcataggaggaaggtgcccggtttgtcattccactagaacgatacttagcataaaccagaatgcacaatttgggaaataggacccatttgtatgttacttcatgcactcttcatgtttggactgctgctctgtgactgccatgattttttaggaaaaatgtgcatgtgctctttggacatatatgtggctacgtgcatttaaaaaactttagagatgcaatggactgacattgtttgggtaaggttgggcttttcgtattctcattcgcctatcagtaacatgataggaccagttcataagcaaattgttttataatacttctgtgctctccatggccaaaagtgtctggcagcgtggcaccaccactaccagctcagtactgcatgttccccatataggaatcattgctgccatgcttgtttttgggtaactattcagaatttactgcacaaagaactggcactatcctatttccttccactattttttttgggtcagaactatcaattctgacagtcaagtctgggaccttgggtcaaagtggtctcaactcatcctgtattttcttgtcctcattagcatcgcatatactttgaatctttgttcataaggtattggaagtcatgatgaaattttcttaaatatgaaatgtggcaacatgcttttatcctttgaatagtgtagcttagtagtatgaagttgatgcaaccttacttgatcgaagtgtctgccttatacagtgaaacaaagtaaagattggcatgattggaagtttttcatgcttttcttcattattgtgtctacattcctgttcatgcgaaaaatatgtgtctaaattcctgttgcattcatgcttgaccagaaagtgtattagtttattgtggttgcatcttggaatgtgactgttttcttctttcgccagtcatatctctatcagatactccgcggcgttgcttactgtcattctcatagagttcttcatcgagatttgaaacctcagaatttattgatagatcggcgtactaatacactgaagcttgcagactttggtttagccagggcatttggaattcctgtccgcacatttactcatgaggtactatagatttgtgttcaacattttgttttcttcataaagtacatttttttttcgtcataaagttcatttttcatttaccttttctatacactagcacattaactcacaatggatgtctatgggaagtatttttcaggttgtaaccttgtggtatagagctccagagatccttcttggatcaaggcagtattctacaccagttgatatgtggtcagttggttgtatctttgcagaaatggtgaaccagaaaccactgttccctggtgattctgagattgatgaattatttaagatattcaggttctattatcgtactgagattacctttttttgttctgttatttgtgtttttgccaactctctgatttatgtggtgtgttctggttacttttgaagggtactaggaactccaaatgaacaaagttggccaggagttagctcattacctgactacaagtctgctttccccaagtggcaggcacaggtatgacaaaacagcataaagattttattaggcgggtgaactgcatccatatactgtgccactgatattccttgactgaaatcttcatcccaggctcttgcaactattgtccctactcttgaccctgctggtttggaccttctctctgtaagtcgaacaccactcacctttgttcattagcatgtcataatatacccccccaaaaaagaagagtatatcatcgttgtctcgtttcactgtcagaaaatgcttcggtacgagccaaacaaaaggatcacagctagacaggctcttgagcatgagtacttcaaggaccttgagatggtacaatgaccctgctatggctttacattgaattggcttatgtatgggctgggctgctcatttcattccttgtgtgaacgctgtgcccttcgtttgggcatttttgtcattcagctggatatatttcaaatcttgtgtgtttgatatgtatattcaggaacgctaaatagatcaccgtcttggcctctatttgttgagagtaaatatcttccaatgactgcctttcaggccctgtttagatcctccaaaatggtaaaacttttaccattttagatctaaacactagtagtaaaagttaacaatttggtatttggcatttgctagtctatggtagcaaattttgccaaaaagtgctccggaaccacaccacctctctctctctctctctagtgctaaaatggtaaaactttaagatgtatctaaataccaactaatacttttgtaatgttaaatcttttaccatcaaaactttttaccatttgccatttcaaatagatctaaacaggccctcctattcagaaccaaatagcccttcgttgctgttacacacacctttctggtgttccactgggggacacgcatcattggtggtcagcaagatcctttctcgtcttgatgcatgcgttcgacatcatcagaccagagagtgccacaacgactgatcatgaacatgcactgacaaaaggattccactaccaaacgaaaaaaaaaacaacgtattgattatagtaatgtattgatcgggtggttaattctaagctagtgtaatgaaaacggagcacgcatgcacgtgtgtgcaattggtttggatcatggaggaatggagcatttgcatgcattttgcagcaggcctttttccgcattgttattatattgcaattaatatgcttaatgtgcttaattgccgcgcgaggagacgacgagtgaatagtagtccactcttgtctcgccggcgccgccgcctccatcgatctcgatcatgtatccattggcattaatcaatcaatgccactactccatctatactactcctaccatgcatgatggacaaccttactctagctaggttggctaaactgattgagaccatgagacctactcttaggcaaattgatggccaataaatttatgaagagagaaggaatgagttttatctagatgatacggagtacttgataatttacacacttacctatgctttggaattaaataataaaatgaattttcattgatcatagtcttgaaaacggaaataaaaccctactgtgactaaatagtttcacaacaccattcaagaattaaatgctacaagtgataaattaatgaaactgtgcactagagatactctctctgtcccaaaaaaaataaatttaggactgtatatgacatattctaatacaacgaatttagacagatgtataaccagattcgttgtaataggatgcgtcatatccaatattagtttgattttttataggacggagggagtatttgtttcattcatcaattcaaacattaatttttagattatatggtactcgtgaaaaccacacacaaaataaaactctccactaaaattgaccttatacttgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatgtattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaggaggctgcatctgcgcaagggtgaggagccaatttttcggaccattcgacgtagccaatttttcggaccattcgacgcgtgcacgcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaggaggctgcatctgcgcaagggtgaggagccaatttttcggaccattcgacgtagccaatttttcggaccattcgacgcgtacgtcgtgcacgcgcgccgcctgccaggcgaggcgagcgagcgcgcgcgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatacttctacgtcgtactcagctcgatcagcagctaccgagctacgtactctactccaagtctccaattaatagggctcctgaagtcctgtatccaaatcaaatactccctccgtcccataatataagggattttga

SEQ ID NO: 69354 - DNA, 29081 bp, Oryza sativa
  unsure (1)..(29081): unsure at all n locations
caaacggtacaaacaaaaactcaaaatctcttatattgtgggacggagggagtagctcatcaacgactccgctgacctgcagctagctcagttcgtcaaactaattaattaaaaacagctccaactgattgcagtttcagagcttagtatatataaattctcatgcaatgcaagccatgcaggagatcatatatgtacagcaatcctatatacatacatcagctagctagctaggccggccaccatcacatatatcttggcatcctgtgctacctagatactgatgcttttgtcctatatgtatagctagggagtatatacagcattcatgaattaatagagacaccagtccatcactgtttgtccatacatgatgagatatgaacctatatatatacattagctagctgttatcagaccagcaggagtgtaggactgatagatcatatacttgcatatataagcacgtaactaattaaaatgatgaatttataactagcagaagcttgtgtgttcagggggcaattttgcttctcagataatgcactactacctttagcccttgtttagatccaaacttttctccaaactttcaatctttccatcacatcaaaactttcctacacatataaacttccaacttttcaatcacatcgttccaatttcaaccaaactttcaattttggtgtcaactaaacacacccttcctcttcgatgtcatggagtcacggtcaatctagctatgggatatatatatggcgatgatccaatcatggagagtaactaattattgtactactagtagctaggtagctagctagcttgctacgtacagcttgcttggttcctctttcatggatgctttcctcatgtatgtgcattgcatggcagtatatgtgatgcaaactgttgagctaccttgctccacaccgccaatgtattctaaactcaaagtcatcctctgacagggactcaacacacgtacttccacctcagttgctagcatatttttaatttgagatttgctagtttgcaggtgaatgagactggaattcgatcccttaacctagctagcactggaattggaaggaggagggaaggaaacacgtacgatggccactccgtagcggtggcggcaatgacagcgaggtagatcgtcatcttctctacctacggcgcggtgctgatttgatgaggttagagtactttagggtttcgaaggttagcactaggttgtgcgctgcatgcgtggggggaggaaaaaaaaaagagagatgataagatttactgttcatgctcaaatctctcaggatatttctgaccatccaaaaattaactgatatgcacgtctgtgggctccgttttctccttggagatatcgccgttttggctctctctctcccttcaggtgaaaaccgggttcttttcggaacgggtgttgatagcacccttaatgttgttatcttgttgaaggcttcgctcagaaggtttctgccctgctagaggatgtttggtggttctggagacctcgttcattatgttgttgaagctgcttacctttggtaagctcggcaacgacaacttttatgaggtctcaatagttgctttctttttctttctttatagatttttgccagtttcccgtttaattaaccgtgcttattcaattttcgaatccggtttcccttattaactaggccagttctcttcttctataaatttcggcaggagaaactcccaccgtcggttcctcgaaaaaaaattaactgatttttttattgttttcaagtaattaaccgagaattagacagtcctttcgatttacaacattatattgtcagaattaactgcgacgtggtttttgcagctagctagtattagtatatgtggggagaaacaacgccacctgaacatggcaaatatgcatgattcataagcttgtctgagtgtgcatgtcagacagattgagggccgctggtgttgctttcaagccctcaagtctcagcaacggtcgtagtaagcatacagttgagaactttgtcagttatagtagcaccgtggcagaagcaaaaaccatggaaacacatgctcaagcatcaccacctgcagctgccgacaagtttgctagttagttgtacaattgtgttaacacatagctagctcatcattcgtgcatgatcagctacacaagtacggagtactactcatagatttgtactctgctgttttctgaagcaaacagtaacctgtaccgtctctaattgttccttaattcgatacatatatactagcgtataagtggcgcattcgcaccactttaaccgttctattgtttttgttttgtgcatgaagatattatgcgccaggtaaaattaacgtaaataaagtggtgtcaatctgatgccaacagttatagttagttgatggctttgttatggaaatacatcatcagatgagatctatgatctatcagtaatgtcttgatcaacgaagttgatgattatgcagatgaaatcactaagttgataatgattaataagaaagaatcagggatgatttacgaatgatgagtaaaatatatttaggattgattaattaaagatctagatgctgatgatcgaggcattgttttcatgattgaaattttaaaaggaggcagtcaattttctcgttactttgagctcaaactttgcatgcagctttatgacctgccaaaaaagaggagaacaatatttagcacttgtagatattttgaattaaaaagtaggatgcactgtctcttagtattgaataaaactgaaggaaaattatgcaaccaaggctagtcatgtttcagtatagaactgttcattcaacatactggagcaaacttttgtgactgtcagactgagcttcttctgtaaagttttattgtgtgaattgtctttcttgcatcttagaatctgtttgcagtccatatatattacaatagctcagcaagatatgttttcatttattagaagagcaaattccatttaggctcataacagaagcagtaagggcatatcagacctatacaacaaccgtgtggttcatgttggtgagcaggaaaaggatggccagcagtaggaggcctcacatatttgagctcgatacggtattttggggaaatttctacgggggcaagaattcagcggccggagaggtcgccgcagcgccgacgagtacgtagttgctgcattctattcccccacggaggcggtttttttttttttttaaggatgtgggaggactgaagataaacggaagtttcttgaagggccatgatcaagatattcagagaatccaacgacccctgtaacatccggggagaaaatcgagcggtctatatttagttgatgacgtggcatattacttttgcaagaagggtttcacctttcactaggtaagataagatatggtccctgtacaacaacaatctagctaggagctagcacttttttctatgaagatgaactggaaatgatagtagtaatgaactgaaaatagactgccaatctgaactttgtcacattcaggagtacttatttgggactagtgtgtgtacgttcagagtgtttacacattacactgactaaaagtaattaagttgcactgctgttgtacatatcatgaatgaagtcagccaaataaaagaacgcgccttcatttaagtatgataaagatatgatatgaaactggcgaaacaggacagtacatcatcatctaatgacgagaaatgataaggaaagggaagaaaattcatccttactagtactaatagcttgtgacagcctccgtcgtgtcgcattgcaacacattctcccacacgtaacaacctgaaaaaaaatactcatcaatacaattcagtgagtagtactacctccgtctcaaaataagtacagctgtagatatccatgtccaatatttgaccgtctgtcttatttaaaaattttatgaaaaatttaaaaatatttagtcacacataaagtaatattcatgctttatcatctaatagcaataaaaatactaatcataaaaaaatttcaaataagacgaacggtcaaacgttgaacgtgaataatgtaaaactgcacttattttgggacggagggagtagctatagcagcaacgggagcagcaaagatatctatcgcgcgcgcattcgtttgaagccaaggctagcgaacccctcccttaatttcgcttgcctgaatatataaccaattataagcacatgtaagcacacaaaattaacagggaatacatcatcagatagatatcatgtcattccccgtatatacatttcctctagttcgatcagtttgggcattcgatcagatcaacacactggttttcaccctgcagtccttgactctttgttaactactagtgtaaattactttttagaaaaaggaaaattaatctttagaaattagttaaggtgagtatatatactaaaacacatgatttcttattcttcaattctgtgctgtaaaaaaaatccaggaacacgcagacttcgtatatagacactggtggagaaaggggttttactcccggttcgtaaccccttttagtcccggttttcaaaccgggactaccaatccgggactaaagatcgatcactatctttagtcccgggtgaaaaaaccgagagtaaaaatacatcccggttggtgtagaacctttttagttccggatggtaacaccaagcgggactaaagatagagctagcctagctagctagattcggttgctctattattattttcttttcttcattgtgtttttaatatattgattttactctatccccatctcaaaatcccaaatataaattatccccaattctcatatccccaaatcggccatattcaaatagatcacaaaatcttaaaacaaaattacatcacaacttctacaaaattcatcacaaatacatcacatattcacggacatcacacacaaatcaaatacacagatcagaatcacaaattcttaaaaaaaagaaaaaaaaacacaggctgtcgggcgttgttgcgccggccgccggcgcgtcgcccgccgcgaggccccgcggtccgccggcgcgccgcccgccgccacgaggccgccgcccgggcctccgccccgccgcgccgccgcgaggccgccggccgcccgatgggatgatggggagggaaggagaggagttagaaaggaggaagaggaagggattatgggggagggaaggagaggagttagaggagaggaggaggaggaagatgaagagatgggatgaagagataaggtcagtggaggaagaggtgaagagataaggctgcccgtctcctcctcctcgatctcgcagatggcagatgcctcatactctccgctacgatcttttgttccggttaccaaccgggactaaaaatagatctttagtacaccaaccgggactaaatatagtaggtatcttttttcccggttggtggactaaaaataaagattaaaaagcagctctaaacttttgaaccgggactaaagataatctttaatcccggtttttattgcaaccgggactattgtggattttggctaaccgagcaaagatggtttatccaccagtaagatcacgacgggaagagattaatgtgcagtatagtcagttttgtgtcgttgaacagccttaagcgcccttaatgttgcaaatatacacgctcacgcacgaagtgattgataatagcacacattcaatgcaattatgctatagctaactattacgtacgtaccgatcgagcagcttgcatcgtatgactgtagagatgattcagactagaacagccaacgacatgtagtacagtacatctttgattaattagctcatcatgcatcgattgctatctacaagcttccaagatcaataagaatcttaattttccaatatatataaaaaaccagccagctgcgaataagataccgacaaagtatatactcccttcatttctaaatatttgacaccgttaactttttagcatatgtttgaccgttcatcttatttaaaaacttttatgaaatatgtaaaacttatatgaaatatacatataagtatatttaacaatgaatcaaataatataaaaagaattaataattacttaaaatttttaaataagatgaacggttaaacatattttaaaaagtcaacagcgttgaatttttagaaacggaggaagtatgaagttaggcacgcatgatggatatgcatgcgtacgtacgtagcttacctatagctaggtatatcttggtatgtgtatatatatacgaccatatccgagggcagagctgcacgtagtgttcgattaattcttgagctcatatattacttattcatccaaatagtattggtagcttgttgatcgaagaattaatccatggatggattgatcagtgatgatagtatgatgatgggtggtgaggtgagggcgatcgagtcgaggctgcctccgggtttcaggttccatcccagcgacgaggagctagtcggctactaccttcggaacaagcagcagcagcagcagcagcagacggcggccacctccatgctcgtcgaggttgacctccatgcctgcgagccatgggacctaccaggtaatataatacttaccagttaatctactacgtacagtagtagactaattaattaattaattaattgataaactttgtgaaattggcatatactcctatatgtgtagaggtggcgaaggttggttcggatgagtggtatttcttcagctggagggagaggaagtacgcgacggggtggcgcaggaacagagcgagcaagcaagggtactggaaggccaccgggaaagacaagcccatccttcatccgacggtggccggcgccaggaagacgttggttttctactccggtcgcgcccccaacggccgcaagaccgcctgggtcatgcacgagttccgcctcctccatcatcatcatcatccaaacccaaatgtaattactcctaattatattatatatatatgcattatatatgtagctaattaatctgaatgtatgtacactgatctctgcatgcagattcagaatatgcagcagcaggagggggatgactgggtgctgtgcagggtgttccgtaaggggaacaacagcaatggacaacctctagccacttcttcgccacctgctcatcacctggtggagtcactcatcagctcacctgcaccaactatcatgagcgatcacgatcggctcttcaccatccagctgccgcatcaccaacattgtgatgagcagtactttttcttagatgacgatgaacagcaccagcagcagctgctagatctttcagtgctccaagctccaacctcgttcgagtctgagcaagctccaggccacggtggcatggagattaatatcgcagagatggagagcttcgacacgacctgtgctgcgctgcaagacgcgagcgattactgcatgcagctctattaattaattcaatggatggatgaatcacacgtatatatacgcatagccttaaattaattaatgtgtatcatcagcttaattaattgcgcacttggcttatgctgcttgctcttgctttttatatacgatacacaatcataaaaacatatacagtgcatatcatctacgggtagtttagttgggcagggaatgcttagattcagaaactgcggactgataaacagcagcaataaattagctgcttgaggacggaataatgctcagtgtagagtatatggatgttatctgtttgcaagatgatattttgaagcaaaataataaaatatagatacatgtatggacaggggcggatccagaaacaaaaaattgagggactcaattacacagttttttcaacctctagtcatttagggacctttagtttattattcatggtgaaaaaattgaagggggtgcttcgggggtatccatgggtcttgtgggtgtacgggggctcgagccccccctgcacccacgttggatccacccatgtgtatggatgttatctgcagaataatgaataatttaaatgatattttgaagcagggtaacaaaataaaaatatgtatggatgcttatttgcagaataataaataatttagatggtacttttgaatgaagcaaaataatggaaatttttagatggtattttgaagcagaataataaatttgaatttagatggtaattatggaatccgtcacgatgttgtcttccgtggagaatccccctctctgcatagactagcttctaggtgtatatgcaactttgtgggcaaagagacttatttgtgctgacaggatcgttgtagaatcctggaaacaaattctttcggaattgctaaaaatatgtcgccagttttttgggctgattttagtcggtgtcgctggccgtatgattgctccgcgagtatttgctggtcgttggatgttttcacacacggcggcattgcggcaagccctaatcttgtttgttgattagcgttaaacattgcactcatatcttctcttatacaagttacatcacacttacacaccacttacatatgtaattagtatataattttagtatttacatatgtaattttagaacttacatatgtaattctaggacttacattgtaaatacactaaaattacatatgtaatttagggacttacaatataaatacataccgactattttttggtgaaaaatatggcgccataaatatagctactcccaattctttccttccccttttgcacaatgtaatctaaagctgtgtacttctcctatctttcaatgaaaatataggtggggagaagctcccccctggtgaccagtcaaaaaaaattagatggtacttttgaatgaagcataaaaatgaaaatttttagattgtattttgaagcataatatatatatatatatatatatatatatatatatggtggttatctgcataataataaataattaaatgatattttcaagcaggataacaaaaaatgaataataaaaatatgtatggatgtttatctgcagaataataaataatttagatggtacttttgaatgaagcggaataataaaaatatgtatggatatttatatgcagaataataaaaaaattaaaaaaacacgtttgaagcagaataataaaaatatgtatggatatttatctgtagaataataaaaatttaaaataacacgtttgaagcataataataaaaatatgtatggatgtttatctgcagaataataaaaatttaattttaaaaaccacgtgtgaagcagaataataaaattttaaataataaaaatatgtatggaggtctatttgcagaataattaaaagtttatcggcagaataataaaaatttaatggatgtttatctgtagaataattaatagtttatctgcagaataatataaatttaattttaaaaaccacgtttgaagcagaataataaaattttgaataataaaaatatgtatagatgtttatctgcagaataataataaaaattttaaaaataatattaaaacccacgtttgaagaagaagaataaaaatatgtatagatgtttatctgcaaaataataaaaaattttaaaaacacgaaatctgcaaaataataaaaaaattctaaaaacacgctagaaggagggcttgaacctccgaccttgtggttaacagccacacnnnnnnnnnnnnnnnnnnnntccagcttatggttacaaatttacaaactctgataatatcttacttaaagccaaagaatattctgccctgcacttgcacggactgaatgctgtcgttgacactggcatactactgtactctattaagcttgggaaggaacatttgcaactgcgccttctctctctctccctgtgtgggcttgtttacttttttaccatttataaattttgacatttctaacatttggtaagatagcaaacttaattataacactaaggccgtgtttagttccaaagtttttcttcaaatttctaacttttccatcacatcaaaactttcttacacacaaacttctaacttttccgtcacatcgttccaatttcaaccaaacttccaattttggtgtgaactaaacacactctaacaacacaatcctaccaacttttgaaaatttgaaactttccactcacaaaacttcaatcaaaatttgataaggtattaaaccaaacatcgcataattatcttaccaaaaattagtagtaccgaaatttagcattgccaagtattaatgagatttttttctaatgaaataaacaagctctgtttccatcactaatatttcactatatcaaaaagatccatcatcaatactcccccgtttcatattataagtcatttaacttttttcttagtaaactttttaaaatttgaccaagtttataataaaatatagtaacattttcgatacaaaataaatattatatcaaaaatatatccaatgttagatttaatgaaactgatttggtgccgtagatattgctatttgtcatataaagttgatcaaacataaagaattttgaaaaaaaagataaatgacctataatatgaaatggacgaagtactgtatttgtttatgttgtttgtaacaaatcagacaccttgattcttttcttgcagttaggttacttgtgttaggttatttgcctaactccatataatactgtgtctttcagtcagacctctattacaaacaattctaatagacagagagtcagagatggcggagccagaattttttcaagcatagggctcaatttagttgaatttatataattttgcctttatcttctagtttttgaagttttaaaatggaatttcaatgcatatttaggatcaggagtagggctacagccctagctgccctactcctgtctccgcccctcagatatatatacagtacagccatacagggtggcagatgcatactacagtgtggagtccatatgttaaagcaagtgcagtagcaattgaaagtatgttactccactagtcatggattactgtgctgaatatgatatatttattccctgtgtctataaaaacggtgtatgcgggccatggcttccagtgtactgagccaatcggcccaacaaggcccacgtgtaagcacagcagctgtcgtcaagagatgaattcaattcaaacctgggctcaaatcagcaacgagatgcgctttagcttccggcccacttccccagcccgagacgaagtccgtgtcgtatccctcccagtactaccaggccgccactctcctctcctcaacgcaccactccgccgctcccccgctcgggcgcggctctcgtttcccgaaccttctagaagcttggtgctcctcctgctcacctccgccggcgacgcaggtgcgatctctcaactcgtagcctcccctggttcgcacgattcggttccgatcaggctggctctctcgtttgtggcgattcgaggcgatcagctttctcgagacccttcggcggcttgatctgggattggggagttgacgcggatttgcctagtggaattcactgaatagctcgttcactatatataatccgctgggttttggtgggttttatgggtcaactagtttccagagctagcgctcgattggttacacccattcaaaatcgctggttcaattgttcagatgcttgatctaaccattttccttttttgatacggcatacttgatctaaccattcaaaatcgctggttcagtcgtttaagtatctctgtgtagtgtcaatgtgcatgtcttaggattcatactctgatgatttttcatattggacttgtttgactatagggacaccatctttgggcaatatattggcacttcgattttacgaggtatgatagtctgatgtaatgttgttcatagttctgactgtttatgattcttttttcacaaatgtgctctcgtgaatatttcaccgatatatgctactcttcttctaatatgttaatgtgcaaggcttttgcgcgtacgtgaaaaaacaaacacaaatgtgctgtcgtaactactgtttatctaaagaactttccatgtgcataccgttgggtaaaggctaaatttaatgttgttcctttaacaggcattaggaagtgatttattcttctcttgaacagaccaaattggccatgcatatgtggtatccatgattgctaggggaattagagttatgacgggttcagaccagcctgtcgttctgcacatgaagaccttaatggtgttaagaaaaatttagttcaaggtgcgctccctattatcaaggttagagtcttgacctatattgttctaaccagaggtgcctgttcgagtaaaatcagttcatatgtcatttgatactttgactttaaatgcaagctattactttgttcatatagctcaaatgaggtcaaacaatagtagaatgctaacgttggcacacaattacttttctgatgtaatcccgtgatgatgcacaatgtgaggctaatatattctgacctttttgcagtggcactggtggggacatatttactcagaatggactgttgtttcttgtgcacgttctgttatcacatattcttctgggaaaaagagtactgctggcaatcccctcccctcttcctcttcctcttatcattaaaatagctgtgaatccattttttttaaaaaaaaaaaacatgtaagaccctgaatttgactttaatggagaaatttgaaaatatgcgtagggaatccctgcatatgcacactcacctaatctcaaggagaaaaactagttattccaactaataatgggctcgaacttggtgaaatatgatttgtacagcactacagccaaacctcaagtgcagccattcgaccatgttaacagcaccatttgaaatttttgacacaaacaacaaacttgtggctattcctatctatagtaaaaggtcggaatagattttatcaaacaaattgatcttgtcctacaggattcagttgatgctgttaaaactggaatattgtgggtggatggatgcattctgtgctagttactactcttactctatatgcgttgatctagtcgtccatgcattgcttctcgctgagttgctggtgctttgtgagatccagacttttctgaacaccattctatcatatatagagaagttagttaggatgtctttcctgcacgtgcagtattttgaatttcttctagaattgccggatcatgaataccacgaatgagattatgaattattaagtgcaacaagggcagcatccttacgtttccagtaaggatgcatcgttagaatagcattcgccagcttccaaagtatgtagaatacatgaacctgatagccagatacgctggcacgagtatgtctgttactttacatacggcaaaaacgttaagccagtcgatcggcagtttgactctgttaaatgttcaggatcagatttagcacgatggttgttgatattctgatatgcatgtcaggtttgtgcatacggtttccaatgcatcttggacacgccagcaaccaactttacttgaacctcatggagctatcatcaacatgaggatgctatattatccctgcgaaaatcccagatgcagaagcagacaggctcagaacgttactgtgaacacgtgcatcgtctgcaaccgggaaattccaggtatttttctcagatcatatgacccctaaccgctgtcaccctcccaatctctttttcatgaagatggtcacgacttttggtacttactgtgcaaatacgacgtattggatcgtgcatccctttaattaagcattggcaagttttttgaatgacgaattgacgactgtcgttaaatcccaagatgtacctggtaacaatgtttaccactgtctaatggttgttactcgatggaaagatggtagagattggtggggtaaattatgagcaagattaggaatcaacacggttaggctgggacagggtactcacgctcatccctaaacagaacttatacttgtttgctaattaaatagtactattgctgtgccatattcaacattcaagccttgtttagagcatgggagttctctcttttttttcccctgctagaatttatttcactcatagttgcactaaaagatgtagaacagtagaactgtagaagagatcgttgttcccccgactctaggcccatggagtgacagtgcgttgatactcgatagcagataggatagagagttgcgttgggatgtcagtgtcatctaaccttgtgtagaggtgacggaccggtaccaatgaagctgtgagtgctgtggtgcgttgatgcatccataattcatcaaaacatgaaatagacggtggtcaggccgtcagcgaactatcagtgacaacgtcatcaatgccaactagaaccatatatataacccaagcctctatggtaagtaaattgcctacgtaagacaataatatccgacgattagtgatatctgggttatttgttcacaattgttgacgactagttgtaattcctgttggcggcaagtagcccaaaactgttgggataataatgtgatggatataatatcatcctcaacttgatacaaaatagtggtgataggccactattgttattgcaacaatggtaacagggtattgacactaccacgagaatattgtgctgctaaaatagctagagaataatatgggataaaatagagaacgtctctctagtttattcctactagaggtgatagtgacgctattgcactcgcaatagcaatagcgggttattgacactaccatggaaatattgtgttgctaaaatagctagagaataatgtgggataggatagaaaatctctaagtttattcctacttgagtacggttttatttgtgttgaattggcatgggtctggcctgttaagcctgttggtctgaccaggcttgggctttttatgcttacatgtacccgtgacaacccctttttttttaaaaaaaaaagtgtgcactgtaacttcgatttttttaagttggaactaaggtatggttttttatgacttactctaaaaaaaattgaatttttatcaagttgatttggtgccagcattttacgttaatcgatacatatgtatttcactggattctttataaataatgatgtggttcattgaaacggtgtgccaacatatatactctaatcgagcactttgagaaaacttacacgtgtattagaaacatctgactaatgatttaagtaaatcatgttataatgatttagattggaggttcctttgattgaaggaaattcaaagatttttcaaaggattctaagccttaggaatttttccttttgttgtttgaaaaaaaagggatttgagcatatcatactcctatgaattgctatccattgcaccaattccataggaaatttttccatgagtccttctcgctgcttggagtctgtttttagccgccgtaatttctctaagcttcagttttttcttcttttgctttttcttccttcccctagcataagacagtctagctgattacgtcgtgtaactaaaactctttttcttctaatatattgacgtgcaatcattttacgcgtttgcgaaaaaaattttccacgaatccaaacctcttttttatttttcctctgagaagcccaatggatctctcttaattccatcaaatttctatatatgattaaaattttaatatttctgatattagtaacaatagtacggacaatatgtacggggttaacaattagtatgtgtaattcaataaaataagatatgcacatatacttttgctgaactttaaatgttatcttttgtggttctttgtctgcatgcccaatagttcgtaggcactgtcgagagtttagattatactccctccgtctcataatataagggattttgagttttttcttgcaacatttgatcactcgtcttattcaaaaaaatttgaaattattatttattttatttgtgacttattttattatatacagtactttaagcataactttttgttttttatatttgtaaaaaaaattgaataagacgagtggtcaaacgttgcaaacaaaaactcaaaatcctttatattgtgggacggagggagtatataacatcttctttagaaaatggatagaaatctagcctctatatctacaagtgacatacaactaaagtttacaggaatactagattccaagtctcataagtgagaaaacaaaaaacaccacaaaagaacaaaaaaaaaaactaaaacactggaagactaatttcaaatttagatgtagaggctgggttttaatctattttttaaaagaaagattgtgtaggttaacttttagtgatgttagatcgatttgttggacgtttttggagcgtgcattggatagggttagaaaatcatcggccatgaatctcctagtccattggtggctcatcaatcatcgtattgatctatggcaccgaccggtgagctgctgagtcggaatgggtggggagtgaatcggaggacactccagcagagtccaacactcgagctgcctgcctacgcaaccgccggcggcgagaaaattgaaatgatgccacggccaaaggcggcgacagcggcagcgctgcaggctcgatccctcgctttctgtccctcccctgccggggctgcaatattacacctgcaactgcaagcatgcaatggcatggcattttggatcatatctctcctgcctgcctgcctgcctgttgacatgcccttcacgaccccactcaatccgcactcgatttttttttattttgaaatatttaaatttttaattttaaaaataaacacttccaaaatttattttcaagacctgtttgagctgatctggctggcatgccaacgttacctgatcacgtcacgttgacagcgtttttttttaaaattacacagtacaacgtagacactcacaacgcacgcacactcacccgtatgagcgcacgcacgtaaaccttaactctatgagcatcttcgaagaataggccggcaaatccattctggagattgacgaagtcaacacagacgcatcgttgtcgacgagtacgtcgcgtaccactgaaagcacaaagccattaaatcctgaaaaatttgctctcattgggagtcaaacccaggacctaaggtgctactgaggctcttgtaaccactaggctacaggctctttcgcacgttgacagcgttatttggccatgccctgttatgtccgttgtgtgtggcgtgtcaatattattttagtacgctaggcaagttggcgttgccaaaagattcaaattctagaaataagtttttgaagggtttatttttaaaatttaaaaacaagaaagttcaaaaagaaaaaaaaatccccgcactcacccctgccctatcaccggtttatctcttcttttcttatctgctttgctcctcctcgcactcggcactcgacagctctacctctcgatcgagtggttggtccgctgctcgcatccatccatgtttttagtgtgctccagcctgcagcagttgaaacttgaaaccccaaggcagctcaggctcagctacctagcaattcatctttggtcactgacgactaaaaaggatgcgtgcataataatacatgagtgctccattaatttatctctgaatgaattgagttttcagccagacaaatggagccatcgattgggcagcggtagcacgatcgatagcaagataaaagctcctgtcgtggcactgtatgaggcgtacaaaacacacgagctcaacagccatagctagacctcgacacagatttgaccgaaagcccttggaaatggactgcactctgtgagtgcgtgcaaaaggctcgcctgcgggatccacgtggcgacctcccgttggtcccagccccaacctgctcgggagaaacgtcattatattgtttgactcggtacaaaatcaaccaaaaagataaaaaattatattaaacgccattagctaatttagctttcgaccttttcctgggtgttggataagatcatccatgcatgcaggagtaggccacaccatccaattccgtatacgcatcctcctccactctgcccctgtcctgtgttgctgctgctatgctctggcattctttagggagcttgagattttagaaacagatttctttttagtaattacaaactgagatatgagtcttagaaaaagatattttttcagcttttactttgtagtctatcttttaatctataactatatagagtcgaatttagatgaaaatttatataatttgaagagttaattactaggagtaactgatggatggtgcagtgttaacgcggcggcgatccgttggttaattggaaatgggcagatgagaaggaaggaggcaggcaggcaatgcatgcatgatggagttgtcgcgtcggcttcgcttttgcgacgaccaccaattacttgtgtcgccttgttgcggtttctgtaggaaaaacacatctgtcgatcgatcctttgcccttgcccaccggggtcgccactaccactctcacccaactctcaacgcgtatatatgctttgcttgcccaatgtcatgtatatatgtacctagctagtacctgccatgcatctctgtcactcacttgaccagtatacatgcataatttctttataaaatgaaaataccatcacacgtgtttcttatggtaattgaagaccttcaacttttctagtattataatttgttgtctaaatttcaattcatgcatgcaactctgctaaacgaattattaagagctaattaaggtatgtatgtatatatatatatatatatatatatataaaagctaggttgtcgtagcagacacaacatacaatctcttatcatggggctagatataaagcgagggacaaagctcgatttgaggttcgatttcctggatcctgatgcatacacataaaactgtgagtaaccaaaggctggggggaaagtacgtcgtagatatcatagggttgtttgctctttagctctcatcctttttccttcaacttagatatcatttggctagctatattcgccctagctaagatagccccaacacgtacataccctaattaacatgcgatattaatttttggaacattaaccaactgtttacctgcacgttatgactcgcttttagagaggccccacagagagagcaaacagtcgatctgagagcttggatgaggtcattgaccgcgaataagagcgtgccgccagcttgttgtaaaacaggagaacccatatgtacgttcacgccagagaggtgggatggaagccagaaattaaacagtacaataatcatctgtccccttgtttcagtcaaagggttgccatatcaagacatgttcagtgttctatcttattctgccaaacaaacaaaaatgataaatcagatcagctgaccaaaacaaacaagtagatgctagtagtatttaactacaagaatgaaaaggtgaacacgactacttacgtagcttgttgctaattaggcgtcaagttgttgtatttaatttacctgcatggatgttttcttttagaacactgttgctcgctatcagtagtatgataataataagataaatgaggtggctagcaaggctatggtaccaacaggcaacgagcagcagaggcgaatgggacgtgtgtttcatcatcaagcacaagctagctagcactacactgttactgtccattctccattcaggcagctagcgctgttgcaagataggtcgcccggccccagacatcctttctttatataaaccagccagccatggcgcacccaaacacaaacacaaagagagcaaaacttaagctagctctgggtgctgcattgtctgcagtttacaaaggtagatcaattagaggagaatgaggcagcagcagcagcagcagcaggagagcaggttcaagaggacctgcgtgttctgcggcagtagccagggcaacaagaccacctaccgcgatgccgccgtcgacctcgccaaagagctggtacacaactacactctctcatagcatgcatctatgtttaacagcatatcatgaatctctctctttagttttgtttagattgcggttcctttccataattacacctcaaagcaggaagcaaaggtttataattaattaatataggcgtggatctttaataaattgtgatcatatatatgcgctggcaaaacaggctatctttcacctgcatatatataatcacaatatatattgtgttatcaaaatcaaaattaaagatccacgcctgtgtagaggccgaattttatctattcattgtctaaaaagatactctccgtttcaggttataagatgttttgactttgatcaaagtcaaattgtttcaagtttgactaaagttatagacaaatatagtaatatttataatactaaattagtttcatcaaatcaataattgaatatatttttataacaaatttatcttggattgaaaatgttactactttttttatacaaacttgatcaaacttaatgcaattttactttgaccaaagtcaaaacgtcttataaccttaaacggagggagtatattgtactagttaactacaaactatcggttaccacttactaacggatactgtaacgggaacagctcaacatatcaacaaagttttaagagttggtaaaacttattcggtttcatccgtttttattcggttactgccaggtagtggtaaccccatccatattggataaggaaacctgcttccaatagatcgacacgataccctcgtccccttttctattcaattggactacatggctgctttacatccatcatcacttttttttttgaaaactactctatctgtcccataatataagaaattttaaagggatttgacatattcacaatggatctagataggctctatgtctagatttaccgtactagaatatgtcacaccctttcaaaatctcttatattataggacgggggagaagtatgcactactaatcaagagactatattgtggcaacgtgttcgaacaatatccagttcggtggtacagtaagaaacactacaatggtactggttgtattcgacagtgaaattcagacgtttatagtatttcgcgtgcctccctttgttttttttccttcatcgaaagaaaaaggaaacagagggacaggtctacgttctgttctgcaaaggagtactagtacgtatcaagacaagtacagcagcatgtacagagattttgtcatgtcagaaaatggcaacgcccatgcgttcctctgcatctcctgtctgcatgtgtatccccaagttttatgggaacaggagaacgctgccccattgttgcctctgcaacgaatttgctgctgcactgcacgatgatgatgaggagttgttgtttccgtgcaggtcgcgaggggcattgaccttgtgtacggcggcggcagcattggcctcatgggcctcgtctcccaggccgtctacgacggtggcagacatgtcattgggtacacactctcttcttcttcttcctctttccatctttaatttccctggcctctgaatttcaatccaccacgacagtcaagcttcaggttctatgttaaaggccactgatgttattgcgtcatgccatagcttctatgttaaaatactctacgcatgatattttgtcagtttagcttaggattgatgcacagttaattaattaagtctgattgaagagtatttttattatattactccctagtacgtccattaatattgatgcaagtatatgccagtacaaggaagtgctcactctgttgtttcatgctcttgtcttccatgcgcgtgcagggtcatccccaagactctcatgacccccgaggtatgaattgcacatctcccctactgctattctacttcacaagtgaaattattactgtaaattactatcatatactagttttagcaccaatcaccaccagtatatgctccttttaagtttcaatcatggcaatgcactgacacttgatagttttcaattgtgttactactaggccccagggctagttgacactctatcagatatatagcagtaatccttgagcacttgaatcgatcgagtgtctcctgggaaacagaacaggcactgcttagaaactgaaaacaacagtttaatctaatcacctggatgggatggagtatagtcgtacttttgtagtcgattgcgcgcctgcggcacaaatccaaacccgggcgtgagtataaactagaggagcactgcagctttgcagatgattcctcaaagacatgcttcccttggaagtcgaggcaacgtttgcctgtctctatagccttctcctcaaaagaatgttcttgtttgctactcctactacaactccatccatgaagttttagaagcaggaatgcaggcatgaggcatcctagatgaccttgattgatgaagcagagggcattgatctctgcagctacctgcatcagcccatcatgtattacttgatggctcatgcaacagctcaatcctgcttgcacatggttgttgcattgcagtaatttctcattgcacttgctcacagccatatgtactgtgaatctgtaatagagtacagtactgtttttccttcttgccacgtgcatgataggagtaatgtcaacggtaattaattggcatcaatgtgtacttccctggctcagcagtgtggtacgactaggagtttttgcctcagaatggtttagagacaatgcatgatgcatcatatatagtcatagcattgtaatatacttttagccacctgcaaaaatagttttagtagtagtgaattaaccagtaatctttaagtaatactgaaggggatatatggatgtatgttgttgttatctgcagataatcggagagacagtaggggaggtgaggccagtgtccgacatgcaccagaggaaggctgagatggcgaggcagtctgatgcattcatagccctgcccggtgagcgctgcatagccctgcatttcataactgtgcattgcattccatttctcaattttgtcaggtcaaggcgccagcaagatctccacggctagtactgcctcttaagagcaaggttaatagtagttgtaggcagccggcgttaattccatccaactcagctagtaactctttttgcaccttgtgaatacaataagtgacctgcaacgctgggcccatcaacttcacatcataataaaataacttaagcttcctctcacacatgcagctcacaacctttgcgctcaccacttttcaccatttttctctcgaagctggtgctagagccagcgataaaattgtcgcccactctcactctctctcctcttctcactcatccagctcaacactgtagctgacgtgtttctcctatcgccagtccagcttgtactgttgtactcgctctaataaatcctctagtaatagtactgcgtgtgtcagacaagtaataacacgccaagtggcaacgtggcacccttgtttacttacggtattagtattactgatcttctgtcgtttagagtaccacaaactaactagaatgtatcgaaacaattcaggaggatacggaacactggaagagctgcttgaagtcatcacatgggcgcaattaggcatccatcataaaccggtataattcagtgcattaatcgctatattatggagtatataagcactcgcttctctctgaaacgaactctttacgatattatccatttcatcttaattcagtgctaatgatttctgacagagagctttattcttttcctgatgaaccatgcatctttcaggttgggctgctgaacgttgatgggtactacaactccctgctcacattcatcgaccaagccgtggaagaaggcttcatcagccccagtgctcgccgcatcatcgtgtcggctccaacggcacaagaactcatggacaagcttgaggtagtctaaattaacagctcatgcaaagtttctttttttttttaactactccctccatcgcaaaatataatgtttataagttaatggtcttcaacgtaaaactttaactgttgctttcatccatgatatattatcgacaacaacaaaattaacataatatgaaaaatacttttttttcaagaatacgcataaggattacatatctttgtattaagattgaaaaaggaaaacgcttttaaatgcaaatttagtgatataactatgcgtggcactgaacatatacagtgttttggttttattactggtcacaaatttacaaaggttgaattttcttaaaacaaggatctccatctcaattatgacttgcttttaattgctctgtgcacaactgactgtatctcaatctatttatgcaggaatacgtcccttaccatgatagggttgcgtctgggctgaactgggagactggtcatctagggttctaagctgttgcagcgagcttaattaagcttaaatgaattgaagaaaggcgaaccatcgagcagccatcaacattaagcattgcttgttaattgtgctcgatctatgtagtagtagtagcagcttgttaaccagtctagattgtcttttttttttctcctacgaagcatggagtttgtcatctcagtttgggtaagaaaaactagtagcacctaatcagccatatatcgatgttcaagatccagtaactgagaattaattgacactaaaccaagtgtcaaagattgacctgatctggttactgcatcataagttttaagattgttgcaagttgttgattgaaacactctttgttttggagatgtaagccgtttctatttccatttccattatttgatcggtgttattatacacactgatacatattgagcgaaagcaaaagaggcccataacattatttagaaagtgttatgggcttgacattaaaatggatcggtccgacttttccgccattatttcaattcagcccattagtcgcaaacgggaaaatgggccattaacagattcgtgttgccacgatgatataccgacattgctgcgcctcaattggaacagaaaaattatggtaaaatagaaatttatttaagcatttttttcccgaccgtttacatccctggaatccgctgtaattcctgcaaagcaccgtgtagacaaaggcaaaggcaaatttgttcgtccggcttcaacataaatttatcttactttctacactcaaaagtttggtattccacttcccttgcttttcagatgtgcactttggtttctcaaagggttttttttttttgaataaaatggtcatcgcaatacttggatataggaaggaaagggttatggatgcataatgcaattgatccttaattagtcctaatctgtcatcgcatacacgatggattgttttccagctgcttgcaccaacttgcattgccacttgccctttcacttgaacaacttactgcttcatgttatatgacttcctactttacattttttttgggtaagacctgacttcgtgacattactattgcactatgttctcaatgaacctaattcatgtatttttctgtttcagatgatgagaaagttcctgtcataaaaaaagatggtgagcaagttgataaagtcactgtcctgggatttatccttgggttaatcaaacgtcgtttgtggcagatttatgttttccagtctcaaagatcttttctccgtcaacctcttacatcaatctcgcttactttgtttcagttgattgtgtttgcgagacttggggttgtcgtctcgtagttacatacccgaagcctgattgcaaaatgtgccaaccctaattctaatgttgttgtacatcccagatcagaaaaattccagtgtgggcagcaaaaggacggcaaattcgcatacgtacagcaaatgctaatttaatagtatgataatactaatttgttggtactgatctcaaatcagataaacaagacaggttatgatatactgaaattgctgcgtcccaattcgaacagagcttgttcaggaggcctgcaccggggtgggaaaaagaaaatcttgatcagtttttaactgggctttcttctaatgtttttaatgattcattatatttttctctgtcatttgagactttcttttgttagaaagttaaggagttgaactgagccaaggtgaaaacaactttagttcaaaatttaataattctcattttaaaaagaaaaactagatcaatcagagaatttttaaccgagccatctagttggctaaacaatctttttttcccccatccgcgagctcagctaactagttcatctggctaaactaaaatattagtataagagccaaatgaaaggatcaaatcatttcaatttcagtcctatcttgacaatttcggtttgcatggactctcctacagtcaaagttgagggtaatgctaagctgaacacctgctgtcgatctgcaaagcccaaattaacttaattcagggtaagctgtgttcatgtcgctgctcacaatcacatgttagactactggcctgtaccatgtaactgtacactccgtatattgccatgagattgtttgttctgcattgattgattacaatgcaaagctagtgagtccaaacgagccaccgatgatcacagattcacaggcaggcagctctgcctctgctgctgctactgctactgaccgtcagatgatttccagatccggcaagctatcagcttagctggcatggaagcacgaagcggtaatagtagtaccaagactttaatggtgctaccgtaggagtcctattattactcgtactgcaactgggattaatttcggtgttctgatttgcagataatcattcagtcgttgaatctgcccgtctgccccctgccctcttgccaacttgccatgatatgtggtttgaaatttgaagccattgtttttagaaaatggtttaattagagtcattatagatatagccttacgcttcaacgattaattaattaatcaaccagtactaatataggagtatgcaactactactacaagcaaattagaacaacaaaaacgagttcctgccgtcttaaggtgcttgattttactgtcattgatttggtatttcatccatcctacgataaagcaactagaatagtactccctccatcccaaaatataagtatttttagctataaatctggacaaatgtatatttagattcatagctaaaagttgttacattctagaacggaggtagtactatgtgatataacctattatagtaattttggacatatttatagtattataatgaatctagacataccgttatcgtatattcgttgtatccgttgttccatgcttttattttgggttttatgtactttgcttaattaaccgcgcacgatgtactatgctactagttgcaatatgccactcggccacgcatgcacctatatatatttatgtatctactacaggcgtgtggagaaatcaaaggttatatatgtttcacatgcaatggattatatatttaattactgcggaatagtattactaatagtaagcggaaagatgatgttatttgaatatagaagaagttgatgacaaagaaaatgtagtgtgtagaagtgtttcttgaagaagaagggaatgatggagaaaagcgacatcgggatcgattatcaacatggatcatggaaaggaggtaacatgcaattgcagatgcagcagctgaggcaggggaatgtttgtagttttgtctccaaaaccaaagagaagctatagtagagtgtgcaaagcacaaagcatgacatgcccgcactttccgctccatccctgcttaaacaattgactaacaagcataccacaagttaattgcatttcattaacccatactgcactactcatgctaataaactagcactagcaggtagtataattatttatactacatctccctccgtatttcttaaagtaaatcatttagaacaatatttaagttaaaccttaaaaatataaatcatgaataactatcaagttgttaagtttaaaaatataaacattatatgaattgatttgtcttgaaaaatacttttataaaagtatacatatatcgcttttcaataaatatttttatagaaataaaaagtcaaagttgtgttttagagaccgtgtcgctgttcaaaacgactttcttcacgagtacggagggagtacatatattaaaacaaaatgacggtgtcgaggttcacagacgtcaatgccacactatatattactgtactaatttatctacatattggtagtagtatttgtttaggaaaagaggaagagaagagaagatgcacgcatgtgcagcttggaagttggtagtagaggcactggaaatattatgcatacgatacgtgggcggccttcttttctcgcgtgtgcatgcatgcgtacaacgtaagattaccctttttttttccttttcctaatcttacgcacgcacgcatgtgcaccaccaacttaggagtattatactttcttaattagccgccctgttaatttttctctcacactaccagtattcttctattactgggttcatatagctcctgttcagatggttcataatattgctgccatatactctctctgttctcttcatttctctctctctctttctcacacactacaagtattttcctcctattcttcatcttcacctggcacacaaatcattattcagctgctagctagcagaaacacagtcagcttaattatatcttcccaggccggctgcaggttgacataataatacaaaaacaagactactactagcatgtgaaaagcaatactttacgtctttgcttggagataaatactcacatactccctccttccctaaatgtttgacgtcgttgacttttttaaacatgtttgaccgttcgtcttattcaaaaaatttaagtaattattaattcttttc

SEQ ID NO: 69355 - DNA, 2192 bp, Oryza sativa
gccatcgcatgcttcctttgcttctcatttactactccatgtggggggggtctagctactcctcacaagatagctagcgtgatgtgtctagtgagactactaccttaattaatttgcatatcaaattttggataagggattatctacataatgccaaaaacaccattcattagcgaagaaaataaaggaagtactgaacacttatttctactctactccgtatcggcgatattttgtctccgctgtacctagagtgtggtgtgtttagttcacgccaaaattaaaaatttgattgaaattgtaacgatgtgacgaaaatattgaaagtttgtgtgtgtaagtaagttttgatgtgatggaaaagttggaaaaagttttattgaaattagaacgatgtgacaaaaaaattgaaagtttatgtgtataagaaagttttgatgtgatagaaaagttagaagtttgaagaaaatgttgggaactaaaccaggccctattactgcaccggttggcttacgtggaattcaattgcaagtttgagcatgtatatagcccctagctgaccaatcctagctagtctttgcgggagtgattgacaagaacaacgcataattaatcaatcgttaaataaccagtactaatactaaccagggttaccagacttggctaatgcttgtcttgtaagctggaatccccagccttaaacctgtatacagacatcttatgctttctcagtaaagctgggcggtagcttcttgatccaaaatactaacctgcagggcgtcgttttaacatattttaaagagataaataaatagagagaagagcaacgggctacagatgtatagacagctgcagcatggactataagacgtaatgtgcgtatgacaggtcagaccatatattaatagtatagtaagcaactattgtataaattggctattacattggctatagatgatttggagctggtagtgggctatattatcaaacttgccctaattattggtatacgactggagactaaaaataatacacatgaaatcgagtggagtacgatacgcatgcatgtgcgtatatagggtgtgtttagtttacactaaaattagaagtttggttgaaattgaaacgatgtgacgaaaaagttaaaagtttatgtgtgtagggaagttttgatgtgatagaaaagttggaagtttgtagaaaaagtttagaaataaacgagaccataactgggcaggaatgtatgaccgtgcgaaacagtgacaggtgcgtatgtagctgatccgatccgatcgagtgatgtagaaaagcatcagcgagcgaggtgcaaattaaagccatagagacatagctttgcttagacgaaacaccaaggtagtagctagctaagtatccatcacccgctacaactggtatccctccttaaggggttcgtaagaattccaaatcaaaggaatataaaaattaaatgattagaatgtcacactcatttcattcattacgatttttaatttctaagaggtctcacatcatgctaagaatcatatggaattaacctgtaacactataatctaatttattcctataaaacgaataatacatatattaaaaaattctaaggattcaattcctacgataattctatgaaaaattctctaaaccgaatgagcctaaaagtaaattaaattatactactatcagtcgtatttagcactgctataactatttagtggaggagtaattagttttactaacctggtggctctattaagaacaaataaagacgtaaaaggcgctgtttgggagcaagcgaattgaagcgaccgacagttgttggacatctgcccgtgtactactactgtgcacttagtacaacggtgaaaacggtgctccccacggggtaaaacggtgaaaagaaaagaagaaaagaaaaagctcttctggtttaattcctaactttttcttgtaagtaaaacggtgaaaaaaaagaaaaagctcttctggcctggtttagtttctaatttttttaaaaactgttaatttttatatcacatcaaaacttttctatacacataaactttcaacttttccgtcatatcgtttcaatttcaatcaaattttcaattttaacgtaaacaaacacaccctctgtttctctttttcatcgcgcgtatacgtatctacggtggtgc

SEQ ID NO: 69356 - DNA, 9705 bp, Oryza sativa
  unsure (1)..(9705): unsure at all n locations
tctctctctctctctctccatccacatctctgtctgtctccgctttaaagctgtcaccttttcccatctctctctctctctctctctctcccgtgctgctctcccttctcctctcctcaattaccacgccgcagccgcagccccccaaccctagctagtacggcgggcgacctgagggggtagctgcctacctctatacctgctatctccgttcgatccgggtcgggctcgtgctgctgggggcgggggcaatcaatcggcgagctcggtgatccatggccgtggctgtggggtggctgtgagggtgcccccggcggcgctcccctccgcgcctgccggcgagggggctcggactgaaggtcgccacactctaccgccccacccatgctccctccgcgcgcgatctaagctaggcctaatctagggttcctgattgcttttccattttcgcccggacggaccaaactactactgtctatctatctagcttcttctgctgcttctcgtgctgctcctgcatattttttaaaatttttatttcatctcatttccgggttactctcatttatcatctactccgtaccactattagccaaccaccccattttcccccctttttttcttgagatttttgtgggcgaattcgagtaacctttactccccccattctaggaagcggtttcttttagcatggctttgtttttttcttttcctctcccgctttcttagttaatcaactttaccatatctgttgcgtgcacttcaatccctgtcatttgtatccttcccctagattttgatgctcaaacgattgttttcaccaaatgctgagtcaaaagaactctccttttcttttttcccccagggatctaggcgagctgaaaattgaagtgcaggcaaggagataagagcagcgtccaaattgtgagtacttcattagcaggaggtagtggttgtgcttgcttggctcctttgcaatttggctttggcgaggtagcaatggctgcggcagtggcaatgcgagggagtagcagtgatggaggtggctatgataaggtttccgggatggactccggtaaatatgtgcgctacacgcctgagcaggtggaggcgcttgagcgggtgtacaccgattggcccaagccaacctcctcccgcaggcaacaactgctgcgtgagtgccccataactgctaacattgaccccaacagatcaaggtctggttccagaaaaaaaggtaataataatagaatcgaatctttctacggtagttttttggacaaaaacttgttatggcacgtttccctgaatgtttcatctgacaactgaaataacaatttcgtttagttccttttggggaggctatcggtcctaatatgnctgctttgctgtggcgatgataagcggaattttgatatgaggggagctgcaatgccaattgtttatcatttcatttgtttgcgcaccagcaaaatgtagtataattactttacctgacggctctgcatgtatatgattttttcgtttttcatgttcgctgaagtggatacttgtgcttgtgttgctctaggtgccgggataagcagcggaaggagtcttcacggcttcaggctgtcaacaggaaattgacggcaatgaacaagctacttatggaagagaatgagcgactccagaagcaggtctcccaattggttcatgagaatgcccacatgcgacagcagctgcagaatgtaagctcttgatgtgctggtgctgatgttgtcccccatgcataaacatgttctcactgaaatgctatctattctttgtgcattttgttatacgcatggcatgtccggggatgtgttgttctgtactgtatattgtagattagtataactttaaaatttgatgtatgtgtagctataccagctggggccatatgcgtcagttcctttagaattgatatatgaattaatcctcagaatgtccatgagatcgctagatttcactgataacaccacttgcttgggtgcagactccgctggcaaatgatacaagctgtgaatcaaatgtgactacccctcaaaccctttaagggatgcaagtaacccctctgggtaagtaaatagttctgagtgactcaggtagaattattgttggatggacttgctctttcgatatcatgctatcttaactgccttttatcttgttctaggctcctttcaattgcagaggagaccttgacagagttcctctcaaaggctactggtacagctattgattgggtccagatgcctgggatgaaggttccatgctagcactgtttgtttttttgttctgtgatttgtgctaagaggtttttacttgaagtgcttactacccttttgttttcatgatgtaagcctggtccggattcggttggtattgtggccatttcacatggttgccgtggtgttgctgcccgtgcctgtggtttggtgaacctagaaccaacaaaagtaagtgttgtagctatttgggtacatgggtttggtatttttatgttacctcagtattccctgtctgtatgttttctgaagcatctattttgggtgatagcaagcctatccaccagtcacttagttttctttgtgtgcaaatggttagaaacctactacctccatcccaaaatatagccaaaagttgctatatcaaaaatcctatcagaagtgcctcctgaacacattgctgccgagtgtggaattaagacacactgtaattcactttaataaatactaaactttgaagatgtcactttagaggtctaatgatttcatgtctgccaactgttatcatcaaatttaatcgtgaagataagcagatatcttgctttttttgttactttattcaggagattttgtgtctcatagaactttgttacgtaggtggtagagatattgaaagatcgtccatcttggttccgtgattgtcgaaacctggaagtctttcaatgattccagcaggaaatggaggaacggttgaacttgtctacacacaggtgaacactgtttcatttcacatggtataatggtatatcctcagtgttctctatcaatgcatgtggttcatgccatgaacattattacttgtttttgcttacagttgtatgctccaccacctttagttcctgcacgagatttttggacgttacggtacacaaccccaatggaagatggcagtcttgtggtatgtatgaacatgaacactgttttcaccccacaatgagtctcaatgtgatgttacccttgctaatattcctccatctccaaggtctgtgagagatctttaagtggttcagggggcggtccaagtgctgcctctgctcagcaatatgtgagagcggaaatgcttccaagtggatacctggttcgcccatgtgaaggtgggggatcaattgtgcacatagtggaccatctggatcttgaggtatttttcacacttttgtacagttgaaccatgttttttgtcctttgatgtaggaccatttttgtatcctgtcaaactaataatacaatttggtttaatctttcaggcatggagtgttcctgaggtgcttcggccactctatgaatcttcaagggtagtcgctcagaaaatgactactgcggtaagctgtcgtgaaatgatattcagctcaaatttcattgatgtgattacaagttcatcatttcaagtgaaacttgtttttaatgaactcttcaagtttcataacattggatttttttttagaaaaaataaaataaaaatccaatattatgaaacttgaagagttcaagctaatgataaagtttgtgttttggataaagcttataatattggatatgtggtgaaaatgatttatatgggttggtacaactaatgataaaatttgccttttggatatgttgaacagttcattttctgcaatctactttatactaaccttttattgtctatcctatatatcaaggcactccggcacatcagacaaattgctcaagaaacaagtggggaagtggtgtatgccttggggaggcaaccagcagtgctacggacttttagtcaaaggctgagcaggtgatttttttataaattattactcagcaattaatatttttttcacctgtttaatctaacaccaatattatgcttttcttagaggctttaacgatgccattagtggtttcaatgatgatgggtggtctataatgggcggagacggtgttgaagatgtagttattgcttgcaactcaactaagaaaattaggagtaacagcaatgctggcatcgcctttggagcccccggaggtattatatgtgctaaggcatcaatgttactgcaggtaagggtaatcattatcagctcattagggtgcagatgacccctctgtatgtagcgtcattttccaaggaagggaaaaaaaaacttttttagtgattcaacatatgcaagcacataaataaattgctcggctgtattaacatttgatagtgagatcctaatgagatttttgatgttttgcctggtcctacacctgatgataatttgtttgatttatttcattactttcttttttgcggagaaacttatttcataaaactgctgtcatcgctggtgtgaatataaaagcagtgtcacaaaagttttttcctcagagacattgaacacacagaatgagttctttggaactagatttccatgttcaaaacttgtagctgttaaatcatgttaatccatacgtcttcttttccttctttggtatttcagagtgttcctccagcagtactggttcgatttctgagggagcatagatctgaatgggccgattacaatattgatgcatatttggcttcaactctgaaaacaagtgcatgttcacttactgggttgcgacccatgagattttctgggagccaaatcatcattccacttgctcacacagttgagaatgaggaggtatattttcctgaatatggggaaagtctgttttttgtgcgcttgttgctgttgaactgatttgagtaatggttatagcaaactacttattttcattcttgctgatctgtttacattgtcatagtggatagtgactatctagttaattccattgtcggacatagttttgttattattgatttattttcattaacttgaaaaaaaaacgaacagattcttgaagttgttcgccttgagggtcaacctcttactcatgatgaagctcttctttcaagggatatccacctgcttcaggtaagacactaaatgccattgctatgttttttgtctgtatatgtactgtgttgcttctcaattgagaaaactagtagcttttaatacatgtaatttcttgcttaatatgttgatcattgtatctattcgtgagcatctttggctctatttcatcttatcaaattattgtagagttaaatatgctgtgtaacaactaccaacccataagcctatctttatccgggcatattaagtttgttgctacacccttttttcccccttcgaagtacagtcaaagatgcaaagctttttatgaggcttgtaaatattccagtttgctaatatacccttatcttttgcagctctgcactggaatagacgagaagtctgtgggatcctcctttcagcttgtgtttgcaccgattgatgatttcccagatgaaactccattgatttcttctggcttccgtgttataccacttgatatgaaaacagttaagtgctgccaaattccaaattacattatccattacccttttgactgttccctaggtccatatgtgctttatttgctgttgcattaatctgtgatgagtcgtgaatgtcttttagcttttctaggaacctcagttttattcatttgttcagtgagttaaccctggccaattttaactcttcataaacaattgttttggttgttctaagacaaataatctcttggaaatgtttcatttattctcccctctagtccgctttaaatgttccagctctgtccacagagaccccaaaaaaaagctattttgtaaactcccattaaattgagaaaaaaaactgttaaattggttatttgcatcttgattgtatcaccagttagaactaatagaggcatttggtttcaaatattcccttggaaaaataaagcaagtatgtatgaaccaagcttgctaaaatgtttatcctttttgaaccagaggtagtactatatttttggtcggctgccactaaatttttaggctctgtgcccaaaagtttaaccgtcacatttcatgcaggatggtgcatcctctggtaggacattagatttggcatctagtcttgaagtaggttcagcaacagctcaagcctccggagatgcatctgcagatgattgtaacttgcgatctgttctgacgatcgcttttcaattcccttacgagttgcatctccaagacagtgttgcagctatggctcgccaatatgtccgtagcattgtttctgctgtgcaaagagtgtcaatggctatctctccctctcaaactggtctaaatgccggacagaggataatctctggtttccctgaagcagcaacccttgctcgatgggtttgccagagctaccagtaagtgtactcgtagtttcttcctgtgcagtagtgatgatatttaataagaataaatttgatagttttccatgttggttgcaagctgacaaaatattattatgccgtcgctcagttaccatctaggggtagagttacttagtcaatcagatggagatgcagaacaattgttgaagatgctatggcattaccaagatgctattttgtgctgctcattcaaggtatctgatgaattcaactcgatcaatgttccatcatttgatctaatctcatttagtctattaagtactattacagaccactcgatcaatgtttacccatgtattacagaccactcgatcaatgtttacccatgtactctaaaacttatcgcttgtccagctgacctacaatcttttcatgcatttttcaatctaacaaaaactggctctgttaataataacctaatagttagaaagaactggctctgttaataatgacctagtaatagttagtacttagtacagacctaacgagtgcttagaccctcaaacgtgttttcaacagggtgattttgctatatttttccctttgagtaaatgctctcaattttttgtaaggtttacacttttgacactaatgcgatcatcggaccacaatatttgctatcttgtatgacagaaatgttttggtttctttcaggaaaaaccggtgtttacatttgccaacaaagcaggactggacatgctagaaacttcccttgtcgccttacaggacctcacattggacaggatctttgatgagcctggaaaagaagcattgttctcaaacattcccaaattgatggagcaggtagaaactccttttcgcttaactcacacccttaagtgcatcatatttcagaaatcgctgagttgaaataaattaaaattatgttacattgcttaccatttttttccctgttttgtgtttagggccatgtctacctgccatcaggcgtgtgcatgtcaggaatgggtcggcatgtttctttcgatcaggccgtggcttggaaagtgcttgccgaggatagcaatgttcactgcctggccttctgtttcgtcaactggtcctttgtgtgaccatcccacatccactgcgaagtgaagattcatttttgcttgttcaagactgttttgcactagatctagacctgagaatctagtagtatttgcgaaatttctcgcttatgtaaatgtaatctcgctcccattccatcaagtacccaagtacaaggcagtggccaagtggttttagttgtagggggatcggagcaatcctgacggttgggtacttgggttccttccagcaatgtaaaatcggatcctgtagggcgtcgaaaactgcattggcaagattcttcgaaatgcagaccaaatttagctagtacatcgtaactttggcattagccatttggctattgggtttttcgcttaggtgagatgcagcagatcatcaactgctaccacttctcatagtgataattaaaatgcaaagatgcccccccccccctccccccctgttcagtcactaacgagatgaaacttgtgcacgagtacgagactgaactagactggccgatacattcagcgacaggatttctgattctgaaacgaagggcttgattggtttgataccaatttattaccctaccaaatttttagtaacttcaatagtagcaagtgtatgtttggtgtgctaccaaatattacccacaatagtccaattgaatgctacctaatttggtagtgccaaaatttgccaatgttttggtactacctgttttggcactaccaaaattttggtagtgcaaaaattagctccaatccaaacaaacccgaactatcagggtaacaaacaaggcaggataaaaggcttgggctagctaaaaggccacaatcattcagttagccttgatcatgagtaaaattcctgtgcagtacttaaacttgagagaagatattacttaggtccgtacacatgaaaattacacgtctagatccatcatcttaattcaatgaatcaagccagttcaaaccacgtttgaccagggatgaccaccgtcgtggcgctccacttaggcataacttttgtacttatcgcctccacacctcagcgtggcggtaatttagcaattagcccctcattgctaccgtatcatcccaaaagcacatagtcccctcgtccctcctatcccccctaatacgacgcttccaatgcaaggtgatttgggcatcgattcgagctccgtaagtagtggcgcccgataggcatcacggtacgcaaatccatcgccggtatgtatccacatttcgcccctaccgccgctaccgtctcccgccgctatgtatccacattttgcccctaccgccactaaatcgccgtctcccaccgccttcatatgctgctcccacagttgcaaccctagccatcgggtgaaatgtaaggggccgaatgcaaaagtgatgcctacatacgtcggtggtcatctccagttaaacgaggtttggactggcttggttcattaaaccaagataactgatcttagatgtgcaattttaagtttacggatctaaattgacacccccttgcactcaaccaagataaaccaagtttgaaggatcggccattcttgatcaatcagctagcagtacacaacatcacatgacagattagcagtaataaatgtaatggcgactgacaagcagtatgatgcaaagagattaccacacgaacacacagaattagcaaggcaatctgaatggtctcatatttataaccaagaaaatatgatatccggtggttcttcgaatctttgaggtattacaaaactgcaatcaaaacataaaatggcttgtgtttgtccgcgagtgattacaaggaggaggcgaagcgatcacctaggcgcggtcgcggcggccgtaggggaggcggccggccccatactgctgcggggcggaggtggaggcttcggctggcccacgaccccggggaggtcggccatgccaagggaggtgagcatgtcaagggtctccttgtcaacgcggatgtcatcaacctcgaccgccaacttgtccgg

SEQ ID NO: 69357 - DNA, 1258 bp, Oryza sativa
  unsure (1)..(1258): unsure at all n locations
cagacaaacaccatgtgggtataaaacatttgcgaattggaagcataatttaactgtcgtaaaactcaattccaccgttggattggaccaaatcctcgtacaagacaaaaccggcccacatggaaacgagtaaggcaggtcggagtccataggagagcacgtcccaggcatggtagggggtaacattgaaccaacaacccttcacaacaataatagacgacggcgatgaacaaaactaggacgactctttcttctcttccacctccgcttccttcttctcctcaggctccttctcctctgcagcctcctcgaacgtctctccagggacaagctcagggacatcatcgtcgtcgtcctgagcgttacctgcgctggcaccagcctcagcaccgggtacctgcttctggaactgctcagcaagcctcctgaggttgtccaggttatcaggtcctgcagataggtaattaagggtgatcaaacaagagtatgtatatactactatgtgagtaggacgtacttaaagactaatgcttggttcagatatttcaggattagggcgaggtgtgcaatattgaactcatattcagtaaaaccaagaaaaaagtctcatacccaactggttgatgattgttggaagcagatcttgcagctctgtcaaaattagaaagccaaagatgagaacaccattatgcaggattgaagaataacatagggtcaacgacgcagatgcaaatttgcgtttaaagggtttgttcatctcaagattttttgccggatgtaattcaacacaaacaagagaagatatttcaacctattcattcatgttaaccactaaacatgaggctacacaacaatcagtacgcaagatcttaagcaatgacttactcttcgtctgtggtgttccactcactacccatgtatttgcaccaatggatgcttgcactgcaggaaggcaagaatagaagacaatttcagaagaaaacagggagcgagttatcaattctatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69358 - DNA, 70121 bp, Oryza sativa
  unsure (1)..(70121): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctccaataaagaccacaagaaaggccgatagctccccaccacttgtcaaatgccagaagcgtgaacgcggcaaggggaaggtcggggagttggcgccggagccaaaaaggggcaaggctgcgacgttgatgccggtgagcaaagcggggaaggtcgtgagggcgctagcccaatttgagctaggcatgccattggtggaggacaatgtgttagccgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatacagaagttggacactggtcttctaaaatgctactccttgtaagtgcataccttctatacttgtgatatgattggactatatctcctaattaaattagttctaatacgtaaatgttttaaggttgtgttggatcgagagtcgtcgccttggtaatcaggttgggttccttgatccatccatggtgaacgaggttaatttacgacagagcttcactgaggtggttgactatgtcaaccggtgtttatgggcccatcaagacaaggagtacatcatgtgcgcacacaaccaagagtaagaggacaatacccttcgtgtatattatttttgaagttaaggttcttagtactaacgctacataaccactgtgcaggcgacattggattctcctagtcatcgtacctaagtggagtagggttacctaccttaactccaataagtccaaagattatgatttcactgaaatcaccaaggccttaaatatggcttggggcccatatgtggaaaagggtggtaggcacaaggagggcaaggacgaactttaccatgacaccaagttcgcatgcgcacaacagatcggagaccaatgtggtttccacgtgtgccacaacatgtcaacacttctaagagaggtgaaagatttcgaccctaaggttgttgctaatggcgaataagctcatttcaataccaacattgctattcaaaacgtgctaacatcttgtttattaaacagaaaggtagagctggcctcaagatctcacccatcaacacccccgctatcagaggcgaagtgtgcgccttcattctggcagaaataatgaacaagaaaggacgttttcacgtcaaatagacttatgaacttggctagataatttattgtgatgtaaaaaagatgttttcataatttcttgtgatgtaaaaaaatatgtttttatagagtgcaatgtaatttacttttatatgtgcaatatttatggtagtttactaaagtgtcatcaaatttgatcaactactatttacgttgtactattcatctgttttctcctttttttccttattgacaggttgtggaggtcgaggacattatggctttaatccatttggtaagtatatatgcggttatatgagcaacgaccaaaattgtggctttcaaggggtgtgaatttgctgtgcaaaattgtggcatttgaactgcatatgtgaatgatgtcaatttttgatatggatctgtgttgttggggatctgtgatgtttgagatggatctgtaatgttatattgggggggtgactggaatatatctgtgatgtatctgtgtttcagagggcatggctagcaaatcctgaggctagccaatatttagcatttattttttttctggaattaactcatcagtgactggtcggaacaaaaatccgtcaaaggtaacaacacctgtgacggactagaaaaataaaggcccgtcagaggtgacctacctgtgacgggcctttacttttggggccatcacaggtagatcgcctgtgacagcttctaactacggagaccatcacctcacggcctttatttaaagggccgtcagagatgagtcacctgtgacgggtcccaactcgccctaggcaagcggagacaaacacctctgacggccttccagtaacttgcccgtcagaggtgggtgtcacctgtgacggccagccacctatcaaaggtgactggactcaccagtgaccactgatcactgaccatccgcgaagccgtcaaagatgagggtttgggcccgtcacaggagaccttggccagtgtagtggcccggcgtcccgcggtggatgaacgccatagacagcacgaagtaggcgaccccgtcgacgatggccacgctcctgcgccccgtgaagacgttctggggtgggctcggtaccttcctccatcgcgcgaagctgccgctgttgatgccattgccgccgagggtgagcaccgagcaaacctgcagtacgcggtccatgcggatgcacaacagcttgtactgatctcctcccgtcgacacggtccgcccgagcgcgaaggagcagttggtggggtggttcacccagtcggggacgaagagacggcggcggacgaaccggtcgctgctgccgacgaggagagccacgccgcggtgcgccgtggtggtggtggtggacactatagatggccataaggcccggggcccgaaggcccggcccacgacatggctttttggcccggcccgaccgctgggctgtgcctgggcctccccaccggcacactgggcacggtcgggccagcccggcacgatgggccagcaggccaggcccgacatacaaagtatagggactaaaaatggatatataaatgtcactgtcgaaagaatagggatcttaaatagacttattttagctatttatataccacagcacaaagaagagggaggtagaatagacttttttagctatatatatgtcacacctcccggcggacaccttcctgacgacctcaccggaggacacgtccacgatgcagacgtccaccagctccctcccgtaggcgcagaggcggccgtcggcgttgaagcggccgcggacggtgacggcgaggacacggcctctccatcggaggtggcgacgagaggatagtcgttgtctccgttttcgccaccttcaaatcgcggattttccatcggcggaggcggcaccatcgttgacggctttctcgatttaattatttttgtcagaaacggagcttgccttatttgaagaaggcttaaggagtaatccgagtacttgaccggcatgatttcgaaaatgcttggcgccgggcatcgatgcatcgggcgctgctggcgccggagcccaccatggagcctgctacgccgcccatgtctctcccacgcgtgccctcatactgcctcgtgttccgaccacatattccgttgcaacaaatcacccacatattttggaaatcctctattaagggaatacgtttcatattttttttcactaatgtttcacctagtgtactcacaatatttcactatgtataaatctaatgttgcagtgaattgaaacattcttttgcaacaaatcactcacatactatggaaactctaagggaattcgtttcactttttgttccacaaaaaatgcttcacctaatatacttataatgtttcattttgtatggatcaaatgttgcagtgacttgaaacattctttcgctatctgctgaaacattgtttttatataaggtaaaacaacgctcgatttaaactattgaaacatttttgatctacctagtgaaacaattctgatatacttggtggaacaacgtgtaacatttaaaaataatttaataataagctattttttcatcagaatatatccatgcgtggtcttgttttaaagatttaattgcaacgaatttaatggtgcaatcggatcatgatttgaataaataaattaagagaaaaaatagtttaaaatatttttgaacgcatgaatgcttgatgacatcatgttgacgtgggcgtccgattcctagtcgcctccagatgatttatatgcttgtatctcactggctcagttgagtagaaaaaccatccatatgcaattgatccgtgagaatcaggtcacataggttgatttttttagatggatggagtatttggttgaaaagcgacaaatcagtagactaggggcctgtttagatcccctggcaaaattttttaccatgtcacatcgaatgtttgggcacatgcatggaatattaaaaaaaataactaattacacatattacatgtaaattgcgagacgaatcttttaagcctaattacttcatgatttgacaatgtggtgctacagtgaacatttgctaatgacggattaattaggcctaataaacagtttgcaggcagaatctgtaatttgttttattattagtctgcgtttaatactttaaatgtgtatccgtatatccgatgtgacacacctaaatttttcacccctggatctaaacacaacctagctagatagaaccaacccattcattgtaccgtacgcacgcccaacagggctaaccttccagaacatccagtgtggaacttgtcagaaatggatttcacaacactctggagataagagaatggtgttgcacccatgtataggagggacgtcactgcacacagtgcgtgctctcgtaagagactaaaggcctgttcggttgcttgtctacggtggctgcggctgcaccatatgtgtgcggcactgttgctgctggctgcgtcgcagccacaacacaagcagccgaacagaccctaaaggtacgactcaatcatttttatgattagtacccggccaattaagcgtgctttttgaaagtatgcaactattactacctcagaaaagaaaataggtgtcggttgggaacctataaagatgccggattttcaaccggcacctagaaagcatggaaggaaaaatatgtgccggttccgatgtcggtttgaaccgacacctttgaggtttcaaaataacaataaaaaaaagctggctcgaggcatcggctcaattcaagaaaatgtatcgagcaactccccttcacccgatttcacccatcatttaattcatcaaattaatcggcatccaagaactcaaaaacatcccagagcatcaccagaatcaacactaatacaaacacaaaaaagatggacgacggcctctggagaggatagagctgcagacgagcagtacgtcgagcaccgccgttaccacctcccctcgccaaggatggaactgcagaagaatagcacgccgcccgccgctgtcgccttccttcctaccaccgcccaccaccgcacgtcgctgcagccgccttccctcctgctagatctggcagaggggaggacgccacccgccgctgctgcctcccctcccatcgccgcccatcgctgatgtcgcctccctcccgccaccacacatcgctgctgctgcctcccctcccaccggatctggaggaggggacggcgctacccatcgctgccgcctctcctcccgccgccgcacgccgctgcgactgagagagccgagagagagagggaccgagagagatagttgagacagagagagaggagagggtgccgcacgtctcctttgtggagtggataaggacataataaaagagagatgagaaggaggagagagccactgcttcggctcggctcgattttaggcgtgccatttttttttaaaaaaacaatacttggagagatatatatgatgacttttctttgttttattttaatatatgtgtgaagtacatatggttaattaattaatttatacagtgttgttcgttctatgtggttatttatagtaaacggtagcacgtatatatagatgtctccgctcgcacgcacatgaaacctgagcttgagtcgctcggcactactatagagcgtgtggtgtcttggatagagggagcgtgggaatgagaaagacacacgaagagtagagtggaccataacatgaaacggaaggaaaagattatgcattccaaagtaaaaacagggttggatggatataatttactcagtaaattatataattaacggtaacgattcatctaactttctctatatgcagatgtgctcggcgtggtgcacccacctatctatgtcctccattaacaacttcttagttaattttctagatcagtataagaagagttgccactttagaaatgagatcgtctatagataaatttgtatggatgactctatggctcgggcgcccgattgggttggagaaaaattgggtgctgataacgtcagcgcccgatttacgtgtaaaactactttaaattgatttttctcttaaattacttatccaaatcatgatccgattgcaccattaaattcgttgcaattaaatcttcaaaacaagaccacacatggatatattccgacaaaaaaaattttaatttattattgaattatttttaaatgttgcacgatgttccaccaggtatatcggaattgtttcactaagtagatcgaaaatgtttcactcgtttaaatcgggtgttgtttcaccttatataaaaacaatgtttcagcaaatagcgaaagaacgtttcagttcactgcaacatttgatccatacatagtgaaacattatacgtatactaggtgaaacatttttcggtagaacaaaaaataaaccgaattcccttaataggggatttccaaaatatgtgggtttttttgttgcaatggagtatttcagttcactgcaacattagatctatacatagtgaaacattgtgagtacactaggtgaaacattttttgtgaacaaaaaataaaccaaatttccttaacagagggttttcaaaatatgtgggtgatttgttgcaacgacgcgttccataatatcaaaatccactgcaatatttgatccatatatagtgaaacatcactagtacactatctgaaacatcgtaaaactattggttgaaacattaagaaaaccatatgcaacattctaaaaaaaaaatcaataaaaaagccaaaatatttttttgtcgaaatataattatgtgtggtcttattgtaaagatttaattgtaacaaatttagtggtgcaatcagattgtagattagataaatagtttacgagaaaaaatctttccaagaaatgaaagatgttagtatttgctttgattaacgtcaacgtcacagtctgatgcatggatagccgtccgatccgtgcggctcgatagcacggcgcgcgcggcgaccgatttttcagcgtacgatcgggcgcggtgctgagcattttcgaatttgtatgcagctatgagatgggctccaacaattccaacaagctgtatgacagagctaagtcaagatattaatggtgtactcctcgattcatcaaaggtgtctttgtaatgtgatagttatataactattgttttggtaggctattatattaattacaaaagataattgtactattattcttaaatagatatcggaaagtataatatttttatttaaaaatcggtaccttttgtactaggtatttcgagatacaccaaaattttttatactattttaagaagaaggtggtggtggtggcagtgaatatgatatccccatactctcattgtaaattttacaaattaccacttgaacttctttctattaaaaaaataaaaaacataaatgtataaccacataaagttacgccatgtattctacattacatttctaataatattatcataccaaattcacatagcaacggcgcgaggtctaactacagaatcaatcctccaagctaaattccgaacaatgggctgcataatgatgagttgatcatcactaaaaggtaactaaaattaagcttacttccccggcggcgcagctccaaggctatcatcaagacttgggatgaaccaaaacggaggaggccagttcatgcatcgcccgagcggcttcacctcctcgctctcctcatcctccaacttgtccttgatcctcttcatcgactcgtcgtctaaccgcgtcatcctcgtgatcctcctgcttttttgcctcctgatgttgatcctcctcacgccgaagtcctccgccatggcggcgccggcgtagccggcggcgtcctcggtgaagtacacggcgccaccggcgagcacggcgtcggcgtccctcttgccgacgcacaccgcgccggtgtagctgacgaacgtcgccaggttatggtagatggcggcgccgtccatggtggccggccactccatgccgccgtcgctggcccatgtcaggtgccagacgtggaacgtcgccgtggtgcgctgcgtccggcctccgccgccgccgtcgctgccgacctgcttgtgcttgtacacccgcttgaggaggtagagcgtgccgcgcggcgctccgacgaggtagcagcactcgccggcgcggtcgcggtggtcgtgttcgtattcccgggacatggtgatggcgttgacgttgttgtccgccttgacgacgtagtggtagggcgagtcgatgaccagcaccgactcgagaatctccggcgacctgcggacgttgcagtcgaacttccagcgcgcgaccttgccggagaggtgcaccgtgtagagcttgccgtccccgtgcctcgccatgtcgacgattccgtccagcttgttgttgacgagacgccacgagcgctggcccgtgcgtgccatggcgaactccctctccctcctgtagaggacggcgacggtggcgccgccgtcgctgatgtcgacgacgacggccttgagcaggacgaggtcgcagaggccgtcgaacgagaacgccacgcccggcccgccgcggtggtgttcgtccacgtacaggaagctaccgacgcacccgtcgtagccgtgggcggcgtcgaggtagggcagcctccagagcggcgggagcggcgcggtggcggcggtgagcgggttaacgaggcgcgcgtacccgaagtcgttcgccacgacgagccacccggacgagcacccgaggcagatctcgcggcggccgaggcgcacgtggcggccggggagctgcacagccgcgacgtcacccgcttgacggcggccgaggtaggagccatcggccttggcggcgaggagcagccacgggacgcgctccaccgcggcggcgaggcggcgcgcctcgccgcgcagcgcgcgctcccaggacgggcagacgttgcggcagttgaggaagtcgacctgcgaggtgaggcggccggtgatgtgggtgatgatgtcggcggggagctcgggctcggatgagtcgccgccgtcgtccaccggccgcttccgctttcccatctcgatcgccatggagacgagacgagaatgatggggttttgccgttggaactcgcaagtttctcggactcttgttgggatcagtatatgtcggttagccttcgaactctgagcaaataaacagattttcttctaaaaacgtgaggaatttggaaacgattttttgtcgcggaaaaatctagaaatccggtgccacacgagtacgcgcaaggcggttaaaaggcaatcgctgcgggctggggccgcgtgtccccggtgggccttgtccacatgaacgaaaaaggcaaacgctatgatagatgtgactgtctcatccaaacttatccatatcattcacttataaatgaagagatatgtcatctctagcatatctctaatatctctaagagcaggtacaataatgggcggtagatgatccacgtaggatttattgatgagctgaaggagagagaagaaggggacgactaattagtcgcccggctgcacgctccgcctgaggcgctgtgggcccactaagagagatgggcgcacccgcgcaaggcgccgttgcccgcatcaccgacgtcgtgctctaccgctatggccgacgtcacgcaccaccggattgccgctgtccccgtcctcgtccgctatggctaccatcgccatcgtgaccgctaccgctgccagcgtctgccatgaccgtcactgccgccctcatccgccatggttgtcgccgccgcactcgtccgcttgcatccgtcgtgaccgttgccgccgcccttgtccgccgtgaccgtcgtcgccgccctcgtccgcaatggttgttgccgttgccgccatcctcgtccgccgtgaccgcattcatcgtcgattgcatctgtcgtgacagttgtcgccatcgactggatctgtcgccgccactgccctcacccgccatggcttccgacgcctcgctgtcgccatcaactgcgttcgccgccgccgcatagtccattgtggcccctggaccgccgacctcatcctctgcacttgtctcctgcgtccgcctcggctacaaccttgtccaccgcggccacccgtgttcggcttggccacggcctcttccgtcgccgttgcccttggtccaccgcgatcgtcgtcgtcacgttcttttgctacatctcatccatcacgttcgtcgcgtccgtctaccgatgcaccctcatccgctgcgtccgccaccgtcgtcgccctcttccgcctcagttggcgtccttgtccgccccagccaccgcgggtgccaccgtcatccattgccgtgtgcatcgccgtagttcgaaggagcaaaggtgagaggaacagatgggaaagatggtgggctagacaaaggtaataaaatatatgtgttacaattaatctattatacacattggctatattgtttgctatatatgacatggctatctattgtagccgacagtgggctttattactgaacttgctctaatactctcacacatttcttaaagttcgtgtggaggttgcctctttatttttagggtggctcatcatctctctccttatcacttctctcctcaatccaatgttgcactcttaggggcagcatatagagtattacagtacttgcctaagacaatatgtgtgataactcacaagctcgaggctagacttttgctggctaatccttactattataataagaaaatagtatttgacaaaaaaacatgtgtatttcaaaattttacactagagttatctagtatatatatatagctatcgagtttacattagaattagaaaatatgatacctcctgatatcaggatgataaatttattattctatatggtttcacaaaaatatatttgagacacgtgtcttcgattaaataacagacgtggcttgaaaacaacatcgatgtcttccccgttagcgacatagttacaaggtaagtcaatatttactttattataataacactgattttttaaatatatttttatgtgaaatcagatgaagagacactttactttaaaattatatagctcaataagatctacaatttaattggcagtcttttcgtttgagattgtttacgtgcttaaatatatgttacaagctctaatatttattttgaaaattgaatttttgatttatctattattatatactaaaagtccatgaagcttcctacaaacattctcaagtcgccacgtggcgctctaataaaatagagaaaatcctagatattctaagaaaaaagcaaaacatctatcccttaattttcacttaaattggtgggtccaatattatagaccgttagataaaattgatcttaaaacaaactaaataccatgggtcccacctatcctcctcccatgtattggcaggtggagtatatacgtacgtatgtacgcttcctttcctcctttttttttccttttttcttcttttttcaatttatatatttaatggatatattttttaaataatcattattttacaaacaaagaatctaccatcatataatttaaacgggtatactctttactttgtacaattattttcaaataatgcattactttaaaataaattttacacaattatatcgtattttacacaattatatcgtatagttatcaaataagcaatatctatattaactaatttatatgtgcacttaagctgatggccccattatataaatcatcggatctactttttattacattggtctattattctcaagtaatgcactgtttcaaaataaggtctacaccattatattatctatccattatattaacaatttaaaatctatattaactaatttacacttacactagaacaggtggacatattattataatcattggatctattgattgctaataaataaagcgttcgaaattctctttttgcccgctgcacaatgcacgtctgcaccttggcctttcacacgcgtgacaaagcgtagtgtctgagacatctaagttgatcataactgctgtagcgctaccgctttgccacatatcaaatcatatatggagatgattaattttgttaataacatggaaagaaaattaaaggtgtgatgcagcgagagaataattaagcaccatgggttgtgtttttctcaacactaattagctatgtttaagttaaaaccgagagttgattatatagtaattataatgtatttgtgttatgtcgtatttggattttttactatttgtttgtacaagtgaaaggaatcattatgttataaatgtgagcacaatattgacgaatattaatataactcttactacgataagggtgataaagggagtttaaggccctctcttttttttcccgattccatattttggtttttgtttacacgcatttcaagtttctaaatggtgtcttctttaaacaacattctaactttttagaagtcaattcattcaattataccctcaaatagctatcacataaattatataattcatcaatttcagctattctaaaccttaagtactacatatttttttttcatgtgagtcatggtgataagtaaattggtgatcaacggatcatcgaagtcataagatgaatatgtaagagttactctgaacaattataaataggtgtcaaaattagttgctattaattagacatctaatggcttgctagccacaatattaatttctctctacatgtatataaacatggatgaagttggaacaaatattaccatatgtcccacacatatatattgcacaattaatattctaattagtcatttaaaattccttaaaatgctcgcaagctgccacgtggtgctgtaataaattagggcaaatattagaaattctaagaaaaaaaatcaaagtatctattacttgattttcagttaaatcgtaggtccaatattataaaccgttagattaaaatgatcttagaacaaactaaatagtacgaggtcccacctcggcataggtacgcacctacgtgcatggtacgtatgcctcccctccctttttttcatttttctctttcttctttttttcccatgcatatgcttccctccctttattaccatatcatgcgtcttcatgagacgatttaatcaaaagaattttgagtatcttgcactcggatttttcatttgcggccatactatacgtatgtatatagatggactgtatgataattaactagcaatagtttcttatttactcgagaaaaaaaacattattcaaaagttgtaagtatttaatccatctcctactcaaaagtttgtgaatggttttctaagatatcttaagaaaaatagataccttaaattattataaaataacattatccaaactttagtttgccctaaatctattagaaaaaatttctgaacaaacaataatcttaccttttaataatataagtgcccacgcatacgcgcagaccaccttcctagttgttttaaatgatcttggatggacacatgctctacaccgaagctatataattcaatgggatgtgcaactttgtaggtgacaacgttttctttggaaaacaattacatgtccgaatatgtttataagttctcattaaaaacagattttcaaattttccaaatgacacagacgagatctacagctttgtagttgatattttttcattttaaacgatttaaagtgtgaaatacgaattgcaagttttagagagaagttaagtaaaaaggaatatcatcatttttctctaaagaagctatcataccatgtttggatatgtgcatagtacttaaacactcgtgagtgttctcaatggttatattaccttgatttaataatcatgttagttgaataaaaattccttttatctttaagaaaacatcaaactgtttcacatgacctcgtggactcttaggtcttgtttgattaatgggctttagggaaatgatttcccacccaccaaaaggcatctttgaatgctaactattcattctctctcctccatttaatcctaacacttcttttatttcttaattccaatcccactccttattttccattatctaacatacccttaaaatttacaaacacttcaatcttgaaccggagccaatactacattgtaatatataaacattcttcgaattacatgtttattcaaataatataccactggcactatttaccattttatatatttttttgtgttaaaaaatacatatgttcctttgtacaaataatttttttgaccaagcctttgtacaaataattcatcagttgcttattttatttcaggatattcattgggccaaattgacagctgttatttatagcatactttgtgtgctgtagcaccaattctgaagaatccaagtcattttaggtctgcagaatttagttatataattctcttactactttgaaaatgtcatttgcttacatcgttcatacttctactcaaatttctctatgctttgtttttgtgaaactcttatcagatacagttactccttttcaacagcattgacatcaaagtccatgctcagaatcgtaacaagcttgaaatgtctgaatatacgatcaggttaggatgttatcaaaattccagcatgttcagacaagagacagctgaaacaacaaaacagtaggatattagcaactgcaaatctgcaatataactacataagtaagtcgacttcagtgcacatagttttgtagtagaaccatcaagttcatataacagcgaaaacaggactaaaaccatcagaaaagaacataacttgaataaagtttggacagaacacttcagttgagtgatcccactgaaatcttatacatcaaagatttccaagagttcatcaacagaagtttgccagttacaattcggctacaaatttacagcagatattgagataacatgaagagacaggagtactaattatctgaagacttgatatgctacaacgagcagttcacagcgaacaaatgtacttaactagattgtcaatggcgagagtcgcagcgacgcattgattcgcctggattttcaggcgacgcgctgtctccctcatcgcggcgccttcttccccaaccatcagcttcctcaccgccacggcgacgcggtcccggtcgaacacctcgccgagctccagcccgacgccccactggtgcgtcacgtacctcgcgttcaccgtctggtcggcgaagcacggccgcgcgagcatgggcaccccctcacagacgctctccagcgtcgagttccacccgcagtgcgtccagaacccgccgatggccgggtgcgccaggacgtccctctgcggcgcccatggcacgatcttgcccctgctcacgtcgaccccgtagggtagcgctggcatacagccgcggacggagccgggccggttgacccagaggaacggcacgccgctggcggcgagaccccacgccatttcgtcgaacatgtcgtggtcgatgcaggcgacgctccccaggctcacgtacagcacggagcgcggcgggtgcgcgtccagccacgcgaggcaggcgcggtccggaccgtacaggcgcacgaaatggcggtactgctccgccgccgtcctcgccgtggtgagcttgtgcagcggcccgacggcgaaggttggcttggacagctcggcctcgatcttgcccagttccgacgcctcgatggcgtcgaacgtgttgacgacgaccccagacgccgaatcccgcatcgcgtcggcgacgcgggcgatgaagccgcacagcgcctccgtctcgcagccgtcgacgcggatcaggtctcgcacccggagcggctccagctccggcaccgcctcatccagccgctcgcctgcagggataatccacaaagattcagcgagaacgaagtggcactcatctgagttctcccccaagattcaagctcgaattcatccgttcttgccttggattgggatgaatccggcgtcgcgcagccgcgggaaggcgagcatgctgcggaacgtggcggcgctgtccgtccggagcgcgagcgcggggacgccgagccgggccgccgcgcccagcgccgcgtaccactgcccgtccaccacggcgcacgccacgccggggagcagcgacgccagggcgtcccggaacggggcctcgcaggcggcgttgagcgcgaggagctgcgcgacgatgtcggcgccaggggaggtggcctcctcggggagcgccgcctcgtggatggggaggaaggcgaggtccggcccgtggcggtggcgcgccgggtcgggcgcgttggagcgcgtgtggaggacggtgacggcgagcccccgcgcgcggaggagatcggcgagctggagcatggggctcaggtggccctggaacggcagcgggaacagcgcgacgcggcggccggcgtggggttgccgttcgggttcccgttcttgcgtggccatcgctgccgtcctcggcgaggtcctggggcttgcgacttgcgaggtacaagcagcgagcgctagagagtactgacacggatttctttttcaggtcggtggagaattgtttcaacaaatgcggctatatgatattatgatgcgatggcatttgctaaggtagtacttccattcttatcacttgctcccttcgtttcaaaataaactaaaattaagtgaccagtatacatatgatgtgaccacttaccaagatgaaaccttctaattagaaaagtaattgagatgttttgttgtgcattaaatctcaatgctagtatagaactagagaaaggattgtgtttaactctctcttccatgatccaactataaaatttctgggtgtgttcgattcaaagaatggaagtactccatttgtcccttaaaaaaacttaaatattaggaataaagacacgatttgagtatttttagatagaatgagtagatttttagtggcatacgaaacgagataagacattagcacataattaattgagtattaattattacaagcttgcaaaatggacttattttttaaaaaaactttcatgtgcaaactttttaggcctttcacagtgctccacctagagcgttacttcatgcgtccacataagctgcgtgatggcgtggaagaaagagagtgtgggccttcgtcccttcactgaggtcttcgtttctcaacaaggatgcgactaaaacaattgtactctcaacaagggtgtttgtttcaaccgcatgtgtttgtttatgtactctcaacaagggtgtgggtcctcgtcccttcactgaggtcttcgtttctcaacaagggtgtgttcgattcaaagaatggaagtactccactgctttactcatgttttcttctcaaccaatcgtaatgttccttgatgattttcattttattttttaaatactcgtgttaaaccccgataatacttatattttgagaaagaggaagtagtcactttggttttattgtttgacacatttaacttataaatgtacatttatcattctttaatttatgtagtagttgttaaaaaatataagttatggttaaaatatcttttatgtaaaataaatggtaattacctaatattttaacaagacgaatgatgaaatatatatatatatatatattcaaaagttaatggcataaaacactgcaaaacaagaggaataactataacacgagaggtgttttcatgtttattaaaataagatgtcacggatacatcagcagtaatacagagaatcatggttagtcacacataaggacttgctatcttctcatcctatgaaatatcttttttttaaaaaaaatagcgtttcagattttacaaaaggctattgctgcaccgtgttcttcctctagctttgtttgaataaaccctttaattaatagagtagatacgtttgtcagttatactttgataggtactcctatattaaaactccgagttctgatgtacatagtacattgtcttttactaggcccttgtttacttctcagctttttttcttcaaactttcaatttttcatcacattaaaacttttctacacatataaacttttattttttttcttcaaacttttaattttagtcaaacttttaattttattgtggaattaaacacaccctagatttcttgtgatggtctgtggtgggtgcgggccgtggcgccactgacatgtggcatgataaattgtttattggtgagttaggcaaacatgtagtaggcctgttcggctgaaaaaaaaaaagcagcagccggctgctcgtgctcacctgcctgccgaacaggctcgtagaagaaagaaaatacatttcagcccatttaatcacaggattgaagaaatatagaaatatgaaaaagtcaggaatagtataggaaatcatatggaaaacagaggatatgttagaggattgaaaaacatagaaaaattataggaatgatcatttgattggtacaaagaaaaaacacagcaatgttgagtattaagttaatagcaatcaaaatttgaatggttttactagggtaaaccttatctttcaatagtgttttgcctacgcataggaaaataaaaatgagctcaaggtggatgttagtttttctatggaattcccttaaaatcatgtcataggaaattttctcatgctttttctatgttcaattcctacaaatcaaagggatgaacagtaccaaatcctataagattcttgttcctatgtttttcctctactttttcatatgaatcaaaagaggccttcatagttttattattctcaatgaggttgatcgtttgtgctgctttgtagttagctgcgggtgcggctgtgctgtgtgtacagtgcaagcagtaacaattatattaggtttggtgttgttgatgcggctgctcagccgcagcaatgtctcccgatcagccctaataaatagaattccaacactctcatagtggagatttgcttatcaattatatatattagtatataatgtagatttcatccaatgccatttattagcatacattagagattcgaagagtatattaaaaggaaaaatctaaagagataacatatggtccaccaacttatcaatagcttgctgagtagaacctccattcttcaagcatatcaatattttcttcttaagttcatctgccctctgcttaacctcagccccctcctcaccttccatcaacctcctaatggcctcctcaattttccatctctctagcttaccctccacccgaaaacctatctgccacgtctcctgcacgtacctcgcagtaaccagttgatctccaaagataggccttgacaacatcgggaccccttcgtaaatactctctaacgtcgagttccaaccattgtgcgtccaaaacccacccaccgcatggtgagctagcacctccgtctgcggtgcccaatcgaccactttgcacctaccctccaccgcttccacaaacccttccggtagctccggtttccccgagacaccgataacgagaccaggacgaaccacccataggaaaggccttccactgtttgccaaaccccaggctacctcgttgaactcatcctggctcaccatgaccacactcccaaaactcacatatagcacggatccgggctccttcgtgtccagccactcgatgcagctccggtcctggtccagcaggctgctcctgtcgccattgctggtgagcttgtggagagggccaatggcgaagaccggatggggcgccgagctcgtcacgaactgagcgcagttcaggggtttcaagagcttcgaatgtgttcaccactgtgccggaggagttcgttgtggtttcggtagagagagccaggattttgttggccatttcctcgttgaagtacttgcttgggtcgaacaggtctgatacacgcagtggtggcatctcctccactggcctgttcagctcagactctgaaacgaaacagaacaaaatttgttcaaatggaactaattaaggcatccgggtaactggtttggaatgggtatatagtcatctgaattaattaattgattgattaattactagtgcaattgtgtggttagatacgttgacatggttgtatttgaaatttaaaaacagagcttttttaacagatgaaacagagttgcattacatatgcaaaacaaactattgaccatctgttaatgaatttgaaaatccatttgaaatgtgtactggtcaaatgaaattattaaaccatctaattaatagctggagcaattaatttgtatttagaaacaagagtatccttaaagctaaaacagttgtatacaaaataaataattgaccacctgtaataaacttgaaatttcatttgaaagaattttagccgtatttttagaataaaatgattttcagctcacctttcgctggcaagtatcccttctcgcggagcatggcgtacgacctgaacaggcggaacgccgccgcgctgccggtggcagcacgatcgtcggaaggccgagctccgccgcggccttctgcgcccggggagcgcggcgtcgatgaccaggcacgccggccgctccggcccggacatcagcgacgcgagcgcgtcgcgggcgcacccggacgcctcgatggcggcgttgagcgccatgatcttggcgatgccgtcccggggcgccgcggcgagcgcgcgcgcgatggcgtcggccgacggcacggcgacgaacgcgagctccgggtgcgccgcctcgtcgggcgcgttgtaggccgtgtggagcacggtggcggcgagcccgcgcgcgtggagcgccccggcgagctgcagcatcgggctcaggtggccctggaacggcagcgggaacagcaccacgtggccgcgtggggctcgcccgtctcctctatctctggctccggccatcgtcgccgtcgtctcgccggcggttggctggccaggaagctttccttctattgtggaattggacagcccgttgctgttgcaggtttcggactagttgggggatcgatatatatatatatatatatatatatatatatatatatatatatatccagatttggtcaacaagtgaagaagcaaaaaacagtataattattagggattagtattcattaattaatttgcgtagtggccaacaaaagattttctagtgctgatgcctggatggttgaccgttgattcttcatgcttctaggaaagttcagtcagggtctgttttagtctgcgaaaagaaaatttttttgtatcacatcggatatttgaccagatgtcggaaggggtttttggacatgaatgaaaaaactaattttataactcgcctggaaactgcgagacaaatcttttgagcctaattaatccatcattagcatatgtgagttactgtagcacttatggctaatcatggactaattaggctcaaaagattcgtctcgcgaatttccccttaactatgtaattagtctttttaatctatattttaatgttctatgcatatgtccaaagattcgatgtgtgatgtttttggaaaaaaatttgggatctaaaccaggcctaacaatagtgatatgtagggttgtgagcagtagatgttgcctcttgtttctctttgtgattggtaaagtagcaatcaccatcctccaactaacctaggatatcacacttgaaggttgatgttgacctatcttaacctactactttctctgttcctcaaatttcaaaccgtagcttcttcaagataaagtttaagggcccattcgttttgaaggagaaataaaggaaaaacgtacaaggcccattcgttttgtagtatttgagcaaaggaaaagcataggaaaatttcctttggttatgattcctaagaaattccatatggaaattagcatccagttagagctcatttttctattcctacgcataggatgaaggcaaatcacttagggcctctttgatttggaggaaaatcataggaattttcgaggatttcaatcctattggaaaaaaaatcctatgaatacctttgaaacaagggattgaatcctatcctatccttcaaaaatcctatggaatggacaatcctatagagattttggagaaaattttgctagagcgtcaacctcttggaaaatttcctttgagtctctctctatcttattcttgtgtttttcctgcgatccaatcaaacggtcattcttgtattttccatgtgttttgtaatcgtctgttttgcactttaattcctgtcagaatcttttgtttttcttattccaacatctttttcattcctacgattcaaagggcccctcattgttctgtgtatttagccttaagttgtacagattaaagtattccaaccttgatcatgttaacttaatactaagcattcctgtatttttcctaccaatcatccaaaggatcaatgctatatttttcctatcatttgttttgcacacgcgttcctatacgattcctatgttttttttatattcctatgatttggaaatcttgtaaaccgaataagccctaagaaaaaagacaaaagaccaaaatggccctaattaataggaaagttgtattgatggataggttggtgaggggtattaaatggataattttttttgatttgccaatggatggtaagtaagaaggtagaagttggtttaattcgggacaaaattcaaacatagaaattgatttaatttgggacggaggaaatagtacaattcaccttcttgtggaatgaactatgtaacactactagccctaattatttggacaaaagagattctttgtccaaagaacacaaaaaaaaatccaaggattacaagagtttgctttgttctcataaatatcaatgtgaaatacttacaccaattaacttagccacttatgattcacaaagataagatataactaactagcctatcaatagcaatttgagaggacccaccgtcttccaagcagcgtgccactttgttcttaagctcatttgctctttccctcatctcagctccctcatttttccccattaatttcataatcgctttctcaattttgcaccactctaactttccctcgagctcaaaccctacaccccacaccgcttccacgtaccttgtatttatcatctgatctgcgaattgaggcctacatatcataagaactccctcacatatactctccaatatcgagttccatccaccgtgtgtccaaaaccagcccactgcacagtgtgccagcacctcctgctgtggggcccacttaatcaccttacccctaccttccaccgcactctcaaacccatccggcaagcatgctctctccacccccctcacaaggtttggacgaaccacccatagaaaaggatggccgctcttctccaacccaaatgcgacctccatgaactcgtcggagtccatggatgccaagctcccaaagctcacgtacaacacggaccctgtcgcctgcgtgtccagctactcgatgcagctctggtcttggcgtaggttgaaggtgttgctcccagtgttcatggaggagagcctgtggagtgggccagtggcgagcacggtggctacgctgtcgtcaccaagctcgccgtggaccctctcgagctccatgggttccagctcttcgaatgtgctgatcaccacgccattggagttcctcaccgtttcggcgatccgagcaagcacttcgaaaaccagttcatcacggtgctgaaaaggtcccttactcgcagtggtggtagctccttcactggttcgtataattgtgattctggttcataatacatttaccaaccaaaatataattaatggcggatataaaacttagcaaactttaacattttttacatgatctctatggatacaacacaaggattcaaagccaaataaaacctactccctctatttctaaagtttatttagcaaagattaagattaaggggaaagattctccttcagttatctctttagtcccgatgcttagattgcgtgcattcaaatatgtatccttaaaaatacttacattgtatatcgaatttgaatcccgtaaattcttatattagattcgttccaaaatctttatagtttgagacgggggtgtatgaaaatatgcgattgtttagtcctaacctttgggaggcagatagccttttgaagaagcatgtcgtaggcgaggtagcagcgaaggcaggcggcgctgccggtgcggagcacgagcgtggggatccccagcccggcggcggccttctgcacggcgaggagatgggagtctatgacgaggcacgcgacgctgggctgcccctcgccggcggcgaccaccgaggcgagcacctcgcggatgttggacggcgacgcggcgccgctctcgtcctccgtggcctccatggcggcgttcatggcgaggatgatctcggcgacgcgaccgcgcgcggcgacgtcgggcgggatgccgtcggcgacctcgacgaacgcgagctccgggtggcgcgacgggtcgagcgcgttgaagcgggtgtggagcacggtgacgcacaggccgccgcggccgtggagcgcgccggccagctgcagcatcgggttggtgtggccctggaacggcagcgggaacaccagcacccggcgccgccgctcgccgccgtggcgcgctcctcctccgacgacgctggcgctggccatcgcggtcagtaggatgtcgctcgctctgcgtgtaatcagctcgcgctaaaggcccagctgtcgccgttatttttctcggttttccaggtgggtcccacgtgaaaaggtgacgtgactgcagtactgcagaactggtaggggcgaaacaaacaaatcgcgttcggtgacaaggtgtaaagcaccgcatttggtattgttgacgttgcgctattttgcattttcttctggatgccagttgccacggagcagcagctatatagccagctaggcgtcaccagtcggagggtttttttttatactgctgtgataaatctttattttatatatacttaaaagattcatagtgtttttatcgtcccaactgatataggagaagagttgggttgtcggacgccgtttgcaccttccagcgctagtgaggctagggggtcacatggagccacggtggcatgggatgaattgaggcgtcgagtggcaaagtgggcatgaaaaatgaggagaggataaggtggggtcattgtcatgcacaaatcttaatgtgttctaggccgtttaaaaagtatgaaagtggttttctataaatatatgatatagaccgtcccttataatattgttgtaatgcttctcttgttctagtttgttttcacacatagaatcaaaattaagaatgagggaacatgaaaagagataaaagagataaagtttattaactcgtactatatggccgagcttaattaaacgcgaaaagaatataatatgtaagaaaacaaagggatatttggctcgtactcaacaatcaaacctaaggatgagagggagatattgtgacaagaaagataactccaagatttacagtactacttagtggtgcataaggatgaaggaaagataatatttctcacattgataggactttgtcccatctcttcttctcctatgcattggctattggcacttcagtcaaataaatgttgtgtggtgcatcaagagagagccacatacatggtgaaaattgtaaaggctatatgcaggggcggaatcaggcatagggcagctagggcttgggccccatgcctagctccataatccctattataatcttgaaaaatactatgtaatttatgaaaatatttaagttcccattagatcagtcctagacgtggaaactttctagctccgccactggccacatgacgtgaatatcatgcatagggcctacgagagatctgtgcgttgatggcaaagacgatgatgaaatgcttattgattcttgatgcctcacaacggaacagaaacagtgacaaactaaatgtggttgttcttagaggagtgaaattttacccctaggccagtgcgaagaaggacattgggagaatgaggacatctatatcacttgctttgatacatataaataagaaaattaaaggaaaccttcaacttcttcacaattcgtcgatggtagtattcacacgataagtacataattaaactcaagtgttagagagatattatataattcactaacctgttgatggcaatttgagaagatccactactttccaagcattggtccattttcttcttaagctcttttgctcgttccctgatctcagctccctccttttctaccatcaacctcttaatcgctttcttgatttcacccctttctagcttgccaacaagctcaaagcctacagcccacaccgcttctaagtaccttgtattcaacatttggtctgcaaattgaggtttacatatcattgggactccctcactaacactctctagcgtcgagttccacccattgtgcgtccaaaaccctcccactgcgtggtgtgctagcacctcttgctgtggggcccacttaatcaccttacccctaccctccaccgcacgctcgaacccatccggcaaacttggtttatccaaacccttcacaaggtctggtcgaaccacccatagaaaaggctggccactgctctccaatccccatgccacctccaagaactcgttggagtccaatgacgctaagctcccaaagctcacgtacaacacggatcccgtcgcctgcgtgtccagccactcgatgcagctccggtccgggcacaggtgcaggctgcccccggcgttcatgggggagagcttgtggagcgggccgacggcgagcacgatggcgacgccgtcgccgtcaagctcgcgccggatcctctcgagctcggccggctccagctcgtcgaacgtgttgatcaccacaccgttagagtttctcgccgtttcggcgatccaaccaagaactttacggaccagttcttggttggcgttgctcgtgtagtacaggtcccttactcgcagtggcggtagctcctccactggttcatagagttgcgactctgaaacaaatgacaataatattgtttctcttaattagacagtggatttaaataaaagccggcctctatatctcaagggatgtacaaagccacaatataaaacccggcctccactccacaatgatgtagttagaacttagagcatgaatgcaaaacgaaaggattgtttggattcaaaatgaaatggaaaactgtgatgtgaaaagatgatgatttggtagtgacctttgggaggcaaatagcccttttggaggagcgcggggtaggcgaggtagcagccgaggcaggcggcgctgccggtgcggagcacgagcgtggggaggccgagctcgcggcggtcttctgcgcggccatgaggttaccgtcgatgatgaggcacgacgcgcggggcttccgcccctcgtcgtcggcggcgaccaccgacgcgagcacgtcgcggaaggacggcgacgactcaccgccgtccatggcgacgttcagggctacgatgatgtcgacgatgttaccattcgcggcgacgtcgggcgggatgccgtcgggcacctcggcgaacgcgagctccgggtagcgcgacgggtcgatcgcgttgaagcgggtgtggagcacggtgacggacagctcgccgccgccgccgccacggcggccgtggagcgcgccggcgagctgcagcatcgggttgatgtggccctggaacggaagcgggaacaccagcacccggcgccgcctgatgcttccatcgccgccgccgcggcgcgtcgctccgtcgacgctggccatcgtgttgctcgccgtgtctcagctcgggcgcgcgaggcaaagcagacgggacggtgtgtgtaccggtttatcagctgcgggtggggtgggccccacgtgtcggtgacgtgacgtcctgacgactgacgtgcaggtgggtagtcaggtacgtagcggacgaagacgtcgacgctgctaggactaggaatagtaggaccaggcgtacgtgccgggctcgtgccggccggcgtttcgcgtcactggtgacgtcacaggcagggggcgggggacggataaaaaatccttgtcatgttacgaacaatgatagattatagcttgaaaatcgggtcttgttcctctatttcttgattcgtttcttagggcgaatttggattgctgccgtcctaattttaccaaagtgctaaaacttatataagtttaggagataactacacagtagtggtagctggttgngtctaaaccanctaccactccatctatgagagactctatacacctatacttcaaataaaattttctcttaaactactcatccgatttacgatccgattacaccgttgtgttcgtaataattaaatctttataacaagatctcacatgattatattttgatgaaaaatcataaattacttttatgatatgtctaaattacttttagatttcactaagttacttcttagacatataaaagtaaattcagcaaagccaaaaggtaatttacatatattatagaagtatcttagaacaaaagaaagtaactttaatgcatgcatttttcattggacatgactacacagctagtcgtagctggtttatactccatctagtgtctcctttcaagttgaaaaatacaatagtatgtatcttatgtgtgtcagggttacgggtcaggcataccctctacccttcgatatacgttacatatcgacatggcatacccacgcgcacgcggatgttttctacatatcctaaggaaacctttcacgaaatctacagatgggaagagtccttctcggacagaactgggtcgtcggcgtatcgtattgggtctgatatctccgagttctacttggagacctccagatctgtgatataaaagggaccccccgggggagggcatagatcatcgaatcatacaaccaacatagcctaagaagcaggaatctgcgaggagccaagtcattgagagctagttcttgacagaaaacacgaggcctgggagatctgcttaactccagtgcaggtccaaaactcaccttcggatgtatgagcgtgccagttgatttgatcttgtaattaacaagaaatagaacaaagaaaccgcaatcaatcctataaatgatagccgatcggctaggtgccgatgacatattatttatttcaagccgatgtcatgcgtacatcgatcgacaaatatcaataaacaaatcaggactaaatctactcgatcggctgtagatattaatgatatataatccttatatcgatatatacttaaatcaagtgattgggatagatcggtcaccttgccgagacaatataaatcacttagatcgaaatatatattaatagtgggattatatacttttatagcatagccgatcaaatggatctggcatgtatcggctaataccccgataccactctgtattaagatgttaaagcaagtagaatataccaaacataagtctaatatacttagatgcgataagatcttaacataaagggcagatttaacatatagattaagcatatggaataaaagtagttaaatcagataagatcggctgaaactctgatactaccctaaccggcaaccagaaagcaggctagagatggtagttctaagcacgacttagtagatcaaacttaactgatgcagcactaagtatgaaaagaaacacaatatctagacaatcaagccgctggaagtttcgtagagtggtagatatatcacataatctaagttaacgtcattgtctaacctaatcggctgccttccattaacagatgttagtcgattatgggttagataaatatattatcgaagattatgtgagatatatgataactcgacgaatcatatagacaagattagagtatcataaagatggaagcactaatcctaagaacataagtcgtcatgacaagttttacctcttgttgaagatcgaagccgatgcagctcaacccgagagcacgaacttgtcgaaataaaagtaaagcaaaaagggtggcgatgcgccgagattgtattggatgtgttctcctttttttacatagggctcgggtctatttatacccgagaattacaagatacgcccataacggacacgactattatctctaacaaactctaagataccataagtctttacggcagacttttgcccaaacatatctctaagaaaatcacatagaatatcctaattaataaatacaattgccttcctaggactctatccatgcgtggcaatcatcttgaagcacatcaacttgaacccgatgacatacaccgagtcatattgtcggaatcggctgtatcggctagccccgtccgactcgaactctgccgacctgaccttagccgatttggactgcagccgattcttactctgtttccgcaacgatcttcatcttggattccacttcgatctgatcttcatctccgatgcctatagtgatagaatttaccaaatttggtcgttaacacatgccccccatgtccggaatattggataatgtttcggatttgccatataccgactctgagagaaactcgcacttgctgtttttccgactgttatcgctctgctttaaatactaaccgttgccccaaaaaatctttacgccgtgatttccgtcttcaccgcttaaacagatcccgtcctctctctctccggcgacctcctcgacgcacagggcgatttccaggcgattccactcccggccagatctccacccgcgacgatgtcgacctccaccaatccgaccgccgcatcatcaaccgaatatgctgaggtaagccccatcggctagatccccttttccgttcatcagactagttttcgctcaccttatcttgttttcttcttctctattcttgtaacatctttccaatcttgttgcagttcccagtctgttgcatgaccaacaatactttctcggtccaatcggcaatctagaccccactgagtttatcatagccgaaaccaatagaaccccttttaggtcggccaatccaaccacaagccattggaaaaacaacttcaaatcctgaccttctttggagaaaagctggcctatatggtataagcggatatcggctagcaaacaagcccattgggatgagatctgaatcagccaagccctagccctcacaatagcaaattcggccaaagatgaacccctgatggctgctgcaacttatttctggtccaacactctcaatgcttttcttttcaaccaagggccaatgaccccaacgctgctggatattatcatgctcactggcctagatgtaacctcatcagctaaccccatgaacctgaacaccaagaatacttttgagttcagaactaagagcattgggggttggtcaggatatatcacagcatatatgggcaaagggccagtcactcctagagaacatgtagcttttttgctgatgtggttggaaaaattccttttctgcggatcaagctgcggtcctacaaccaactggcaattcttagccgaggccctagtaatgaagaaacaatttcccttaggcaaaatccttctcggctatctataccagatattaaacaacgcatcggccaagataattgtcggctcagtggttggaacaggtggaccatggtggctcttgcaatcctggctgaacctggtagtcatgaaagttgtcaatcggccatctgtgacagaagctgaatttccaaggttggagccgattgtggaagatgatggagaaaaacgcaccaatcacagatgtatgtcatatggagaatatgcatctacaccagccaacgcaggagcaaagttatcagctgaacttctgaaggactggttcttcagcttttatgacgggttccaaaaagatgcccgaatttggttcttctacgccgactcaatggatttcgaactgccagccgatttcaggtttgaagacattaatcatgaaaagtttcagcaatctagagaaatcttcactactgccatcagcccatgtatcctcccaattggcatccatcaagggagaaatattcagctctcttacgagttttatcatccaatgtcatcggccagacagctcggaatgggaaaactgctaatcggcctgtacttcaccgacaagatccagtgtagaggcaatatctcttcaaccttgatgatggatcggctactgaacatccctggacccccattaggcagcattgaaaacataaagttagcaagactcaggagtagggcatttgatagatggtggggcgagtggaagctacatctgttccatcaatcggcttccatgtacatgacagacttattccctgatgctatccctcaggttaatcttcatttcttcaatcttgcttgaatagtcattcagccgatttgaaccttgactaacttttcttctgttttgcagacaacagaatcttctcctcctcgccagagtaatagcggtaaggtcattaagtatgctccaggtctaatttcaaatggaggtgggccatctctttctaccatcggcttcaatgcccccaagacttcagcacttcttcaacggctcatcagagaaccagccgatgccgacaagaagcggagaaccagatcatcggctacagatacttcagccctggctccaaagaagaaggctaagacaaagaaagctaagccagctgacgatctacccgccctagatccatccatcgaacaagctctggatgaagaagaaatcggggaagacattgaccaagctgcagccgaaataaacgatactgaaagaacaacatcggcttcacctaagcaggctcctccattcccttctgctccagctcaattagcaagggtaagcaactttctctgcccacttttgcaatcatttactttatagccgattcctcacaattttaataaatatagagaaagaaaattgctgtgaggaagaaatcggttactctagcccctaaaccagctccaccagtaagatacttctatcatctcattaactgacttgggctgattatatctaacatttatccctttggcagccttctcctccttcttcccctcttgtgcaggtagaatcaggcggccgcactccatcggctgcaggcagtcatcatgttgaagaggaggaacaattagctgcacctactattccagtaagttttatcaacataaatttgagatcggccaatcatatcttgatccttaatcatccatgatattatctcttgcaggtcttagccgatctgttctcctttgacatcaaagattacctcgatgaaacagaagaagacaccaccagtaaagcaacagttctcccgtctgatgatgtgaagaaaacactcgaagacatctcccatcggctaggagcatcactagataacctggtgaccaactgtggctcgatccgggcaagatttgcagatatccaagcctttcttccggacgaattagccgatgctcttactctagctgtctacctcgagcagcatcaattcaaactggagaaagccaggcagaggttagccgatcgccgggagcgcaatgacatcgaggctacaatccaaaccaatcggcagcttgttcatgaagaaaaaaccaagcttgatcagttatttgaaggcccgatcaaatctaatattgatcggcttgaagctcgcaagattgaactcttggcacaacttcaagaatgcaatgctgaactggatctagagcacaagaagttagccgatctcccgtaagctgtcgaagaacagaaggcaaggctaaaatcagctatcaagaaagttgctgagatgactaaatccttgaaagtcattcctggaaccgatgctcaagacgcccaagctatcgaagaaatagatcaaattaggcaaagggctatatcagctatccagcgatacttgtctcagtgatttccatgtaatagtctagaaaactgttgtaattggctaagacaccctaattactttgctgtttatacaatccctgtaccatccttgtgccggcgtgttcaaaaatttgcaattttctttgcaattctctatgtatgtgcccccctaattttacaacgttgaaaacattgacaaaattatagaaacgactaagggcgatataacaatatcggccatgtgcacatcggcaaaccacaaccgattacaatagtaaaaagcaactaagggcgatataacaatatcggccatctcaaggcgatgcaaacacatcggctatgatgtatcggcaacactacccgatcatgcattaacacaaacactgggataatatttcttcaagtatttgtcatttagagctcggccataaacttttccatcgagtccttgcaacatgtatgctcccttagacactaccttatgaatttggaacggtccttcccaattcggcgaccacttgccaaatttgctatcctgagtcccaatcggtagaatcaacttccatacaagttcaccttccgaaaagtccttgggtactaccttcttattataatgccgggcaactcgctccttatccctagtaacctttgcaagggctcgtagccgtgattgaaccagatcctccctgtcatcggccataaggttataatactcatcggctgttaaagtatcttgcaactctgttctcctcgagccgatttgaacttccatggtaaaacagcctcatgtccataaacaagtttataaggaggaacctatatcgatccatgacaagccatccgataagcccacaatgcttcagccagccgagtatgccactgccgaggataatcagaaatcttcctcttaatcaacttgaccaaactcttattagatgcctcggcctgcccattagcttgtgcataatatggtgaagaagtcaacaatttaattcccatgctatcggcaaattgaacaaactcatcagatacgaaaattgaaccttgatcaatcgtaatagtttgaggaataccaaatcgatagattatatgctcttgaacaaactgtatagcatccccagaatcaactttctttaaaggaatcgcctctacccacttggtaaaataatcggttgccaccaatataaacttatgtcctttactcgagggaggattaatcataccgatcatatcaattccccaacctctaaaaggccacggtttaataataggattcatagccgatgccggcgccctttggattgctccaaatttctgacaatcttgacaacctttataatatctgaaacaatcctccagcattgtcggccaaaaatatccagcacgtcggagcaaccacttcattttatgagccgactgatgtgtaccacatatcccttcatgaacttcgccgattgcaacttttgcctgatcggcactcaaacatttaagcaacactccatcaatcgtccgataatagaggtcatcatccaataaagtatatttctgtaatttccgcgaagccgattgagatggattctgtaaatactgaaacacatcatatctccaatcatcggctgtaattgtggcaatctctatctcgatatcttttgtcattggcttatatcccgatgctccttgagccaaatcattagcctctatattctgttctcgagatatgtgcctcagagtcaccagccgaaattcacttatcaacgttcggcacttttcgtaataaaccatcaatgtatcatccttgcattcatactctcctgccaattgactaatcaccagcaacgaatcacccatgatttcaatagcatcggctgcaactttctgaagcaactgtaacccttttaaaaccgcctcatactcagcctgattattagtcacatggtgtttaatagcataggcaaattcaaaactttccccccaaggcgcaattataaccaagccgataccataaccatgacttcatacagatccatcaaagaataatacccaaggcataacgtcaaccaagccgattgaaccatcacgatgacccacgataaaatcggctacagcctgtcccttaatcgcctttggtgattcgtgccgaagatcaaactccgttaaagaaaatatccacttgccaactctcccttttaaaatcggagccgataacatgtacttaatcacatcggctttacacaccatagtgcattcattggacaacaagtaatgcctcaacttagtgcaagagaaatataaacacaaacacaatttctccacaggagaataccttgtttctgcatccaagagccgacggcttaaataaaacacaacccgctcttttccttcaagctcctgaatcaagaccgagctgattgacttatcaccggccgacaaatataaccggaaaggaatccctttttgtggaggaatcaatactggaggagaacttaaatattctttaatattatccaaagctttctgttgttctgcccccaagtgaattgctgatcggctctcaatcttaacaatggtgtaaaaggttccagttttccagacaaattagaaataaaccttcgaacaaaattaattttgccgatcatcccctgcaactctgtcttgtttcccggaggcttaatctttttgatcgcaaggatactcctctgaggtatttcaatccccctctcatgaacaagaaatcccaagaactggccagccgatacaccaaaagcacattttgtcagattcatcttcagaccatacttcctagttctctcgaaaacttttctcaagtcggctatgtggtcctttatttctctggatttaacaaccacatcatcaatatagacctcaaccaaccatccgatcagatcatgatatatataattcatagccctctggtacgtagctccagcactctttaagccgaaagtcattacaacccattcgaacaagccgattgcaccaggacatctgaaagccgtcttatggatatcttcttcggccataaagatttgattataccccgcgttcccatccataaaacttagtatcttatgtccagaagcagcatcaaccaactgatcggccactggcatcagatattcatccttcggggtagctttattcaaatccctgaaatcaatgcagaccctcaccttaccatttttcttgataacaggaactatactagaaacccattcagcatatcggcaaggataaataaaaccagcatcatacaaacgtttgattttagctttgacaggttcaagcatatcagccttgcatctcctcggaggctgttggtgtggtctaatcccaggttttaaagataatcgatgctcgacgatcgatcggctgagtcctggcatctcataatattcccaagcaaagcaatctctaaactctttcaaaagctccatcagcttggttctaaattctgaagacaaattcttactaatgaatgtcggccttggtcgatcacccggacctatatccacttcttctaaatcatcggccgacataaaaccctgaccttgcttgtcatcgagatcatctaccgtgtccttggcgtagacgcttgaaccctccacgacgccctcaaaatattagcttgggttcttcatcttcaatcggctgtatatcagaatcggacacttttagaaaatctccaacccaaatcttcccggataaacaatcaaggccatccatctcccaaagagctagatcggcactggcaacattaactgacctgtcggctggcacaatctcaaccttgtcgccttgccattgaatcaagcattggtgcatggtcgaaggaatacaacaattggcatgaatccaatcccttccgagcaacaagctgtaagaacctttcccatcgatgacaaaaaatatggtaggtatagttttactgccgactgtcaattctacattcaaaacgccctttgtttccgatgggttgccaccaaagtctttaagcaccatgttcgtcttgatgagatcctcagtagttctacctaactttctgaacgtagtataaggtatcaaatttaccgcagccccaccatcaaccatcatcttagacatcggctttccattgacatagccatttatatacaatggtttaagatgccgattttctgtcccctcaggcttttcaaagattgctcgttttggtgatagaaccaacttagccgatccctcttttaattcgtcaacatcggcctggccaatcccaaatttggctggcaaagtaaagaccatgttaattggtgccgtcacaacacttttcccatttgccaacctctttgcttcgtcggctgcaatatcatcggctccaagaacttgattcttaacacgccactccttccttggctttgcttttctcagccgatgaccaatttcttgctcgacctcctggaagtgctccctgctcctcaacctttgaacccttcttttctgattctttgtaaaaataccagaaggacaccactgggtctttgtgttcttgtcttcctccaagtaatcgtcttgatttactgggcccaacctttgatgagcgggaattctcgcctgcttcagccgattgcctttattgtacgatcggcctgaactctctgtaatatcactgcacccaggacagtcttcaatagatgtagcctcataccttcgttccagcagaaccgaaagaactcacaactccaatgaggattgaaaccatcattatcttctccataacgcctctcttgttgtttgtcgtatttcctcttatacttatttataattttagccgaattcacgtaaaaacctcttgctcgtcccacatcggctgtccgaccaacggtatgcaccatgttaacagggaaaggattaccatcgaccttcatcggctttttggaatcatcaaacttaatcttccctccttcaatggccacttgaatctgctgtctaaaaaccttgcaatcattagtagaatgagatccagaattatgccatttgcaatacctccttttgccagttcctcagccgatggaatcacatgaccagcggggagttgaatttgcttctcccggagcagcagatcaaaaatcttgtcagctttggtaatatcaaaatcatatttctcctctttcccagaattctttacccactgacaaggtacaacctttttactccttacccattcggctgcagctatttcggagtcatcgtcatcatcatccgatccatacatgtaagggcagacgtgattaaccctcttagagcttctcctggcctctgcaaacctctgttcatgcaatgttaccttctgcacgagatgcgataagctatcaaaatcttcagatgagaatttctccttaatcggaggaatcatgccttgaaaagccaaatcggctaactgggcgtcagtcaaacttaagctaaagcacttgttcctcatctccctgaacctctaaatatactcatgaacaggttcatcatgcctttgcttaattgccgtcaagtcggataacttcatctcatgaactccattatagaaatagctatgaaactgcttctccaaatcggcccaactattgattgatccatacggcaaagaagaaaaccatgtaaaagccgatccagacaaggacaaccggaataatctgactctaagagcgtctacagccgatgcttcgccgcattgagctaaaaatcggctaatgtgttcataagttgacacaccatcttgtcccgaaaatttggagaagtctagaactttaaatcggttgggaagagggactttctcaaaccactcagggtaaggttgccgatacaattttccagtatctctcggcttaagcccaaattgttctctcattacatcggcaattacatcggcccatggtcgttgttgagctgctccttgcgactgttgctgtattggttcaaactgattatattgagaagcaaactgaggttgggttagccctccttgctgatactgaacttgaggggaaggatgctgatactgacaatttatattgccccttggtaattctggtaatttggctgaatactttgcaccaagtgctctggcacactctgaggcatcgtcgtaccatctggctgtatatggtgaaccaaatgttctggaataacctgattcacggcgtgtccagtcgattgcccagccgattgattcatcaaggcttgctgtggaatcggttgtatagtttgttgtttcggaggtgttggctgaacggactgcacaacctgctgccttgatgaagtctgttgaatcggctgcacaacttgttgccttggtggcgtctgctgaatcgaattgatagtagattggaggggtaaaaacatagcagccacctgatcctgtgttggccgatttaccgtctgcccgctatgctgtggctgttccctcatcaatagccaaggattaatcagctggcttggtgtcaacgctgatgaagtaggcaaagaagtcaatagcggtgccatcggctgaaccgatggtgcactcggaagaactgcttgagcaggtggctgagcatcagtgatcaaaggtcgatatttcggaaaaacacctccctgcaagtagaccgggcctgcagcttgatgctcagctattgatccatcggctatcgtcttcatcatgttagacaatgtgttgactaatactccagattgattgatcaaagcatggtgtacggcgtagtccactcgatcttggaaattgttgaagaaatcttgtgctgtctcactattctgattaagatttccttcttgtggctcgtgagcaccatcacattgaactgcatgtacctcctgagagccgtcaccctgattctcttgagccgagtcatctaaaactctttttccttcttcctccttagaggtactggtctcaggctcatcgggaaccacctttaccttgtacttttgaataaatgttcccttgcgagtctgtgtgaatgacctaaagaactattctcgtgcttgttgcatcattgcttcaaaatccttcttctggtcaggtgtgagcttttccggatcaacagccacaatattctcttcattaactttgctcaaacctagtctttggattttctctttaacagtacctgngctagccgaggatggcgacggtggcagcttctcggccatgaggaagattgatttctgacttctaacctgtcccaccaggcgtgccaaaagcgtgttgacagaaaacacgaggcctgngagatctgcttaactttccccaggttgcaaggtttcccaaaaaaaccctttttcgcttcagatgtatgagcgtgccagttgatttgatcttgtaattaacaagaaatagaacaaagaaaccgcaatcaatcctataaatgatagccgatcggctaggtgccgatgacatattatttatttcaagccgatgtcatgcgtacatcgatcggcaaatatcaataaacaaatcaggactaaatctactcgatcggctgtagatattaatgatatataatccttatatcgatatatacttaaatcaagtgattgggatagatcggtcaccttgtcgagacagtataaatcacttagatcgaaatatatattaatagtgggattatatacatttatagcatagccgatcaaatggatctggcatgtatcggctaatactccgataccactctgtattaagatgttaaagcaagtagaatataccaaacataagtctaatatacttagatgcgataagatcttaacataaagggcagatttaacatatagattaagcatatggaataaaagtagttaaattagataagatcggctgaaactccgatactaccctaaccggcaaccagaaagcaggctagagattgtagttctaagcacgacttagtagatcaaacttaactaatgcagcactaagtatgaaaagaaacacaacatctagacaatcaagccgctggaagtttcgtagagtggtagatatatcacataatctaagttaacatcattgtctaacctaatcggctgccttccattaacagatgctagtcgattataggttagataaagatattatcgaagattatgtgagatatatgataactcgacgaatcatatagacaagattagagtatcataaagatggaagcactaatcctgagaacataagtcgtcatgacaagttttacctcttgttgaagatcgaagtcgatgcagctcaacccgagaggacgaacttgtcgaaataaaagtaaagcaaaaagggtggcgatgcgccgagattgtattggatgtgttctcctttttttacatagggctcgggtctatttatacccgagaattacaagatacgcccataacggacacgactattatctctaacaaactctaagataccataagtctttacggcagacttttgcccaaacatatctctaaggaaatcacatagaatatcctaattaataaatacaattgccttcccaggactctatccatgcgtgccaatcatcttgaagcacatcaacttgaacccgatgacatacaccgagtcatattgtcggaatcggctgtatcggctagccccgtccgactcgaactctgccgacctgaccttagccgatttggactgcagccgattcttactctatttccgcaacgatcttcatcttggataccacttcgatctgatcttcatctccgatgccaatagtgatagaatttaccaaatttggtcgttaacactagtcaaatcaactcgactacgatctcgtcggatccgacaagttccatcgtcctctttgtaacttgtgttttccaccatataatcccatatcaactggattagggctattacctatcaagaggcctgaaccagtataattcttgtcttttgattatttgatgtcgtacttcgtagatccttgtaccaacgtaccccaataccctctatatccggtctacgggtatcacccgtcgacagtggcgcgccaggtagggggacttggtactcatggttctactactatgtcatccaacttcgtcgacaacaacgtcaacactagcctcagccaagcgctccctgcttcaacaatgctggtatggtctcaagtcggcgaaatcgtcttcccggtttacaccacaacgccgatgtcaaccggtcctccaatgatcggaaacgagaatgcagtggctacaaatcaaggcgactccatgtcgaaaaatccacccgtcgaaacggagaacggatcatcgatgacatccaagctcgggaaggattctgatacggccaaaccttgtccttccgacatgaaccacgagccggcaaagatgacttccgaagccacaaggtcttggtgtcctatccacaaaaccaagaaacacaccctgcaagattgctgggttttcctcaacgtccgtgctgaaatccatgcctgcaaagaacgtggaattcagcgtacttctccaactcgggatgtctattgtcctattcacaagacaaagaatcacgacctgttgagttgcaaagtcttcctcggcgccatgaaaactccgtctcctaagtcatacgtccctgtcagggataacggcaaggaacaaggagcgactccagcctcagatcgattcgttgggataatcgatatcgatcctcacgaaccatcggtcttacatcttctcaaagactatgggtcatcgacaacgagcgtgccgcgagaggtattggctatcgatgacgttggcacgtcagcgcaagccaacatagaagcggcgaatcatactactccagcccaacacatcaaggctgttcaagctatactgagggaaactccttacgatcctgttctgaatgatgacctcgagcgttggacagaacgactacgggaatcagtgaccaacctcagcaacgcgtttgaagaagccactaccgcagcgcaccaagatcagccgccaactagcgacgccaatggtgaagatccggaacggagggaatcacctcaacgagccactcctccacctcacggcgctggcgatctctgagatcaaatcaacggccgccgagaagcacgacgcacacgagacaatgtaaatcgctctcggcgtcatgtctcttcacggcgtcatgataatggaaatcgaggagaccgctcaaacgaggaccgggatcacgacaaccaccacgatcgcattgatcgcgaacgacggaggccagacaatactggtcatggccgccgccgtaacgacgacgataatggagatcggcgccgagacaacagcgagagacaacgacaggattcccgagatccaggccgtcatcctcgtaatcgtacgccggaaccaagcgacccatcgtcatcatcatcatctgcgtcctcctgactgtcagacagacatccatgaaggacacacgaccgccgacaacccaccgcccccaacgctgggtgcagggctttcggtcgttccctacgtgatgttcgatggcctgagagatttcgacccggagcaattgaaaagtatgatgggagcaccgacccagaagaattccttcaagtctactccacagtactctatgctgccggagcagacgacaacgcgctagtgaactagagattcctccaagtatgtcgacgtttgatgtcgtcattctggtatttgcatagtatggggatcatcggtgctaggatatatgcgaaactgaggtaaaagagatggagacagggatttttatacaggttcgggcccctgagtggtcaggtaataaccctatatcctgttggccggagccggagttgcttttattcaccataattgtcgcgaccgagaaaaatacattttcccgaatgctagtgtattaatccccgtcccaggaaaagccggggtacaccacacaaacacgatataaaagacacatctttattatatcgataatatttacattatgacaaaggcacttaaggcctgacaatcaaaaataaacagcagcggactagcgggcctacggctccatcttcacaggcgctcaactggggtataagccaggactccacctaagacttcttctccaaatcttctcttactgaagggggggggggaaagattgagcaagaatgagtacaaccacagtactcagcaagccacaccgacagatgcatgattaatgcaagggggtacaaggggtaataatataggggttaagttttgcagtaaacagcttttaaaagtcacttagttgcccaaagccattttataaagacgatcctagagctacacagtgttattaatcaaggccgtgaaccctcacgaacctgccttaacctaaggcctaagatgattcagaccgaactggcaacccgaccctgagtcccagctcgtcccaagccaactcaggccaaccattccacattttagttgttaagcaggttttaagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggattgagcccctagcagcaggacaccagccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgacaaacaaaacccaaccacgcacctcgagcccagcctaaaaccattttgggggttttgaatagagggggaggtgtgtccaattccaacataagccaaccattccatagtgtccaaatgatatgagaattcccaaagtctaaagttataaaaccacctaatgttgcctaattaatcagcgaagcatctacctaaattcataccagtggaaccatgaatagagtacccactagttggggttttattttcctagggtgaacaaggtaataataacaatagcaataataataaggtcataacaaaggtaaataggcatggctaaataaaacaatgataacgcgggaatttaaataaagcgataatacgttaatttaaatcaaaataattttataaactgggattcaatatgctcaaggatgatgtgacttgccttgctcagagacaacggccttccgaaccttcggcgacgaccacgaaccacgcttcgggaacctccggaacgacagaagctacgcgaagcacacaagcaaagctacaagcctataaagaagcaataacaatacataaaaagaaaacacatggttctttaggttataaaaaacattaggagacttgaacggatcgattcggagctcgtatgaccaagacatggtcatccgaagtttaatgctgttatatggagatttgcggattattataattaggttttgcaactataaaacatgtgtaagcgtcagcctggaaaagacaggaaggctgcgctgttgacatgcggaccccacatgtcaacctaaaggaccacagtagacagagtacacagagacggtccacgggtcgacggaaccggaccccgtgtgtcaaacgaggcaagtggccgacaaacggactccactagacaccacgagggctgcacatgtggaaaccacgcggctaccgagcgcgcacacaaacacggtcaccacatgcacacacgaacgactaccgacaccggtacacgggtaccggtgtcgacaaccgcacaacaggcacgggcgacaccgaaaggatgaggacggggcagtgagggagagggatccttaccaccacgcgacaaggcgtgggaacggagacggctcggggacgacggaagcaaacggcgagggaacaacttcggcggcgatccttgaacgaaggcgagacacggccggcacgaggcttgatgacgcagagccgaggacgaagatgacgacggggctgcagtggctcgcatgacgaactacgggcggcgaacgcgatcggcttgacggagggacgaaggccacgacgaccgggaacgacgggaggacgacgacgacgacgaccggggccgtcgaggaggcgacgtgggcagcctacagcggctgcacgaagacgaggatggcgtggaacacgccgctacgatgccgacgacggaggcggcgccacgagacgacgagtcggcgaggatgagcggtgaagacgacgacggacaccggcggtgtttgggtggaggggaggcgaggccgagggcgaccttgccgctgcgatgccggaggtggtggtgacgcagcgagccgacaagccggggaggacgaaggggcggccgaagggacgtcggcgacgacgaggatggagaggccggcgcgggcgacggcggtctccggacgaaaccgagggcaggccggggtggaggtcgacgcggtgatgccgagggaggagacggcgtggccggcctgcacctgagcggcgcggcaggggcggctggaggcggtgggtggcgacagtgccaccggttgccggcggggacgtgcctccgggggtctcacgcgaaacggagggcaggccgggggagaggaggctgctgtgatgtcggggaaggcgacggcacggccagcccgcgctcgggcgaggagggagaggcggctggaggcggccggcgcaggggaaagagaaaggtgacggcggggaggggtgatacgaccacggggaggctcgggatgaggctaaaacgatagaacggaggatggggattccattttataggcgcggggagggagccggccacgggaggagcggggaacggcggcggaaagccggccggcggccatggaaggtggccggggttggcgcgggcgttcccgacgattgggggcacgaaccaagggggaaattatgaggaattgaagaggaatcaatggggattaaaaccccccaattaattttggaaaccccggtttgaatcacgtggattttggggaggaagcgagctagggttcacgggagagagaaaggaggccgggcgggaggaggacgacaacccgggggtgggacccacgtggccaggcacgcgtcagcgcacgcacgtgcgcggcacgggcgggaatggcgccgctcggcttgggcaggggcgcggcttgggccgagcgaccggcccaggaggagaggagggggaggcggcctgggggagagagggaggaggagggagtgggccgaggggaaggagaggaggcccaagagaaggagggagaggaggagagggagaggaagagagggaggaagagaggactttggccgcgggccgagagagagagggaggctttgggccagacttggcccaaagggaggagggggattatttttaggttttctttttaataaactttgttaattgttgttgttgtttaataaatatttccggtgctctgaaaattcaagtaaaatttgagggctccttttagagcaaggagaatttaacaaaaattctccggaccacattcgaatttttcttgtacgtattttagtgtttgccaatttcttttcgaattttaattaattctatttttcctttttgaaaatgacttttattttgggatgaatttatcaggacgtgacaataatcacaccagtacaatatgtgggcagcctatctaactgttgtcgacatgttggtccgaaggtctgactcgtagtcgacaacagggtagtcttccttctcggatccgtgcccggcgagatcacagatagcgctttcatatctcctgacggtatccggagacaccgtaggggaatagctatgcctatccctgaagtcgatatccggcggcaagtcttggcgtatgttggcttgtatgttgattgtgttgggtgttgataaggtggtcgtcccgatcgtggtgatcgtgttgatcgtctcatggtgagtgtctgtcccctgtcttcctaggagggcttgtatttatacccatgggtgtccccttgtccaagtagaactaaggaaaccaatatggatacaatccgagtagtccttgtcgtttccatgtagaactctggttgtctttccttatccggaactccctccatatctgaagtcagttttcgtataggacatggtatgtggtgagtcctgccgagatttagtcaactactattaggtatgtggtacccataaccatgacagtagcccccgacttcaatgcaaatgaacgaattcatattctcaatcgcgcgcagacttcgaagtaactgccatcgagctcatgtgaccattctcggtgagtttagagataatgttagacttcctttgtcagcctcgtgcgggcacctaaagggtttgtctgagtcaatctccgatgtcaaccaaggaagtacatagcgtacgactaagtctcccgtcttgccgtaatcgagaatttggattgaagtcaagaaattctatctcggagggtacaccatcttttcattccgtattccttgtcaagatccagcaaccgttctcgagtgatcgagaaggcgtagagtctgcgacgaagcttttagtcgatcttggtgtagaaccatagagacatggagtcttcgtaaatgtcgaatagaattttcctgaaatcaatactcagaaaagaatatcaaatagaaatagccctcgagcgaatgcccaaagggtgacatgttataatatgtatggtaaattgaaaatgaattaaatttaccgaccaatgttttgtgtaagagtgttttctcagttcacaactttggtcagtcgtttgagttgtacactctccctagcccccaacgttatcatcggagaatcgttctcggaggagaaggctcttggacccttgacctgccttggttgaataagcactgatcctagcccccagccgtgaagttggaaaagtcaatttccgattatacggcttggttaatacgcatggcgagaactcttacacgaccagatcttacatggtctttcgtctttgaaggatccgacaaggccttatcggctctgggcgtcccaagccaaagatcccttaggttcctcggaggccttgtcaagacggcgtaaagggacagcaggataggtttcaatgctaggtgtcgtcgtggtaagggatctctaggtaaaacacttggcgatattgtgtacctgctaccaactttgttgaagtagaggtagtgggagaaatcgctacaccgctggtcgaggaccaggcagtagccgtaactcgaccacttaaagtggaagtagttggaggaacactacatcgctggtcaaggaccaggcagtagccgtaactcgaccactgaaagtggaagtagtcggagatattgctgcgtactggtgcgagaaccagtgagcgagcagaattatctctcgaacaccgatggaagctgcggtgtgagagattgctgcgtactggtgcgagaaccagtgagcgagcagaattatctctcaaacaccgatggaagttgcggtgtgagagattgctgcgtactggtgcggtgaaccagtagtccaccgatggaagtgctagagttggtttattgcaagtgtatttcatgtggccagcatgactcacgtacccaacttatagcatatccggatgtctgttcgcaatcatgtcgggtgatcaagccgacgacgttgaagtagaggtagtgggagaaatcgctacaccgctggtcgaggagcaggcagtagtcgtaactcgaccacttaaagtggaaatagtgggagaaacgctacatcgctggtcgaggactaggcagtagccgtaactcgaccactgaaagtggaagtagtcggaggaatgccacatcgctggtcgaggaccaagcagtagccgtaacttgaccactgaaagtagaagtagtcggaggaacgccacatcgctgatcgaggacgaggcagtagctgtaactggaccactgaaagtagaagtagtcggaggaacgccacatcgctggttgaggaccaggcagtagccgtaactcgaccactgaaagtagaagtagtcggaggaatgccacatcgctggtcgaggaccaggcagtagccataactcgaccacttgaagcaaatgtacgagagatcactacgatcaactggttgaggactagtgcgagatattgctgcgtactggtgcgagaaccagtgagcgagcagaattatctctcgaacaccgatggaagctgcggtgtgagagattgcttgaccactgaaagtagaagtagtcggaggaacgccacatcgcttgtcgaggaccaggcagttgccgtaactcgaccactgaaagtagaagtagtcggaggaacgccacatcgctggtcgaggactaggcagtagccgtaactcgaccacttgaagcaaatgtacgagagatcgctacgatcaactggttgaggactagtgtgagagatcgctgcgtactggtgcgagaaccagtgagcgagcagaattatctatcgaacaccgatggaagctgcggtgtgagagattgctgcgtactggtgcgagaaccagtgagcgagcggaattatctctcgaacaccgatggaagttgcggtgtgagagattgctacgtactggtgcgagaaccagtgggcgagcagaattatctctccaacaccgatggaagttgcggtgtgagagattgctgcgtactggtgcggtgaaccagtagtccaccgatggaagtgctagagtttgtttattgcaagtgtatttcatgtggccagcatgactcacgtacccaacttatagcatatccggatgtccgttcgcaatcatgtcgggtgatcaagccgacgacgttgaagtagaggtagtgggacaaatcgctacaccgctggtcgaggaccaggcagtagtcgtaactcgaccacttaaagtggaaatagtaggagaaatgctacatcgctggtcgaggaccaggcagtagccgtaactcgaccactgaaagtggaagtagtcggaggaacgctacatcgctggtgaatgaagtagtcggagaaacgctacatcgctggtcgaggaccaggcagtagccgtaactcgaccactgaaagtgaaagtagtcggaggaacgccacatcgctggtcgaggaccaggcagtagccataacttgaccactgaaagtggaagtagtcggaggaacgccacatcgctggtcgaggaccaggcagtagccgtaactcgaccactgaaagtggaagtagccggagtaacgccacatcgttggtcgaggaccaggcagtagccgtaactcgaccacttgaagcaaatgtacgagagatcactacgatcaactggttgaggactggtgagtaggtgtccctcgatcacttggagtcgtggtacgaggaccgctacgctgtcgtagtcgtaccgagagattgctacgtactggtgcgagaaccagtgagcgagcagaattatctctcgaacaccaatggaagttgcggtgtgtgagattgctgcgtactggtgcgagaaccagtgagcgagcggaattatctctcgaacaccaatggacgctgcggtgtgagagattgctgcgtactggtgcgagaaccagtgagcgagcggaattatctctcgaacaccgatggaagttgcggtgtgagagattgctacgtactggtgcgagaaccagtgggcgagcagaattatctctcgaacaccgatggaagttgcggtgtgagagattgctgcgtactggtgcgagaaccagtagtccaccgatggaagtgctagagtttgtttattgcaagtgtatttcatgtggccagcatgactcacgtacccaacttatagcatatccggatgtccgttcgcaatcatgtcgggtgatcaagccgacgacgttgaagtagaggtagtgggagaaatcgctacaccgctggtcggggagcaggcagtagtcgtaactcgaccacttaaaaaggaaatagtaggagaaatgctacatcgctagtcgaggaccaggcagtagccgtaactcgaccactgaaagtggaatttgtcggagtaacgctaaatcgctggtcgaggaccaggcagtagccgtaactcgaccactgaaagtagaagtagtcggaggaacgccacatcgctggtcgaggaccaggcagtagccgtaactcgaccacttgaagcaaatgtacgagagatcactacgatcaactggttgaggactagtgtgagagattgctgtgtactggtgcgagaaccagtgagtgagcagaattatctctccaacaccgatggaagttgcggtgtgagagattgctgcgtactggtgcgagaaccagtgagcgagcagaattatctctcgaacaccgatggaagctacggtgtgagagattgctgcatactggtgcgagaaccagtgagcgagtagaattatctctcaaacaccgatggaagttgcggtgtgagagattgctgcgtactgatgcggtgaaccaatagtccactgatggaagtgctagagttggtttattgcaagtgtatttcatgtggccagcatgactcatgtactcaacttatagcatatccggatgtctgttcgcaatcatgtcggttgatcaagccgacgacgttcgcgaggaattatccgttaacaaccttttctcgagtagtccagcatggccggtgttatgagataggtcgtcggtctttgttggtaggttgggtgcgatagctccgcatatgtcgagaatgttctcgataatggagtgtactctaccataacctactcgagtgctgttcctgaaaaatattttctagaaggcaagatatatagcagaaaatatcgagtatgtactcaaaaaactgcatggagcttctagtattatcaggagataacgagtagatgtaaatatcaggcattatgtaaatcgtaaagaagcatgatttatacagaagaaaacagagcgagcccccagcgttagaccgtagttggcctatcgtcggaagtactcgcacaacggatattgtataagaaacatgctctaggtaaacataataaattatagatctgataatgctgtataatctggataggtacgataaattgcatagaaaatattgcgtacctttgtagatacatgccggatgtatctacaaaattagtagatcaattaagttaattaacctactaattaccttgatttgcatgcccgatatactatctacagaagatatatatatatatatatatatatatatatatgcgcatgcagtagactttgatgtatcttattggtttggtcgtagagcagtgtaacctgtcacatgcatacacgtgtctaggcatgtgtacgtgacatggttaggcaagcgtgctcggttgaccaactccgggtagaacacgacacgtcagtgacacagcggcacttgttctcggatgaatcatgtgcagcctgcgtcgagcgattttggttgtgggaatcgatgccgtgttggatctgggctgaagtcgcgcgggcggcaataccgatttgccatcctccatggtggccacgtcttgatgaagattgatcgatctcgccagatcgaaaatttgacaatgatggttccgatcttgtcggaagacatgctctgaccgggttagatctccacagccgaagtcgtcgagtagcttgttgtcggagaatccgtcttttgaaccaatctcgtcgaaatcctagagcaccaaaatccccctacctggcgcgccactgtcgacgtttgatgtcgtcattctgctatttgcatagtatggggatcgtcggtgctaggatatatgcgagactgaggtaaaagagatggagacagggatttttatacaggtttgggcccccgagtggtcaggtaataaccctacatcctgttggccggagccggagttgcttttattcactataatcacaccagtacaatatgtgggcagcctatctaactgttgtcgacatgttggtctaaaggtataactcgtagtcgacaacagggtagtcttcctcctcagatctgtgcccggcgagatcagagttagcgctttcgtatctcctgacggtatccggagacaccgtaggggaatattcatgcctatccctgaagtcgatatccggcagcatgtcttggcgtatattggcttgtatgttgatcgtgttaggtgttgatgaggtggtcgtcccgatcgtggtgatcgtgttgatcgtctcttggtgagtgtctgtcccctgtcttcctaggggggcttgtatttatacccataggtgtccccttgtccaagtagaactagggaaaccaatatggatacaatccgagtagtacttgtcgtttccatgtagaactctggttgtctttccttatccggaactccctcaatatctgaagtcagtttccgtataggacatggtatgtggtggatcctgccgagatttagtcaactactattaggtatgtggtatccataaccatgacaaccgacccagaagaattccttcaagtctactccacagtactctatgctgccggagcagacgacaacgcgctagcgaactatttaccaaccgcgttgaagggttctgcacgttcatggctgatgcatcttcctcccttttcaatctcttcgtgggcagacctgtggcaacaattcgtcgccaattttcaaggaacgtacaagcgccacgcgatcgaagacgacctagaactcaggtgagacgacctagaactcaggtgaatcattgagggaatatgttcgacgcttcaacgaatgcagaaacacaatccctgatatcgctaacgcttctgtaatccgtgccttcaaatccggtgtcagagatcgttacactacccaggaattggtgacaagacccatcacaaccactcggaggctattcgagatcgttgagcgatgcgcccatgtggacgatgcgctaagacgcaagaacgacaagccgaagaccgggggagaaaagaaatcagccacagacgcatatgagtcaagcaagaagaaaaatcacaaaaacgggaaaaggaaagctcaagcggaagtcctcgcagcagaatacgcgaacccccccaagtgcccagacccacaaggcagcgacacaaagaaatcttggtgccccatacacaagacggacagacattctctggaagattgccttgttttcaaaaagtcgctcgagaagcacatggcgtttgaaaaaggcaaacgagtacgcgttgtcgagaagaatgaagagacggctcctcacgaatcggattctgcgtatccagactctgacctccacgtctcacacattttcggcggctccacaacgtactcctccaagcgagaatataagaaagtggaacgtgaagtggtagggggctgcacccaagatgaagtggtctgaggagaaaatagagttctcggaagaagaccaccccaagaccgccgttatcccaggacgatatccgatcgtggtcgaacccactattcggaacatcaaggtagcgcgagttctcatcgacggtggcagctcgatcaatcttcttttcgccagcactctggacgcaatgggaattccgcaaaatgagttaacaccaaccgatcaacccttccatggaattactccccaatcatcgtccagacctttgggcaagattacgttacctgtgactttcggccaagccaacaacttccgaacagagcagatcacctttgatatcgctgaattcgatacagcttacaacgccatcatcgggagaactgcacttgcgaagttcatggccgcatctcactacgcgtatcaagtgctcaagatgccgggaccgaagggaacaatcactattcaggggaacgcaaagctggcggtgcagtgcgacaagcggagcctcgacatggtcgagcaaatgaccagcccacccgccacgactgagccacccaagaaagtgagcaatacaaataagacgccgaagccggatggcgccatcaagatcgttccactctctagtgccaaccccgacaagactgtcaagatcggggcgacactaaacgagaaataggaactcgcgctcgtcaccttcctccgcgataatgccgatgtgttcgcttggcagccgtctgacatgccgggggtccccagggaggtgattgagcacaaactaatggtgcgacccgatgccaagccagtaaagcaaagactgcggagatttgcaccagaccggaaacaagccatacgagaagagctcgacaaacttctcaaagctggcttcatcagagaagtacttcatccagagtggctagccaatccagtcatggtgcggaaggccaacggaaaatggagaatgtgtgtcgacttcaccgacctcaacaaggcgtgtcccaaggatcactttcctctccctcgaatagatcaattggtggattcaacagccggttacgagctattgagcttcctcgacgcttactctggctaccaccaaatcagcatggcaaaagaggacgaagagaagattgcattcatcacgccgttcggggtattttgctatgttaagatgccgttcggactgataaccgccgggaatactttccagcgcatggtccagggcgcacttagcaaccagcttggcaacaatgtcgaggcttacgttgacgacatcattgtcaaaacaaagacaagcgactcattgattgatgatctgcgggaaacgttcgacaacctccgacgatatcgcctcatgctcaatcctgagaagtgcacgttcggagtaccgtcgggcaagctactcggattccttgtctctggcagaggaatagaggcaaatcccgagaagattaaagcaatcgagaacatgaagtcgcccacgagactcaaggaggtacaaaagctaggatggcagcactaaacagattcgtcgctaggatgggagaacgagcacaacctttcttcgctctattgaagaaacaagacaaatttatagggacacaggaagccgaagaggcatttattgcactcaagcactacctatcaaacccccctgtactagttgctccctaacctaatgaagaattatttctttatattgccgccacgccgtattccgttagcaccgtcattgttgtcgagagagagaaaatacaacgaccagtctactacgtcagcgaagctctccatgacgcaaagacaagatatccgcagattcaaaagatgctctatgcagtaatcatgacatcaagaaagctacgccactactttcaagtccacagagttacagttgtctcctccttccccctcggtgaagtcgtgagaaacaaagacgttgtcggccgcattgcaaaatgggtagtcgagctaagccagtttgatgtccactttgtgccacgaacagccattaagtcccaggtactcgccgacttcgtagccgattggactatgcccgaccacaagttagacaaccaaatcgacaacgaaacgtggacaatggcgttcgatggtgcactcaacagccaaggagcaggggcaggatttatcttgacatctccctccggagatcaattcaagcacgcaatccacctcaacttcggggcaaccaataatactgcagaatatgaaggactactcgccgggatacgagctgcagccgcacttggggccaagcgactaatcgtcaaaggggactccgagctagtcgcgaaccaggtgcacaaagactataaatgctctaaccttgagttatccaagtatctcacagaagtcaggaaactagaaaagaggtttgatgggatcgaggtccgacacgtctatcgcaaggacaacgtcgagccagacgacctagcacgacgcgcgtccagatgagaaccgctcaagcccggcacctttctcgatatcctgacgaagccatcggtgaaagaagttagcggcgaagttggcccgaacaccaccgacatcagctcggggtacttctcaaatgcgtttcgtccgacgacggcagacacctcctccttgatatacatgaaggcatctgtgggtcacacgccaccggtcagacgttggtcgggaaagcttttcgacaaggattcttctggctaaccgccctcagatgcatgcgacatggtccagcggtgcgaagcctatcaatttcacaacaagcacacaaagctacccgcgcaagcgctccaaactatccctctcacttgaccgttctcatgctgggggctagatgtactcgggcctttcccatgaggacagggcggctacaggttcctattcgtggcaatcgacaaattcacaaaatggatagaagcagtgcccacgggggaaatcagggccgacaacgccatcaaattcatgaaatggataatctgcagatacggactaccgcaccgcatcataaccgacaacggctcccaattcatcagcgccgacttccaagattactgcatcgggttgggagtcaaaatatgtttcgcctcggtctctcaccctcaatgcaacggacaagtcgaaagggcaaacggcatagtactacaagagataaaaacccgcatctacgacaggctcatgtcacaagacaaaaagtgggttgaagaactcccatcaatactatgggccgtacgctccacaccgataacgtccaataaggaaacacccttcttcctcgtgtacggctccgaggccatgctccactgcgagctacaacatcagagtacacgagtacagaagtactccgacgagaaccaggaggaacagtgagacatcgatgtaaatcttctcgaggagcatcgtgagcgagttgtcgtccgagcagccagctaacaacagtccctccgccgttatcacgagaagcgcatccgagcacgcatactttcgatcggcaactatgtcctccgacgagttcaagcccaagcaggttgaaacaaactctcaccaaaatgggaaggaccttacacgatcacacaagtcttgcggccaggcgcatacaaaatcgcagacggcaacggtcgcgaactagcaaattcttggaacattgaccaactacgaaaattctatgtatgagtcaataccactgtacctgtaagtacccttacagtatcaataaagcctatttctaggccccatatcacaatcaaagtgttttcacccgatgatcccttaccctgatgacacctagcgttgaaacctgtccttatgtccctttacgccgtctcgataaggcctccgaggaacctaagggatcttcgactggggacgcccagagccgataaggccttgtcagatcctgtagagacgaaagaccatgtaagatctggtcgtgtaagagttctcgccgtgcgtattaaccaagtcgtgaaatcggaaatcaattttccaacttcacggctgggggttaggataagagcttattcaaccaaggcaggtcaagagtccaagagccttatcctccaagaaaattcctccgacgacaaggctgggggctagggagagtgtacgactcaaacggctgactaaagtcgttaactgagaacacactcttacacacgacatctagagtaagaaacatttgttaaagatagatttctttattcacaaagtacttcttacaatttttacataaatctctcgctgctttacacctttcccttagatattgtcgcagggtacgagtactaccaagaaggctaacgccagtccatagactggaagatattctcggccaacggcgacatcgacctcgctagatggtctatcaccgccggatttctccgagaacgagcaaaaccttcgcggtgaaattcaaggtccaggcgcgggcggtgactcgtaggcaagccaacacgtgtcctccggcgtatcggctcgctcgacgacactcctgtttcaaggcctcgtcgatacgcttgccgatgccatcgagttgggcacaggctccgttcagccacgagatgtacccggccgccgattcctcgggatcaccgcggactactcgaagttccctgcatactctcgccatggaggcacagcaactcttcaagtacgagttaaaccacacctcgcgacctcggagcgtttccacagcctgctctttcttcacggccagcatggttctctcgagttccgccacttcaaacttcgtcttccagtattggatacgacgatcttggcttgcaagggcatcctcgagatctgctaaacgtgacagccatcaagacacgctggatacctctttcggaacatggacgacctaatcaggagggcattaagagatgaaggggctactcacttgaggcagtcatcgtctccgcatcaagggtttgttccacattgtcaggtgagatgtgtggtccaagctcgagtaccggaattatcgccagtgacccgggttgcccacgctactggacatcctcgtcatcagcatctctacaatggacaaaagtttccaagatcaacatacaaaactaaacaaggatggcaattgcacgcacgagggcggtcagagttcaatttttacacattatctaacaaatacaagaagtcctactcctcaaaaagggggagaacagactcccccagatcaccgacttcttccatcacctccttacgcatgtcacttgccaccccctgatccaagatctcgcgcagatcgagttcaggacgcgacaaccttacacacgcgaggacatgacacaccccggtgtagatcccgttcgacgtctcctccgcgatcctggctgcatgcttggaggggatctcccccatcgccgttgccagttccgcgagagaggaggacaatgagaactcatcaggattcaccgggattgtggacttgatgccgcactccctggcgagttggtggagtccagtgtaggtgatccgcaacaagccctggatctcggacaggttgttctcgagttccgacatgcggtcctcgagcccattccgttgtcgctcgttgccagccaccagctccctcatttttgtgaggtcttcacgggctttagccaactcgcgcaccagtcgatcagcacgcacgttctccgtcaccgcctccgacctcgcctccgcaatctcgcggccgatgccgcgagcaccagcttcgaggaggcgcccaatctcgatttggagctcctcccaggtgaggacggcagctggcagaccacgacctcccgcaggatcgctgacggggccgctaggcatcgcctcccggctccgggttgcgggcacgacatctgtcgacgctgtggcaggtgacgcgctggaagctcccccagacttagctcgggcagccttcgcccgcgcttcctacggacaaccttgggttagacactgctcgaatgagaagcacggagattcaagaatctatctacttacttctcgccgatcgtcacaatacgttgtcgtcgtgggggtggaggagacgcgtccgaggcctgaaagacaatcaatacagagtaaggaaaaaccctccttgccgcatgatctaatgacgagataaagttaccgagggggtcgctgccttgcgacgatgtccgagtacagacgagaatttcctcggcttggtcgagacattgccaccgctagtggtggccgcatcagatgcctccttgacaaccttctcctttagagatgtcgccacctgatggtccgcgagtggcccgatgatgtcaatcaaaggaagggcctacgcttaatcaggtcataaggtgatttcgaaaggagaatacgggatgcttatcaaatatacttacgttgatggcttcatcgcgttccgccgcccccttttcacaaagaggcacgggcatgtcgctagccgtcgttggaccgctgatcatcacttgaccgacgcgccgctctatagcttcgctgctcagacctgttaaacgagaactggcttttgataagtcaagaggaacacaagtacaagcacgccaagatgaatacgagaaagataccccgaggagaaacccaggttgcgtcatccggcccgaaatagttataggctggatgggcccgagcctggagcggctggatccgcctaccgacgaagtctgcagcgacttcatatcccgacaagccccgttctcggagatcatcgatgatgtcgataaacgactgaagagagggggtcaaagggggcttggcggtccaggccggaatcttgtccggttgatcctcgggaacaacgaagacagggtttgagtccttcatctcaagatagaaccacttattccgccacttactgcgggaagaaggacactggaaggggatataacgcgatttcatgccatcacgaagttggaacccgacgcaaccagacaccctattggattccatccaacgcagttcatagtagaaacagaagagatcgagaaaaggctcggcctcacagagatgaacaaatatactaagaaaggggatggaattaggattcaaatggagaagagaaagaccatagaaattcaacatcaggagaagaaactcggaagatggaggaagaaaaccgcagaaaacgtaatcttcgatcgcaaccatgcgacccaagaggggctgaggatcagtacctcctacttctctctccatgtcttcacggccgggaagggcaccgtcctcctgaaggttcttcaacgtcgcgccggtggaagacgacttgccgagatccattgctgtgccaagatcgccggaaaacaagcctgggttggcgaactagggtttctggtggcggtggagaaggcaaggagcgctggcaggcggtgtgtgttcaacaaggttggcagacttcaaaatgagctcccaaagttcctttaaataagcgcactaccgacggtgcgaattccaaggaacggagagagatccccgccggaaatcactgggcccgttacgcgcggcagttttatggacttcagttcaaaattcactcgtgaccgttgggcttcaaacggcatgctcgattacgttctatctccgcggtcctcgcaccaggaatgataacgttctcgacacccgaagtcgtaaatggttgcacgagttcattttaagcaaaagtcggggctactgtcagggttacaggtcaggcataccctctacccttcgatatacgttacatatcaacatggcatacccacgggcacgcggatgttttctacttatcctaaggaaacctttcacgaaatctacagatgggaagagtccttctcgtacagaactgggtcgttggcgtatcgtattggatctgatatctccgagttctacttggagacctctagatctgtgatataaaagggacccccctggggagggcatagatcatcgaatcttacaaccaacacagcctacgaagccggaatctacgaggagccaagtcattgagagctagtcgaatcaactcgactacgatcttgtcggatccgacaagttccatcgttctctttataacctgtgttttccaccatataatcccatatcaactggattagggctattacctatcaaggggcctaaaccagtataattcttgtcttttgattgtttgatgtcgtactacgtagatccttgtaccaacgtaccccaataccctctatatccggtctacgggtatcacccgtcgacaatgtgtgttgaagttaacattgaacttacttttgaaatttgttaaacttatgtgtgttgatctgtactgattaaataaagttttctatataaattcatattatatccctacaataaatttacttctaatgtcgtgacaatgttactcccattttgttttaagttacttttataatatatataaattacttttagactttattaaatttactattatatgtctaagaagtaatttagtcaaatctaaaagtaacttatatatataataaaagtaacttacgtatataataaaagtaatttacaaatataaatattttttcatcgtaatataatcatgtaagatcttgttgtgaagatttaattgtaacgaacacaatagcataattggattgtagatcggataagtaatttgagagaaaactttatttgaagagaaaaaaggcatacatgtctatctcagtccttcctgctacatgggtgtgtcaccctgtctgcagtcaagtactagtggagaaagcgataacgtaagctgaaaatgaatagataacgagatcggacggtcggaggtgcgtcgcgcaattagactaaaacgagaacgcgcactgtttagattttacgataagtttaaattttgccactatcaatttttttagggcaagattctatttggtttgctaccaatataaagccaacatatgaattctagtaaagattgttatagattgatgtcaaatctaacgtagacattactaataaattggtttcaatcaaactaagcacaagtactatttaaactaccaacgttgatagggctaagttttggtagcaattaaaaaggtccttaattcttttttttcatcgagagaagctcttgactgctgctgcctccactccacacgtgagcatgctgtgggcgtggtggctcgtgctgctggctgctgtcgactttcgtcccagtcgtcaggatgcaggcgcactctctcggcgtcagctgccgtcgcgccatcgctcgacacgaaactttacactaatacacggcacaagcggaccagcgatgggcgctgtggaccaacggcagtgcgcagggaggggtactcgcgatcgcggccggcgcgagccatggcgcacgaacgctccgccgcagacgtcgtgccagttacttactctatccatttataataagtaacttttttaacgaacatgacataaaaaaatttagtattagaatacatcccacccgttgaaaacttactatatattttagattagagattagttgaaaacttactatattttggattagaggcagtacacatcagggtatgtactctcctaagagatgtatttcttccgtaaaaaaagttaatttcacaaactatagatactttgattaacttatatttaaaaatatatatcataaaattatagatttaaaatattatatcagaaaactacaaatataacattatttttatcataaaattataacttttctaacctcaatagtgttatggatataaactctaaaatgtgtagatacttaaaaacttcatcgctaaatctgtagattcgtgatatgatcctctaaatcattagtttttggcaaaatttgctacaggaaactcaaaaaaaatgtgtaattaaccgcaaggcaccgtaaaaacgtgaattggctataggacaccgtaaaaaagtggtaattagctactagacaccgtaatacaagaagggacgagtgataaatactcaaaggtccaaaaatagacatgtttgataggaatccgagtaaaaatctcataaaatgatccaccaaacttgataaaaaatcatggtaattaatgagtctaatagcctaggctgtgacccttaccataaccaaaataagcatataacatgctaaaagaatgactattaataaaccagtcatctcaaatcaacccaaacagcttttgcagcctaataaagcttacaaaaacggtataacacctttctgtcgggcacctttttatgtgcgtcataataattccaaagaattattgaatcgcgttaaaaaggattttaacagcattgggccacaccattgtgaacacaaattgccaaagcaaaaagtgcctaagtccctaaggatcacaacgagccacgctggaaataagattgggctgaagtactgtgcaggcccaggcttgttagcactcccgataccctaattgtaccgaagtaaaataaaacgtctcttcgtcatccccgccgagactctcgccattttccccatttcctgctacagtgcaaaactgcgccggccaaactagggttcatcaatccgctccaatccattgtcacgatcggaaataacccaacaggcgttccttacgtgcgtgcattattccttgtcccaggaggcaaggtacaccaaaagttgatacaattcagagtttaacaagcggaagcgtaattaattaatttattacatgggcggcgaagacccagcacacaagaagacaaacgaaaaacagcggaagactagggcgacgaccacaggcgcttgacggcaggcacgagctagacaccaaagccttcatcatccaggggctcctcttctgggcttgggaaaaattgagcaagactgagtacaaccaccgtactcaacaagacacacccataagtgcagaataaatgcaagggagtacaaggggggttataatataaagggttagggtttgcagtaaacagcattaaaagacacttagttgctcaaagctattttgtaaacacgattctagagctatataatattattaatcaaggccgtgaacccacacgaacctgccttaacccaaggcctacgatgattcagaccgaactggcaacctgaccctgggtcccagctcgtcccaagccaacccaggccaaccattccacattttagttgttaagcaggttttaagaattaaaacactaacttgggtacattgctcagcatgcccataaccgagggtgcggctattcgaataggttatactctgatcagaggtgtacatctttacccacaagacacatcttcctcacgtgtaaccacgtgtcacataccaccatggtatacggacggaagacatgacatagtttccaacccatcctagccataaacaagagtaccgacccaaccccacctacggccggaacccccgggacaggtaggcaggactgagtccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgtaacagaggcccgaagaccggtccttatatggccgaggtgctactatcaaaaccatgcaccccgagcccagcctaaaaccattttgagggttttgaatagaggggaggtgtgaatccaattccacaataatccaacaattccatagtgtcgaggtgataagagtattcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaacttggattcaatatgttcaaggatgatgtgacttgccttgctcgctttcccaaacgtcggcttcaacctccacgaagagtggatcttccgaagctgcagcgtctacacgaccaacggaaaagaaaagacttttactctaaaaaactccatataacaagcaggaacaaagtacaaaaatgggttattgacttcttaaggaaaaattagagacttgaacagtccaattccgagttcaaatggccaagttatggccatttgaagtttatatgctctttaaatgaatatttgcgaatttcttcatttaaaatttaatttaaaaaggctttattgcgtcagccgaggggagggggcgcgcgggccgggtccacgggagtggggcccacgcggcagcctcacggtccacggtggaccgggtgcacccgggctcacaccggccggcgccgtcggtcccacgcgtcagccgcacccaagggcgcgggcggctgatggcctggccccacgcggcagctacacggcgcgcccgagggcggccatgccggcacggtcagcgggagacggtgcgcccgtgccccgatggtcgccgccggcgaccaccggcgcggcggagcggccgccgagagagggaagggaagggggaaaggaggcgacggtccacggctcaccccggggcgacggcggcgacggaggaggcggccggagcggagggaggcggcggcgcggctcgggtcgacggggtcgacggcattccggcggtcggcgaccgaaacggagaggtggacgaggttggcgaggatgcggcgaacccgaaggaggcggcgccgaggtgggaggcggtccggggcgacgacggcggcggaccggagctcggcggcgacggcggagagagagagcgacgtcgcgagctcgaatccggcgaggaggaagggcggcgagaggcggaaacggacggaggaggggcggggagggtttaaatagggttggaagggggagagagcggtcggaggggaaggaaaccggcgcgggaggtccggccgccatcaatggcgccggcgagatttgcgggggcaaatccgcccgtttgaacgcgagagagagaggaaaaaa

SEQ ID NO: 69359 - DNA, 12543 bp, Oryza sativa
cggcgggaggcggcgggattcgcagcggcggcggcgctagggcgcgggggaggcggcgggaggaaggggatgacgggtgggccccacctgtcagcgagggtggcgggcgggcctgcccgtcagcggcgcgcgcgcggggagaggccgagtgggccgcggggagaggagagagagggggagggagatgggccgaattcggcccattagagagaaggagggattttagggtttttgtttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatgtattttagagtcgttttgggatgtgacatccatcctaaaaaacttcacgaaatttctccctgcatccaccgctccgattccccatccctttccagccgtatctcgaaccaaatcaaaccatccagttcacattcatggcggaagaaagagagagcttcgagagtcagtgggcgccctccgatgtgacggaagacaatctgaaggagatggtggcgcacggcgttcttccggcgaaagagatcatcaggtggcgaccgccattcggcgaggcattcccgacccccgatacactcgaaatcgtggtatttgctcatttcttctatggcggattttctcttccaacctcaagattcttccggggaattctaaatttctacgggattagcttgcatcatctgaatccaaactccataatgcatatcgccaattttattcatgcctgcgaagcttttctgggcattaggcctcatttcgccttgttctgccgcatcttcttcctcaagccccagccaaacaagaacaaaccatgcgtcgttgggggtgctggtttccaactcaggggaaccctaagccaaaaatacttctctatgcccttcaaaacctcaaacaaaggctggcatgcaaattggttttatgttcaaaaccctgagcctgctctcccgagtactcctgtcttcctcctgtttatcaggatacttggaactcactgccaatgggggatgaagctgcgcaagcagtagaactgatggagcgcatgataaagctgaaggaacaaggtttgcaaggagaacagatcaccaggcactttatcaagtgtcggttagccccaatcaaagagagatcccgcacagcttttgagttcgacggtaagcatgatccaaatcgtgaaaatccagactctcttgactttaaggtcatgaaggaaaggatgtacaagatcttctcaaatgccatcgtcgtcggctattcgcacttgctgccagtcgtgccattcaatgccttcaatcctcctccaccggtacgtattcatacacttcaacctttctcaaaatatgatcttgttttcttgttgaatcagttaacaatgaaggatattacacccaggaatttgctttgatgaagtcggatcccccaatcgctcaacaccgatctccccgccaccaaactgggcaagggagcggtggaccaagaattcggtctgaaactcaaccaagtgctcctgatccagtcggccagccaaattctcgcaagaggaagctggttctaagtgacgacgaaggcgacactgctagaaagcttggagaccgagaggcaaccaagaaactgccgaagcaggctactccaaggaagaaaacatacagtcgtcctgtgcgaaagatcaggaagtctactaggtgcaactcatataacgatcttccttgcattgatgcgcacccattgcggtaataatactgataatcaaatttgcaggaaaccatctgatatagatccgtctgggaaagactctgacccgactaacatggacacaagttcttccaaagaaaccgggccaactgttgaggatcatccaagtgacaatcaaccggcaaccgataatgtagaatccggtgatcaacccccgactggaaaccagtcggccgaagccgaagccggagttaatcaggagcctccgactggaaaccagtcggacgcagggccaagccaagagattccagaagtcgaaacccaagcaaacaacccttgcggacaagacaccagcaatgaccggagatctgaatctcctttaaaggcatccgaatccacttatcctcgtccagaaatcattaagggtaaacactttgtctgaaaccatgttgacccaaataactctgatcaattgtctaacctttgtcagtggatacactagggccaatgatcagtgatgaagaagaaattccccgtatacaagcagccgaagattcgtgccctcccattctgttcaagtggtgggatgacaacttgcaacctcaaggaattgtaataaaccggcaaaaagaagacgaagaggtatgcctactgaaaaaggcactcaaccaagcgacccgcattgtaaatctaagttccttgacgcctggccttagccatcttgtttgccatctggctcgagcgctgattaaactgctctgtagaggattcatcttaggaacgaggtgaaaactggaaccctagagaaactagttcctcatcttggaaccctcgaagccaccaggagtcaactgcacgaggccagagaacttgccaagaagaatgaacacgatctgagggatcggattgctgagctccaggaatccaatttttaactgaatggctcatcaaaaggtacgcgcaaactctgcccaactgatttgtgctgttatctctgtaatcttgactaaccgaagttaatgtagtgcaagctgccaagatatctcaactagaggagcagatccaaactctggaaaatgacaaggcagagctagcaagacagaggaattcggctttaaaggaggttgaaggtaccaataatcaatacctcaaaagccattatcttctatatgctgattcattaatgtgaatctgttgatgcagaccgcaagatcaagtctcaagcacagtttgatgtcttagttgacaagatcaacaagcttgaaggagccagggataaagtcgctaatgccgctactccactcatccaggccatgtttttcaataacgccggttcgagtacacttgatgctgccgaaatcttcgacaagctgagagtcgctccagatacttacttcaagaacatcaaagaagctggaagtatgggagcaagtctggcgttggcgatgaccaaatcgctttatccaagagttgatatggatgccattgatggctttgcaaacgggacgagcgaagaagctgctcttgacctcattaatgatgcgcagaaagccgctgacaaaatcgctgctgacgtggttgagagattccaagatgtcgaccttcggccgactgggtctgataattcagatgatgaaaaaactgatactgattgatgtacccatgattttgatgattaatgataatggaggctcaatttgtacaatactgatgaatttatgctatgcttggtgttccatacttagcttctgatttcttaaaggcctttgtcaagccttattgagcctaaaacccgcaaaagctattaaaaaaccttcagtcctcattgactaagtcgaaagaccaaacagggcaatgataaatcaagtaagcaaattgaattgataaaaatcacactccattattatcatagtagccccccgactgaaaacttcaaggaaaagcttgaagttagcagtcaaagaggaaagatacaaacgaaatgcctaagcataaaatcgacgaagatgttcaatattccaagaattgttgatgagagtactgtcttcacgctttagtcgataagaacctggccgagtgactttagcaattatgaacggtccttcccataagggagataatttatgccgatcctgtgtggtttgaattttcctcagaaccaggtcaccgactaaaaaggctcgcgatcgaacattccgattatgataatggtgcaacccttgcaaatatcgagtcaactgaattaaagctgcttctcgggcttcttctagtcgattgatgtcgtctactcggccctcttcatagccctcctcgttgaagttccgaaatcgtagtgattcaaattccacttcactcggcaacattgcttctacaccataaaccaaaaaaaacggcgactggccggtagcccgactgggagtagtgcgtaaagaccaaagtacggacggcagctgatctacccacttgccagcatagggacgtagtcggtcaaaaacgcgtgctttgatcccttgaagtatcatgacgttagcgcgctcgacttgtccgttactcatggggtgtgccacagaggcgtaacaaattttaatgccaaagtcttcacaaaagtctctaaatgctcagccagtgaattgagtgccattatcagtgatgatccgattaggtaccccaaaccgatgcacaatgttgatgaaaaaatctctagctttatctgctatgatcgtgatgaccggtttagcctcaatccacttggagaatttgtcgatagccacaaagagatgcgtgtaaccgccgactgcccttttaaacgggccgaccatgtcaagcccccagaacgcaaacggctaggacaacgggatggtttgcaactcttgggctggcagatgaatttgtctggcaaaaaattgacaaccttcgcatgtccgcacaatcttgtcagcatcagacacagctgtcggccagaaaaaaccttgccggtaagctttgccgacaatagtccgtgcagcagcatgattaccacaaataccagaatgtatatccttcaacaattgtctcccttcctccaaagatacgcagcgctgcagtattcctgatggactttttttgtacaactcagtcttatgaataatgtaaagtctgctgcgcctggaaatccgctcggcttcatttttgtcttgagggagttcttgtttggtcaaaaattttatgagaggttctctctagtcggtttcaatcatgcttacgccttgagtatccatggcttcaagtgtttcttttctgggcacggttggttcataaagatgttcgacgaacacatctgaaggagctgcttcccgttttgaatcaaaattggccagcctatcggctgcctcattgctatgtcggaggacatgggtgagctcgagtccatcgaatttatcttccaacttgcgtatctcttgtcgataagcagtcatattatcatctagacaagaccactctttcatgacttgattaacaaccaactgagagtctccacggacgattagtcggcgaatgcctacagagattgcaatccttaatccatggagtagcgccatgtattccgccacgttatgggacacagaaaaatgtatccacaatacgtagctcaatctttctccagtcggggaaatcaagacgaccccagctccagtgcctgtaagcctctttaacccatcaaaatgcatagtccaatgtttcatcttttcctctggcatgtcttcttggcactcggtccactcggcaaggaaatcagctaacgcttgtgacttgatcgaagttcgtggcttgaacgatatgtccaaagacatcaactctaaggctcacttcgcaatccgtccatttgcttcgcgattatgaagtatatctccgagtggaaacgatgtgaccaccgtgaccgagtgactttgaaaatagtgagataatttcctgacggtaattaagacaccatataataacttttgaactagaggatatcttgtcttggagtcggctaaaacctcgctaacaaaataaattggacgttggactttttgaatatggccttcctcttcatgctcgacgaccaggaccgtactcaccacctgggaggttgacgacacatataacagtagcagctcttgtggatgtggcgaggccaaaactggtggagtggtgagaagtttcttgaagtcttcaaaggctttttgtgcttcgggtccccactggaaattgtcagtcttcttcagcagcttgaagaagggcatcccccgctcgccgagtcgtgagacgaaccggctgagcgccgccatgcaaccagtcagcttttggacgtctttttgggagcttggcggtttcatgttgaggatggtgttgattttctccgggttggcctgtatgcctctttgagataccataaatccgagcaacttccctgacggtactccgaagatgcacttttccgggtttagtttcatcttgaaagcacgaatgcttgtaaaagtttcttctaaatccgcaatcaggtcatccttctgcttggtcttgacgactacatcatcaacataagcttcaacattgcgaccgatctaagttgaaaaacatctttgaatcatgcgttgataggttgctcctgcgttctttaatccaaagggcatggtgatgtagcagtaggccccaaagggtgtaatgaacgaggtcttcaagcagttagattcttttagtcggatctgatgatatcccgagtaacagtccaagaagctgagtaactcgcagccggccgttgagtcaaccacctagtcaatgcgaggtaacccaaaagggtctttgggacaagatttgttgaggtcggtataatcgacacacatgcgccattgccccgtctttttccaaaccaggactgggttagccagccagtcgagatgaaggacttccttaatgaagcctgctgctaacagcttggttaattcctccttgatcgcatccttcctgtcctgtgcaaaacggcggagtcattgcttgatgggtttggcgtcttgcttaacatgtaaagagtgctcaatcacctctctgggaataccaggcatatcggatggtttccacgcaaagatatctttattattttgaagaaaggtgatgagcgcgctttcctatttacaatctaactcagcgcctattacagcagtcttatcaggatcggagggatctaagggaatctttttttgtcttggaatcaccttcttcggtcttcgtcagcttggttgcaggcacttctccctcgcttgccgtggtcgcagccagtcggatctcttcgcgggcgagagtagtctcgtgggtttgggccatctcgcaactttctttgtcacatgtgacggcctgcttgatgtcgctccgtagtgatatgactcctcgaggaccaggcatcttcatcatcatgtaggtgtagtgtgggacggccatgaatttagctaaagccggtcgtccgagtatagcatgatatgctgtctcgaaatcagcaacttcgaagcaaacattttctgtgcgaaaattctcccgagtgccgaaggtaactggaagagtgatctggccgagtggtgtagctgacaatcctgggataacaccatggaagggtgcattactcggcttcaattttgtgcgaggaatctgcatatcatccagggtcttagcgaaaaggatgttaagtgcactgccaccatcgatgagagtccgtcggagcttgacattgcgaaccactgggtctagtaccagagggtaccgccccgggtggaccactcggtcgggatgatccgagtggtcgaacttaattgctatctctaaccaccgaaggtattggggcgtgttaggctgaaccgcattgatctcccgttctgttagcttctgctttctcttagattcataagccaggggtccgccgaagatgtgattgaattctttgtagtgatcttgaaaaccagtcggggcatcgtcttcatcatctttcttctttgatgtgccttgatctccgtctgacgtcttacgcgcgttcttgacatattgctccgcaaactgtttgtagacgaagcaatctttggccacgtggttggagttgggatgatgcggacattgggagttcattattttgtcgaaggtgttgacgcgggaacgttgtcaggaagacggagaggtggtcgccacaagttcttcgggcttacgcttgcgatccttgtggttgttacttccactccctcctgcggtcggcgtatccttctttggcttccaagtggtgcccgactgcttggacgccgtgatagcatcttcggctttggcatactcattggctttttcaaacatctgcttgaccgtcttgggaggtttgcgtccgaacttgccgactaggtcctcgtggcgaatgcctttagtaaaggcggcaatgatgacgtcgtcggtgatgtcggagatcttgttgcgttgcttcagagaagcgtcgaatgtaatctcgaagagactctccagacttctgaatgatgttgtagagatcgaagtgtgtgccaggccgttcaaaagtgccttggaagttggcgatgaagtggtcgcgtagctctgcccatgatccgatcgtgccgcggggtagcccgtggagccatgaccaggcagaatccgctagggccacaggtagataatttgccatggctttactgtctcctcctgctacgcggattgcgagaccatagacggtgagccaagactcagggttggtggtgctgtcatatttttcgattccagtcggcttaaagccggctggccaatccactcgacgcagatcgcttgtgaaggcagccactccgtccacgttgtcgtcgtagcgatctggtgaatgatggcctcttgctgcgcggcgctggttgatggtgtcgcgaagatcgatggggcgccttcgatgtggggggtgtggtcgttcaactcggcgctccctgtatcgttcgggaggcgaatgaacagaccgttcatcgtgtcccctgctcctgcgactagatccggcgccggcaatgctgaggcttggctggtgatagtcttgagatcgaagatgagggactcggctaccagtcggggtgcgggtgcttgcagagttggctggaaccgaggcagcgatcatggtcttcgtctggttcaagatgttgacaacatgatcggcttggttgagtgcgtcttccttgaggagggtgtcgaggagagtgattgctgcaaccgcgttctgctggagggtgcgaaagaccgctgtcccatcgacgtcttgttgcccaatgagctctctcgctcgccgcccagattccaaggcgcgttgtcgtcgatcttcagcctcctttgcaatccgttcgcgatcttgttgctcacgctgtagtcgttctcgctcctgtcgctgtcgctcttcctccagtcggcgacgttcagcttcttgtcatgcgcgatcttggtccgcttctcgggattggcgctgttcctccgtttcgttgtcagccatgaatacgccgaagaagaggggcgtgtagttatcctcatagctgtcgtcgaagttgtcgaggtcaccgtggtcgtagtggtagccaaagtcgtcgtagtcgaggatctcggttgatcgagaactgacgcctggggagctaaggtagccatccaactcttccgtcgagactgtcccaagaggttggagtataacgccaacctccctggatctagatcggatcggggccaaagccggagctcgcctagatcttcgagtgggagatgtcttgactgtgaagacagcggccaaatcatcaggaagtttcatcaagattgagggataggacccatcgtcttgatctggtcgcggaaaagtagattagatctcgtccgagtggtttgaagccgactcgggagagatgatcttggagtaggcctcggccgagttcggaataccgaacggcacagggacctggtctcttcccgactggtttgaatccgagtcaaggagagagatcttgccgaagtcgttggtgatgaagttgaggctgccgaaccggaacgtctgcccgggagggaaggcgaagtcgtcgatgccagaaacggaacccatcgcacttagtcggcaaaaacttgacgctacccctacctggcgcgccaactgtcgaaacaagatttcgacaataataaaagggggtggctatcaagctaggaaagtggatgggtttggagacgaagaattttatacagattcaggccttcttattcaagaagtaataccctactcctgtccgaggataattccgccgagtgtgttattgattgtataaactagaaaaagaatcgcgccccgagaggcacatggaccctccttatataggggaaggagtccgctttacaaagtaccgtccatatcctaacggaatatgggattatagataaaatacaatcgtaaccgactaggatcccgggtattttcttgacatacaagtttagaacctaacccgagtcctcatatagatattctatctatatttggtaccatatatccgactaaattataactgtcacgtagatatggggtatccataatctacacactcagggtattcctcctcccatttcacttgtagttccacttgcactagcaaatgaataaatcagcaataataaaataaacaaaatctttaagaattagttaaaaacaaggataaatgcgagtagcaatgaatgactcacactgatgtgggtgcaacaattgggccattgatcccctctcctgtttcaatttgacttgctgagagagttccctggcaatgcttggttgtatggtatagctcatgacaataactgtatttttttccttttactagtgccatctttataaaaaaaaacccttatcctagccacttttgatcttcccggtttctttctcaatctaggcttcttgattttatagcctagatcaacgtgtgtccacccatacttagattccattgaaaaattgaaccttcaagcatatgccttttttaacatctcaacaaagaagcacttatccacaaaatcatccatctgtatctctcgcaatgaaagccaaagcataattgcagtggctttctcattggaggctgtggatgccctatttctcactgaaagatgacagctcggttttatgagtgcaatttgcaaaataaccatcaaaatcaattatttgtgcatcaatgcatacaacccccttacgtaggttcagttgaaaccaatatagcatttgttcatctgatttaatcttaccagagtcactattcaaagaacgccacaaagtcatgtactgcttataacatcatatgaagtgctcaactatgaaattaattaattctagcaaaccatagttatgcatgtcaacatattggtttggcaacgttttattagggacataggtctttggccctccatttggaaagctaaaaaatgataggacgctaacaactaatttcgactcactgtgaattggcctacaaatcacagaaaaaaaaacacatttagctaattgttgcctagaaacaatttctcctaatttattgtacgaaccaaactgagagacaactacactcacaataatacaataatagcacaaaggtgttacttgctagcctcttccaagaaaatctcccccatttacattattgcacaaaatacaaatcctccctgcagctcctcgcttgctgccggccgccgcctttgcgctgctgcctagcctgcaccacagcctcttgcacgctcgtcgccgccacctggccgacgcacgctcgcccatgccttccaatgcaaactcaccgacatcgccgcctagccggatgggatttctttcgggagaggaagcccatgtgcgagcttgagggctatccctacttggatatttcacagtggtaaaaggtcaatcaataattcaaaatatttgtatttcattttttttctttatttctttactgcaataagttcggtctgactcgcttccatctaaaccatgagtaaacgcctcgttcagataaaaaaggtgggggtaaaaactaaaaccctaaaatgtataggtaaaatcagtattggacatcaaaacaggaggagtataaatgaaattatccaataaaataaatacatattgtttttcttttattatctaaaaataaattttgttataaacaatgtgtcgcacaacaaactcataactataatagtcttatgcgataaacttttacattttcaaaaatataattcataaatttctataatcatccatgtgtgagggtaaaatgatcatttatatataaattagacgatcaattgacaggaggggtatggaagggattgaaagcaaattttaagggtatgcaagtataactatataaaaaagtaaggtgaggtatagaagggattagatataattttagaggcatagaagggattttctctagaaaataacaggagctaatttataaaattgcaagagtggtggtgaggtgattgtgtgtaagtgacagattcactgccatcatcgctaatttttctaaagagtaaattacaccgccggtacatcaacttggcatgtaggtgtaatatggtgcaagaacttgagaaatgagcaatctaatgcaacaacttggtaggtaggtgcaatttagtataagaactttataagtgatcacataa

SEQ ID NO: 69360 - DNA, 51761 bp, Oryza sativa
taattggatgtaaattgtatgtgcagtataatttttaaagattaaatttaatattataaggtaatatctataggattactatgatggtgtattgatatcgtgaaaaaaatcacctagcatatgcttagctaaattgatgcatcaaaatactaaattgttaagttcttatactacaagatatcacttatcaagttatcgcacccacttgctaagttggtgtaccatgtgtgtaatttactcttttctaaaggagtatagatgttaacgtcatttgttctgacgtgacggaacgggacaggatacgtgtgacgcccgagaataattggagaagaaaaagaaaaaaaaatgaagagagcaagcaacggcagtggttgctggttggttttgggccttggcccatgcatttgcttgcggcagtggcagtggcacactggccctagctagcagtgcatgcagcggcagcccatgggatttgaccaaagcaacgagaagcaagcagcatgcagtagctagcagggcagcaaatagcgagcataagcggtgcaagaggcagcaaccagtgcatctccttaaacagagtggtcctcccactcttcaagttaaaaactggcaactatagactaaaaacgagctctaacagtcttgctaaacggatggccaaaccatctggctagccaaactggctcgctcaatggccaaatttggcccgtccaaattggcttgccaattgtgggccccacatgagatgctttctccctcctctttctctcccctcccacactctcttccggtgactgattgaggtgatcaccgtcacctcacgcgcgcggggatctgccgccgccgtcgcctcccgcctcgtgcacgcatactcaaggatggaattatggattgatgggccgatgcagtacaagataaagaggaggaagaaggcaacgaaggctgacatgtgggtccctttgttagagactgttggagtgaacacctagtttgactatccaaatcagttgaaaagttggctatataagtatttggagagtctaatttggagatgctgtaagagtttagtctcacatcggctagctaggttgttgagcactactttgtaaggttaagaacccgttggctaatgatcccgaatttgaacttttgcgtgaagtgagtgtaaaaatttaatactccctccatttcaaaatgtatgatactgtttattttttcataacgtttgaccgtttattttgttaaaaaaatttgtattaatataatttattttgttgtgtggcttgttttatcattaattaaaatataatcttaacttatacttttatatatctatactaaagtttttaataagatgaattgtcaaacgttgtaccaaaaattaaagacgtcatatgttttgaaaaggaggtagtatgttgcgtaagggtgtgttcggtgttatgggttcctgatgagcacccggcggcgaatgccctaatttatccctctctttcacggtaccaataataatcaaataattaaaattctgaattttcctagacaacagcaaatttaatgcacacgatagcaaatcaagcagagcgaccaaattaatccagcttaataatagcaaaatataaaaaggactggtcttggcttacagtagcaaaaaccaaaccctggacagtagtactccacccgtgtaccgtgtacctgagagacgatcagagtaagtggactcctagatgaaatccagatcacgtccccaggagatggatctcctgatcacgtcactctccaaacatcagccggtggcagcgattcttcagtacatagcagatgggagcgccataagctatttccaagagaacaaatatatctcgacgaaacaaaaacaaaacctaatcttctacttacatggccaacggcctatttatattcacgcaggcatagtaaacataatgggcccttctctaaaccagactcggcgacatactggtccagatccaaaataccaaagaaaaaaataaaactaataagttgctaacccaaactagtcaaagaacacacgtccaggaatatatattaaatattccggcaccattgctaattacctttgctaatcaagataattaaatatacacctgctttatgctgacatgaaaccttgctttgatacattgctcttcatggtctccagatcaatactccctccgttttctgttatttcttcctgcacagtaacatgcattgtaccaactagaaatactcggggcttggacatatcagttccgaacacccttccctcgttttccgcgcgcacgcttttcaaactactaaatggtgtgttttttttacaaaaagtttatatatgaaagttacttaaaaaattaaattaattcattttttaaaaaaatagctaatacttaattaatcacacgctaatgtattgctccgttttccatacagggagatgggttcccaaccccaaacttacgaacataccctaagtatggttcaacaaattgcactaccatccactgtaggacacccaagtattgaaggatcgtctggcactagggggtgaaaacagtcagaaatgatattactttttttattttagtgtcaacttcaacgtgaaacttacagaaattagaaaaactaaatttctgaaacagtaaccatcggtaaagatattattattataatagcttgcggaaacgacattggtctgaaatttctgtatggttttcacccctatcacattggccgctccacatttaagaattggaaacccaaacgaaattcacggctcatctttgtacccagcaccagctatgtcagccacttgtcttcatcgtatgacgacgttgtcaaagcaaagccatcgtgtctaacatccccctattccattgagcgagattggcatataggcactatgtgacatgggccaagccatttaccaccaggcccctctacagtctagtcatggctcaacggttaaccctccgtcgttgcaaaacccttctccatccccttccacaacaacccctcttttttcttttgtggatctgcatgtactaggcctgattgataccatataggtaccaagctagtagctaggtatcaggattgatgcccgcacatatcgccctggtagcgatggatatcaggggtactaggtctgataccgaccgatatcaaatctagtactggtccaacatcgagtactgtttggagagattagggcgggatcccgtcctcctgtcctatagggtgggtatcaagcttgtgttctataggatggtaccaagtctgttaccgatcggtattaaacctagtaccaatctggtatcgagtcctttcactgatgctggcataagctccgtcctatagtagttctctttggtaaggtgctcctgttttaattgtagagataagtctagaatatatttgtcatacattatattttttatcatattgttacaagaaacagaaacataagatctgtcacagcaggactacacatcttgaaatgcacaagagatatgagccgatgagcgcgccaaaagccgatcaacttcagcacgtgcaaaatcaaatgaacaaatattggccaacatcatcaatcttattatagataagcaaacaccgtatacgttgaagcactggatcctaaagtcggtgcagccgatttgattattaacaacctaaaataaacaaaataactacattagtacttgtaatttccatttctttgtatctaggagtatgtgtccttcaagttatttgctttgtagagatattcatcctcaaggatcaacacatatatcacatatcgtccaacacattctaccaattctggctcgtttatacgtacttcctccgttttatattataagtcgtttggcttttttcctagttaactttgttaggtttgaccaaatttatagaaaaaattagcaacatataaaatatcaaattagttttattaaatctaatattgagtatattttgataacatgtcttttttgttaaaaatactattatattttgctataaatttggttaaacttaaagaagtttgactagacaaaaaggtcgattgacttataatatgaaatagatagagtacgtagatctattatattgaccaggcagagcatgtgagagagcctatgagaccgtgattctaaaacaacgctcccaaaggagggaagctaacaaatttcaatctcctcttcagatctaattaatagcatcctgatcaaggtttcttgctgaagttccgtgtgtttgagaactaaaattataaatcgatggtatagaagtgtactgaaagttccaatgttataaagctaagcatatataaaatgttataaactttttggtttgtatagaaccaattttccgagcaaattaacaaatgcaacaaatcattattctagctcctccaatgcccgcatcaaagccactactacataaatcctaaattatgccgattgggaaaccccttaggtgccagttttcccaaccggcacccggaaggcgacactaattagccatggtcaaaggtgccggttccataaccggcatctttgatgcgcacaggagccaaaaaaaaccaggtcgatgcatcagctcgggatcgagcagctccctatcccacatacaacaaatcatgattcatcatcacagaaatttatcaacatcaattcatcaatatcaatattaacatctcaccatcatagaaattcaacatcagcattaattcatcaacatcaccatcgattcatcaaccacagcatccccacacaaagcacagcatcccacaaaaatcacagaaattgaatccccacacaaatcacagaaattgaagactcacttgtcaaattgccactgatgccgcctgcagaaggccggatccagcagcccccaatgtctaggcagccggatccggcgcggtacggcgaggaggatggaggggcacggccaccgccgctgctgaggtgcgccgcctcccctccagccggatctatcggtgaggagggcgtggccccctccgcagggccgtcatcgccacccggccgccgctattgccactccgccgggcgagagagggcgagagagatcaagaggataaggccgctctatcggcttggtataggtgcccttttttaaaaaaccgacaccggtttgttttaaaaaaaacgacatctatagtatagctgccggtttttctttaaaaccggtacctttatcaattacaggtgctgggtttttgcgatctcaacccgcggaagtaggaaaatgcctataggtaccggctttagtacttccggcacttatagcgccgacacctatttaatattctatagtagtgagcaaatctcatcactatcactattgttagaacatcacatatatagtgcaggcaaatctaattaatctgctcagtgctcactaattaatatcacagataaaaacaccagtattagtggtgttattaattattacagtaacaatggttattagttagatggataaaatgtgattaaccagcttgtcaatgatgaggcaagaagagccagccttggtgatgcactccgccgctctgctcttcagctcgccggctctccgccgcattccggcggcgtcgtcctcttccatgagcctcctgatggcggcttccaccttgcccctctccatctcgccgccgccgccgtcgagcgcgaggccggctcgccacacgcgctccgcgtacctcgcgttgcccggctggtcgccgaagcatggccggagcagcatcggcacgccggcgcagacgctctccagcgtcgagttccagccgcagtgcgtccagaacgcggcggtcgccgggtgcgccaggacctcctcctgcggcgcccagctgaccaccgcgccgcggccgcgcgtcgcggcgtcgaagccgtcggggagggcggcggcggcggcggcgccgcggacgaggcccgggcggagcacccagaggaacgggtgtccgctgttggcgatgccccacgccgcctcgacgagctcgccggcgctcacgctggcgatgctgccgaagctgacgtagagcacagacgccggcgcctgggagtctagccactcgaggcagccgcggtcctggcgcagcaggctgctcggcggcgccgtcggcgagagcttgtggagcgggccgacgtcgaacaccgggacgtcgaggtctcgccgcagcgcggcgagctcgtcgtgctcgagcgcgtcgaaggtgttgaggattagccccgacgacgtcctcaccgcctcgacggcccgggataccagctcgtagatctggtcctgcgcgtggccaccgaagccggcggtcagcatcacgtcccggacgcggtacggcgccggcggcagcaccgtcaccggcgcgtccagctccgactctgcgcgcagatcacaaagctcatgtccgtgtagatcgagccatggaggagcattatggcgcgaacacgtatacgtacctcgagcggggaggtagcccatgtcgcggagcatacgatgcgcggcgaagacgcggaaggaggcggcgctgccggtgcgcagcgccagcgtcggcacgacgagccgccgcgcgacgtccatcagcgtcaggaggtgcgcgtcggcgacgaggcacgcgacgtcgccgccgccggcaggagcagcctcctcgagcagcgccgcgagtcgctccctgaacggcgcctcgcaccggcggttcacgtcgaggatgcccgccagggtggcctccaggtagtcgccgccggcgccgtcgccgtcgccgtcggcggggacggggacgaagtcgaacgccgggtggagggacgcgtcgggcgcgttgacgccggccggttggaggtggaagacggtgaccgcgaagccccgcgcgtggaggacgctggcgaggtggaacatggggttgatgtggccctggagcggcagcgggaggagcaggacgcggcgacgacggtggccggcgccggcggcgacagcggcgtgcactgcttccgtgcccatggatcggaatgaccaatagcagatggctagctagctcttttttcacaagaatccgttgctacttgtaattcatatttggcttcgattctctctaaaatgaagtagaagacgatggattttcaaatttaattttcatgtgcgcatgccggcatatgtgctgtgcacggaccacctcggagtctcggagcacgcggggcggcgaactgacaatgcaagttgccattgtaaaagggaaaatactccttccaatcacaaataatcagcgtatatagtttgtgcagcgacaccgttacactctcacatgtcacttaaatcggcatcgatcaacatgcaacattatttcgtgtgtcctacgcattaattacatccatggcagtttatgccaatgatatcgcttgcatacatgcacgcaccgtaattgcagttaattgaacgatagatagaacaatgcatgcaaaatgatcatttaaaatttagcaccacacagaaaaatgaaaagtcacatggaagattatcaaatatgttgatcgtttctgaataacattgaaaaaaattatgtgatgatcatctgcgaatggatggagaatcatgtactacggggtgaagcaatgaaacggagtgggtaatacggctaatacggctataggctaatacgactgtatgagtttaaattgagtgggatgtatatacgatgaaaatagataaactatagttttaaaaacttgtacaataaccttgcgattaacattactagaaaaatcattttttcagccggccaaaaatcatttttctatgcgggggaacggtccgcctgtatacaaacgcctattttcgcaagcagcccagtcacccgcctatgaaaatcctctggccggatctgggaggggaggggaggggagcagcgccgtgtgccgccaccgccgccccgcgcgttgtcgtcgccgaccccgcgtgtcgccgtggccgtccctgcgcctcgccatccccgcacgcgcgtcgccgtcgccgtggccatccccgccgaacgcccacggccgctaagggggagggagaggagagctgggggctgtgagggagaagagaggagataagacttagaaaaaaaaattgtgcgatttggcgcctatttatatgctacatcaattttggcaggcggaccctgcagatataaagggttcttttacagacgcactgcttaggtggtccgcttgcgaaaatagattttcgcaggtggacaaccatctcaccccacggttgttattttcgtaagcggtcatttagttccgagaggtctacccgccttcaaaaataaaatgccatcgtcgggaaaattggtcctagtagcgtaattttccctcactggatcagagtaagtgcaccagaggctcacaacttgcattcaagagggccacttgtcaatttctttcccagttttactgtgggacagcggtaaccacgtgatacgtttccacgagtgcaaactgcaaactcaattttgccaattcatggaggttcaatatttttcttcgtcggttctctaaaactctcaccactggtcttaacaagttgaataataaattttacaaatattttggcccaaagtttcacgatgaattaggattaactaatgttttcatctgttacactagtttgtattgtactaggatttgaggatacctgcaggagaatatgttatatgtaacgtgagaactcgtaagggttacacagagatgcacataaaaaaggcaaaacccctagtatgggcttgtttggtaacttgagggaaggggattgggagtttacacgagggaattgattatgagattaagatggtaatttgatttttaatcccaatatcttgtttggtagaggtgatggaaattgatagggagtttagttggagattagatcattaataaaaacggatggctgagattttcttagacaaagtacaggaggaattccctcccaattacctgcccctacctaagtattgaaaaggagggagttccttcctcaattcctcatccccatcccacaaaattgccatgtctcccaaccaaacaaaacacttaatagtctcatccctctaaactcccaatcccttctaataactccctccaactaaatagtccgtataagtttttttcgttagttttagcgtgagtagtatctaatcaactagctccatttatcttttttttccgccctttgtacagataatttgcaccttttttaaaacatgttcacatcaacatattgtgtgatccgctaaaaaatgtttttgtgatttgggaaaaaaccatttgatgggattatctaaaggtacttatcttaaggaaaaaaattacgaatatacttattttttcaataatttatgtttataaacataaagggaaggatttacaaaaatatacccgttccgcggggtgaaaacgcgggaccacaacggtcccgcagctctgaaacgcgggaccgatggtcctgccgcacgacggtcccgcagctataaaacacaagaccgtgaccgttctgcacgaccaaaacgcggcaccacgatagtagccattttatcaatgtgatgacactgtcactacagtgattggtactattgagacactgtttggcactgttcatagggcggttccacgcaatagaaccgtgggaatgtctcgtgaatagtggtaaacagtgtcaaacagtgccgaatgcataataaaattgctactgccgcagtgcctcattttggtcgcgcgggaccgtgactgtcccgtgtcttgtagcggcgggaccgttgtggtgccacgcaaccatctcgcgagactaacggtcctgcgttttggtgctgcgggaccattgtgggacggatatattttttcaattcttttttatgcaagtatataaacgtaaattattaaaaaagtaagtatatttgcaattttttttcttaccatgacacactaaaaaacgaattcaaaaggcaaaacaaagcgtatgtgtaagccgcggacgtactccttggatgttctcctctttggactcggcctatttaaaaacaggaataagtccacattgactccctcaaatatatgtccaatctaatttatatccctcaattgtaataccagatttcttaaatcctcaactattgagagtggttttcgctgacgtggcttgttgacctaattcaattgctgagtcatcatttgagggcccacatgtcatcctcactctatatctcttcttcctcctccctctcactcccccttatctcttactctccccttccgttccccttatgcacagcatgcttctggttcactctccacctcctctccttttcgtccatgctgctaatttcctcagtccgtcatgcgcacgccacgctcgccagccatgacgagcacgagctcaattttgaggagactcgtcgaattccaccgctgcttcctcccttcccacgaacgagcaagtgcgctcgagctcgacggggttcgtcaaccactgcctccaccgaagggagctcaaggctcaccactgctgaaggggaagagagatgagagatgtgggggagagagagcaaaggaggaaggatggagaatgagcatgacacgttggtctcacaaaaaaaaattccacctttcttactgactcagcgttcttgaccgtgccacatcatccaaaaccacccttaaactgtcttaggagtcaatctataccggttttatcaatttagggagtcgttttatccggttttgtcattgagggatatgaatcagatccagtctatatttaagagagtcaaagtggacctattcctttaaaaaaggaaaaggagataggctaagctcgaatggaaattactgtatgcccaaaaatggaaatttggctgatcgcgtaagcgagtggcacgctaccgctcgcgcaatggtcttctcggtagacaacagccaatagcttggcagggattttgtgttagattcctctgcttggatatgcgaacttctgggccgaatttacctacatatttgggtcaaacattcaatcaattttgggccacatttacgagtaactttgggccaaaattacatgcacatatgggcaggatgacagctgcaaaacgtatggatgaattccatgcatcaaactattgactatgagaggcaacaagtccctctcaaaaagagagagagagagaggaaacaagtaatttactttaatttattttgtttagatagataatagatattttattaagaaaaaaaattaaatccgagcaaaagggtatgaatgaaaagtatcccagattagggaccaacaccggaggagtcgccggtgaaagcctccatggctgagttcctttgtgactaaaacatctagaacatgcggttttcttgaaagaacaagaaaacaaaaaggaaaacaacgatgagtgactcgactatgatagtctcgtttctcctcgccggcctccgttgaggcgcttgaggcagtgaagaagggcgaaactgtaggatcgaaatacaaaaaccaagcttattaaaggagggtgaatggtaggaacaccaaaaaccaaaacttttggaggaattaaaagttatatcaaatccaacgaagttcagtctgatcacaatgtgtctgaccgccttattgcccggtctgaccggtgttgtcatgccagtctgaccgctctgcttgtcactatagcctcctaaagtcattggtccaatcgccttgaggccgctggtctgactgaaccaaaacctctagcctgaccgcctgtgccttgccgttctaaccaccgagataggaaaaaacacaaatcaaagaacactctgaaagtagatcaacttgattgtttctaactgtatttacaaagcacaacagtagcatttaattctctctcaactttcgactaaactcgtaatccaggctaatcagtaacttttctctcaactttccttacacacaatcgatactgagagaacttgaccactcttctatttataccagagttggctgcccaaaagccatgaatatgtcataatccactaggaaatcttctatcgaactcatcaaactccaaacataccatatcctttcaaattcaattccgcatcccatacacatacaatctccttttgtatgttgtatgaaatcttcaccaccacgtgcattgttctttaattagcctaagtatcccacttgatctcctgttcgtccggacatcatattctcccaagttgactcccgattcagcaccgacaatgctctcccggggcatcaagatacacctacacattaataaacaacaaacgtatcatatccgagcacaagttcttctacctcttaactctaaatcagcacaaaccagtattacatacacatagtaatcatctagctagtagtcataaacatgaggtaatcacgagtaaataaataactagaaatcgaaaccgacacaaattcaaccggttagaccgttgggttggctagtctaaccgccaccacaactccgatcagaccggcgcactatgtctgctttgatcagctccatcaagccgaaacctgttcatcgtcagaaatactattcatcgtaaccacccggtttgaccagtgcacaccccccggtcagaccggccttagaacaaaaccactttatcaaatattagcaaataaaaaccaattatttcataagataattatttatcacaaaataataatcaaaacatattttgatttcacagaaattgggggagagaagagacttggtggactcactggaagggcagagagagaacgacagagaaagagaaggtccaaaatagtctctagcatgtggacttgataacaaactgaatgacccaagtcagtagtatcaggtgggtgtgggttccccagattaattttggggctatcgtcgagtaaagactgatcgatttcaaggcaactgcaggcaatagcgacactttacatcatattcagtgaggaaagacttcctgtacatccaatatctctaattgaacattttccattcgtgattaatggagaacatttagatgaaagtgacgaaaatgtgatgaagaaaactcggttaattcgcaggcatcagcatttggctccgttatatttctccctagctacatgcaacggacaaagctcacaactaaggatatgacagcgcccagtccggcttcaagaactcatgaatgactttcctgatcacttaatagagtttacctcaaggatatgcattaaaaaagtttgattgaaaactgtttataactaaaattatcacagatcgttctatttgtacaaccaaagtcatactttcgcttatgcaatattccacgtttgctagcaccaggaaatgctacctatgttccatcaggaaataaagtaccattctaattgaagagcaagaatgaagctcagtcatgagaagttccctgtgccattgtaaatttcacccaatatattaatagtaacttcagaagatgtttatgttttctatggattttatgaaacagtttattgatataagataatgttcaaaatgacattatgagattcaccaacatatcaattgcagtatttgaagagcctcctttctcaatacaggtcgtcgctttgttcttcagatcctttgccctgtgcctcatctccttgccttcttcactgcacagtaaccttcttacagccctctcaatcattctcctctccagttttccctctagctcgaaccctatcttccatacctcttggacatacctagcattaatcatttggtccgcaaactgaggcctacagatcatcggaacaccatcacatatactttctagggttgagttccacccattgtgcgtccagaaaccaccaaccgctcggtgcttcagcacatcttgttgtggggcccaggaaaccaccatacccctgccacgtgtcgcctcctcaaagccatctggaaggcatgtttgctctgatccctggaccgagttaggcctgatcacccaaagaaacggaatttcgctatcgaccaatccccacgctgtctccaaaagctcttgagagtccatagatgccaagctcccaaagctcacataaagaacagactctgcctcctgcttgtctaaccattccaaacagctttgatcttgagttagcaagctgctctcttggcctatggagatcttgtgaagtggaccgatcgcgtaaaccggaacacttaggccattggcgatctttcggaggtcagaattctcaaggtcatcgaaggtattgagaatgacacctgaagaacaccgtgccgagtccaatagacgttctaagcaggtagccattgtaccatgtgtggtggttgctgagaacatcatatctcgcagacgaagtggtggaagctcatccaatggcatgtccagttgcagctgatctggaatttttatggaaatgaattgagatcagtcattggatgcaattatatgcgaatgcatggatgatggatcagctgagtgcatatatattttttgtagctatagaggacagaagtaactaaagatgcatgtatttagaaattttgtttcctttattttttgacaacaaaattaaataagcctctcaggatgcttccaaattgtaaaccatcatgaggtaactagttatatactttgcattttgccgtgggatatgtggataaatacatattatacattataaaaacgatatatgtatatgtttaaataatattaaaatgatgtggagataatgatttgatattaagttctaaaaatacaacaaaattgtaaaagatatgtcatgtttgtataatatttaaaatactcttaaataataattgctacttggtgatgatgtggcacgcttgtacgtgattttaaatactttagataatactaattgctagtgggtgataatgtggcatacttaaatgttgagattaagtagactgagtatcaactatatatatatagtatagattcgataagcctagctacttatgcctcgctagggtttgatttacacgttgattttcagaaggaaaaaggttaaccgtatgtctcagacttgaaaatagtggccaaatttcgggctcaactttactttaatttatgtacaacccgtatataattatatatactatccctatcaatgtcatatctattttccatggctcttcttacttggtcttagttttaaaggagggagttggcggtgatggtacatttataggtgatgaattggtctcctacatagcgtaaatataaatattataatttgtacataaataattatttgttgcatttgatatttatagatttagtacatttagatgggagccattgcaacgtgcggatatgattccagtcatttaaaattatgcaatttgacatattcaattttggaatttgaaaatattacgaattaacttcctatacatttgcttctgaggacagtgagaaaagacaaacaaaataaacaaccctagcttgcatatctcttatctatacttatagcccactaactctaaagcttaacatgcaaccataccacatcatcacccactaaccataattacatattcaacctcatgcaagcatgcaagagcatctacaatctatttaattctacaaattaacatgtgtcggtgatatgggaccgggagtatcgtgaccagaggcttgaggcagacacaatcgtccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccaccatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctatatgaagaagggcaaaaatgcacgttgctaagctgacacgtggtggacaaggatgactgatctgtgaccggtctgacactggtcgcgtcatcaacagacagccataatcccacgtcgcacctgtttccggcggaagtgggggtagatatgggccgtcccgtcagaagggcacccggacagcaaccgtaccgatctccgtccatttatgaagagaagaatagtccagtttggagagggagaggggcatgtggtatccccttgagatataaaaggaggaccttgcccacttagatagagagaggatttttggacacaaggccttctccagatccgatcccagggcgattgggggctggttgacactttgttacttgttcatacacaaatccactagaacacaggagtagggtattacgcttcccagcggcccgaacctgtatacatcacccgtgtctcgcgtttcttcctagctggcgatctttccacataccgaacaaatccaccaaaacacaggagtagggtattacgcttcccagcggcccgaacctgtatacatcacccgtgtctcgcgtttcttcctagctggcgatcttttcacataccgagagagcttgagatttcaccctaagcccccggccgaaccggcaaaggggggcctgtgcggtctcccggtgaggagccacgagctccgtcatctggcgcgctaggtagggggctcagcgtgtgttttctgagctctcgtactcctccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcactcgagagggtcgaaaaatccgcagcatcgccagtcgcgggtgatgcaggagaacggcgagatggggagcgtcgcctcctcgtctacggcgacggcaacacgcctcagggcgcgcttcaggctgttggcgcgctcctacgtaacccgcccgtcgtccctgacccggagtctccagcccagcgatggctggacgacgtggccaacttggtcatgacggcacagcagcgcctgggtgctggtggatggtccgccaccaccaagacctccggcgccgccactaccggctccgtgtcgtcaaggcggagggcgcggcgagcggcggctgttgcacgccattcggctgccactccctcgtcggcacctccgactcgggaggatcagcatggagagccggatgcccgcctcgacatcgagcgccggcgtaatagccggcgtactccccgcgcaacggagggcgcctcttcgtccagagtgtcacctcgacatggacgtgaggaccagccctccgtgcccccggctggtggtgtcggctgtagagcctttgtggcgagtcttcggaatgtccgttggctcccaaggttccggcccaccatcaccgagaagtatgatgggagtgtcaaccccaccgagtttctccaggtctatacgaccgggattgaggccgctgggggtgacgacagggtcatggcgaatttctttcccatggccctgaagggacaggcgcggggttggctaatgaacctgccacctgcgtcggtccactcttgggaggatttatgccaacagttcactatgaactttcaaggcacttatccgcgcccaggtgaagaagcggacttgcacgcggtacagcgaggggatgatgagtcactcgctcgtacattcagcggttttgccaagtccgcaataccataccatgcatccctgcacacgcggtgatctacgcgttcagggggggtgtgcggcacaaccgcatgctcgaaaagatcgcttccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagaggtcggtccattccggcgacgagggtcatgtcctcgccgtcgagggcgctccgcgggccacccgaaaggggaggcctgcgagcgacaaaaagaaagaggctggtactcccaccagggagcgcccagccggcaagtggtgctccgtccacaacacctccctccacgatctcgcggactgtcgcgcagtcaaaaacttggctgagcgaacgaggaagtgggaggaggacaggaggaaggaacgccgtgagggcaagtcgccggcaactccctccggtaaacggcgaagtgaggccaaacagaaggcccccgctgttgacatcgatgacggtgatgatgacctaggtttccaagaacctggggccaccattgccactgtcgatgggggagcgtgtgctcacgtctctcgccggagcctcaaggccatgaagcgagagcttctggccgcggcccctactcatgaggcgacgcgccgggcgcggtggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggtttttgatgccatcaaggccccggggatggtgctccagccgtcccaaccgattatcggtgtgacgccggggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcggaccacctcgctgctgcgtccaagcccgagggtggtgacgagaggcttggcacctccgcccccaccgccccgaggcagcggattgtcacatgcgccgaggtcccggtcaagggggttgccctgggcgacggcccatccaagaccacacggatcggtggtcttctggatggcaaataggaagacgtgctcgtctccttcctgcgggcaaacgctgacgtctttgcatgaagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttccaaaggcgaatggcaagcttcggatgtgcatcgactacaccgaccttaacaaggcatgtcctaaggacccttaccccctgcctcgcatagatcagattgttgactccaccgcggggtgcgaccttttgtgttttctagatgcatactctggttaccatcagattcgcatggctagggaggatgaggaaaaaactgcattcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaagacgcgcaaccaagagactttactctcagatctagcggaaacttttgaaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgccccccccagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactcagttgaaggcatatctcagctctcccccagttctagtcgccccggggccaaatgagcccctactactctacttagcggcgaccccccaagtagttagtgcagcgttggttgtggagcgcgatgaagacaatcctcatttcgcgcacccccgccctgtgctgacttggcccgggagcgagcagggaggagaagcccccgagtcgaacggtggcctaaggcccctgacgaccggagtcggccctctgcccgcttgtcagacggtgctgggtgcccccgaccctcaggaaggccccgaggccactgcgggaaggccgcacctatcgccctttggccccgaggctaaccctgtgctgactcgacccgggagaaagcagggagaagaggcccccgagccgaacggaggcctgaggcccctgacgaccggagtaggccctttgcccgcttgtccgacgacgccaggagcccccgacccccaggacggccccgaggccactgtgggaaggccgctcctgtcatcctccgaccccgaggtcatcggcacagaagacgagtgcgccccgagaggccacttggacgaagaacgccccggggatgcggcccctagcgaagaggatcggccccgccgaaaggtgcagcggcctgtctactttgttagtgaggccctccgggacgccaagacccgataccctcaggcccagaagatgctttacgctattctgatggcctcgaggaaactgcgccattatttccatgcgcatcgggtcactgtggttacgtcttaccccctcggtcaaatcttgcgtaatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcacggacccctctcagctgcctcacaccgtccactgggtgatgcagttcgacggttctctgtctctccagggcgccggtgcgggggtcacgttgacctctccgaacggagacgtcctcagatacttggtccgtctcgactttcgagtgactaataatatggcagagtacgagggactcattgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccgaccccttaggggagacggatgcgcctgaccagcccccgagacccgtcggagtccaggcctcgggacccgaagggagcgctccaagctcccttagattgattgcttggatctctgagatccaagcatacctcacagataagactctacctgaggaccgtgaagggagtgaacgcgtccaacgcatttccaaacgctacgtgctggtagaagggaccctctatcggcgcgcggctaacagaatcctcctgaagtgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatattttgggaccgtttaagcgggccccgggcgggtttgagtatctgtatgtcgcgatcgacaagttcactaagtggcccgaggcttatccggtcgtcaagatcgataagcactctgcacttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcgtggatcgaggagttgccagcggtgctctgggcaaaccgaaccacaccaagccgagcaaccggggaaacgcctttcttcctcgtttacggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgatgacctcgtcttacgccgcgtccaaacgcgtgctggattgagcaagctctcaccaatgtgggagggtccgtatcgagtgatcggtgtcccccggccgggctccatacggctggccacgggcgacggcacggagctgcctaacccgtggaatatcgaacaccttcgtcgcttctacccctgaggggggggtcgagtgtcaggttttggctcgggccaaccccgcacccccctcgggtgtgcagggttggccgggggctaccacgcatgcacattcttatttctcttatttcagcatttcaataaaagcagtttcaatttcctaaaggttgtgtctgtgccgttttttccttttgaagaatcttgacttgaaataaggtcactcgtgctcaaccttgccctcgggggctcggttcggtcagctaaaatcgccaaacggggcccagaaccgagccgtgccccggggcgtggtgaacttcgggggggaatcggcaaaaacccacaatcgggtcacccataaccctcggtcaccacgttcccggcctggccagcctcgacatgtggatctccccaggcactagccccgacccgagccattagaggactgggacttgggcacgagcccttaaatcaagctaagacacaaaagaggaccacagcacagatcatcctcatctcatacgcatagcaaaataaaattgacacgaattttttcatcatttttgattgtagattaagttgatctatacaaaaaagaggcatgaaggccttagaagaaagaaaaagaaaaaactggagtctggcgggggcctgggggctcagtccgatgcgcccgggtcgccggcctcgtcgttacggtcgtctgcaccgctggcatcgccctcctcgtcggagttgggggcgaacgcgagccgaggggccgacccatcgaaactgtggacgatgtggtcggcggcatcccggacccgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttggaaagcccaggccatctttgtgaggtgcggagcgaggccttccaggttggtggggtgcgtcattgtctggcctttccagaggcccgcttgccgaccggcgcgatccaggcgggagaccgcatcccaaagcatgccgggccctatttcgcccgccaagcggagggcctcggcttccccggcggatgagtctagcgcgcactgcatgtcggcgatggtgagttcggcagctgcgaggcgggcggctaagtcgctttcgcccgcagccgccccgctgacacgcgccctcgcgtccagctccttttcccgcgcctcgaggtcggcagcccgctgctccagtgcggctctctcggcgcggacggattccaaattgcggcgtgcctgctccgccagcgctgcctcacggaggggaaggctatccgccaaccgttgcgccgcggcctcggcctcttcgagagctcgctcccgctcagcgagtgcgtcctcgcggaggcggagcgcggactcctcttcggcgcaggcggcctcgtgcaccgccagcgttgcctcccggatagcggcggcggcctcgcggtccgccaagcccctctccacgacgccggcgtgttcctccaatgccatagcatgggcctcaagggcctcctcgcgccgccgggacgccgcttcgatctccgttgcccgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcggcctcccgctcctcctccacctctcgggcgatctctgccagcgccgctttgcgggcttcaagctccgagacgtgacggcggtgagccttacggcccacctccaccatgacatccaccgagcgccgcccctcctcgacacgcgcccatgcggcctcgagctccgctcgttccactcgcagggcctccacttgggcgctgaacccatctagcaccgcggtgtttgcggcggccaaggcctgcagaaggggctcggcgctcagcggggcgacagaagacgaggagaagagccgccttggagagaatgcgacgcggctcggcccgccggaggacgcactgggctcggggatgtcccccggacccgtttggtcatgggcgtcgcctggggaagtgggcccaggcgatccgcccgcggcctcgtcgcgagccgccccggaggctgtcgcctgagcgtcgcccgagggagtgggcccaagcgacgcgccagcagctttgtcgtgagctgcctcggaagacgccatcgcctcagcctgacgagcccgggcggcctcctccttagcagcttcttcggcttggcgagcccgggcggcctcctcccgagcggtatcctctgcatggcgagcccgggcggcctcttcggcttcccgaaggcgatctgcggcctctcgccggtcagattctcgcctccgttcctctgcggccgccggatcttcggcctcggactggccggacttgggatggcgggaggaacgtgacgggacatcgctgaagcaaaagaaaaaaccagaagacaaacaagatgggtaagggaaaacttgcttttgggataaaagaaagacggtcgcaatgagagtgggacgaacctgcgagggggtcggttaaatgaccaccttggaggggaaatcaggtttccccgggatggttccgtctcccccatcttgcggagccgcttcttcttgcgctccccctcgggctgcgatgtcggcgcggccccctccgggtgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggtagattgttccccccggcggctctcgcccgcgctgtcgtggcccttaggagtttcctcctctgaggccccgacccccatcataatggtcagaatggaggcgcggtcgggatcgctgcagagggggaggattccttgaggaatgagagatgcctccacggagctgagattcagcaccctttggaccacgatcttgaagtcctcgggagcccaatcccatctgactccctggtgggtccgcatgtagtcttcggacccggtgtactcccaggcgccccgggcgcgccgttggagcggcgcaatccggcgacggaggtagtcgccgtacaccatggcccctgtgagcccctgggatcgcaggcccgccagtcggtcgaggacggcgtcatagtcatcccccagatctaccggcgcccgccagctggagacctgcgccgggggctgacttggaagtcggaggcgcgcttcgttggcgaggggggtgtagaaccagtcgctcttccagtcgtcccacttcttgcggagggcgcaggggatgtagtggttcaacaccggcccccgcggctggaagtagcagccaccaaccaccgacggcggcgacaccgactgcacggtgaagaaccaccggaacagccgaagagatgggcgcaccccaatgaacatctcgcacaggtgcgcgaagatggccaatgtcatcactgcattgggggtgaggtgcgccatctggagatcgtagaaatccagaacatccataaagaaagaagaaaatggcggaaccagccctgccattgcgaaggggaggaagaagacggaccgccccgggtagtctggtgccgggcgtccctcgcccagcatcactatctcccggccggtggcagattccggcataaagcggcgcggcagcccggcatgcctctcgctcacgatgcgagaaggcggaagtacgcttccgtcgagcagagcggaaccccgtgccatggcgccggaggaagggatgattgagaacgagcgcgtgtggcgaaggaaaggcgcagcagagaaagagttagggctcaagcagcgaaggcaaggggaataatggcgaaaggaagggagcaaatcctttcctcggtgtctttatacccttgccatcgctgtgcccggctcctcgtttctcgcgcccactatctcgctccctcgtttctcactatctcgctccctcgtttctcgtgcccacgtttccactaatcccattcgcccgcttgcggcgcatgaggtggatatgcggttgtggcagtcgagatagatcgtatcgtgcgcgcgttaattacgctcgctgaccgaagcgacgttaccatatctccaggcgaagcaaatcggttcacccagattcgtacgccgctcaagtgatgtggcagtcttgaagagaccgcccattatggacagccaagtcaccattaccgatgtgcatgatttgagaccgttgggtttctgcccaaccatggagaccggtcccacctgtcaccaggctttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaactacatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctatatgaagaagggcaaaaatgcacgttgctaagctgacacgtggtggacaaggatgactgatctgtgacggtctgacactggtcgcgtcatcaacagacaccataatcccacgtcgcacctgtttccggcggaagtgggggtagatatgggccgtcccgtcagaagggcacccggacagcaaccgtaccgatctccgtccatttatgaagagaagcatagtccagtttggagagggagaggggcatgtggtatccccttgagatataaaaggaggaccttgcccacttagatagagagaggatttttggacacaaggccttctccagatccgatcccagggcgattgggggctggttgacactttgttacttgttcatacacaaatccaccagaacacaggagtagggtattacgcttcccagcggcccgaacctgtatacatcacccgtgtctcgcgtttcttcctagctggcgatctttccacataccgaacaaatccaccaaaacacaggagtagggtattacgcttcccagcggcccgaacctgtatacatcacccgtgtctcgcgtttcttcctagctggcgatcttttcacataccgagagagcttgagatttcaccctaagcccccggccgaaccggcaaaggggggcctgtgcggtctcccggtgaggagccacgagctccgtcaacatgcaagcatattcaatcattacctcacatcatttccacaatagttttacaaatttctttatcatttttataatatttaatatatacttatcaatatgttttacattaaagtgtaaatttgataaatattgataagcccttagatttgatttttttttctttttactcctagctaaattgtaaaaaaaataacattaaaattacttagtaattcccgcagcaaagtacagggaataccttagttctaatattgtgccttgccaatagaattgatataattcactcacgtgtgacaactactactatattagaaaaggaataattcgatttcatgaaaatagttctatcgcttaggattagatttgattaaacttctaaaacattattaaatatttgtgataggagggatatatatgtatatagtacttcgtaataagtttttttttgcgggggtatatagtaataagttgacgcaagggccctggtactttaattggtgatactaaacttgccaacaattggtgggccgttcgagcttaataattactaattagtgatgagctaattacggatctgggctcggataaaccagaattaattatcaaaatcgaaatctccgatggcccacttggccggccggggttgtatacctcgcgacagcggcgggaggacgcccttgccgcagagctccgggaaggccatgtacgccacgaggcagcacgcgccgccggtgcgcagcgccagcgtccgcacgccgcgccgctccgccacctcctgcaccccgcgcaggttcgagtccaccactaggcacgtcgccgccgcctcctcctcgtcgtcggcgaggagcgcctggcggagggcgtcgtcgaacggcgcccggaggagcgcgtcgaggcgcatcagcgcgccggcgaagtcgctgccgctgccgcccgtgggcatcagcgccgccgcctcccccgccactccggcccccacggtcacgaagcggtagtcctcctccgccgccgactgctcggcggcggcgggcgcgttgacgggggcgtggaagacggtgacggcgaggccggcgcgggagcggagcacgtcggccagctgcagcatcggcgtgacatgcccctgaaacggaatcgggaacatcaacaccctcctccgccgccgccccacgccatcgctcgccggagagatcgccgccatctttgatctgatcagataagctaagctctcgctccttcttggatcaatcttgatgattatcttcctgtgcggaacgatcagtatgatttgtgttaattaatttataagaaggtggtggttaggatggatgaggacggaattaagggggaatattggagttatattagcaagagtgtgtagatcgatcacattgaatggtaggatcaataggttgatgtcatgggggatttgggttgtggaggtggtttggtttgggaaatgcgtgatttgcttgggcacaagccaatatgtgtgcatatcgttagggggtgatccacggcaaacagacaggtggaggaggtgaatgacttttgtgactgctgctgcggcgaaagctggggctagctgccatttccatgtcgatctgttgtaatgattgttgtgtgtgatggcaggcacgacgacagcttcgcgtgcatgcactgcatgactcctgtaggtaggcctgcgcaggtacttacctatcttgtgcatgtatagggtgtgtgcctattttcttgtggtgctacgcaacgcacgtactccctccgtaaaaaaaaaaaaaaaagacaaaccttggtttttgtgcccaacgtttgacaaaccctgggtcttatttaaaaaaattatgaaaaaaattaaaaagacaagtcacgcataaaatattaatcatgttttatcatctaacaacaataaaaatacgaattacaaaaaaatttcatataagacggacaatcaaaattggacacaaaaacttaggtttgtcttttttttgggacggatggagtaagcacgtcactactagcttttgaatgcttgatcgtgttgtaccgtggcatatacgaaaacgtattttatgcccacgagttttttgcacactcttcatacacattaattagtaaacgtcataattgtttttttaaaaaaaacttagacatgtgctcctaatgatgagtattatacatatgtacaaagttttttattcaaaattaatattacagcttagaagaattaaaaaaatctaacagttttaagactaaaaatctattagacttttgtctgtgtgggttgggttggaacgcacgctacccgcttccatccacaaacttggttaagatatatttttttaactatagttcgtatgtttccaccacttagtataaattcagacactcatataaagctatatttgatcaaaagcagagtaaagcagttaagtttcactcctaatttgttttagttcatcttgactccgtgagtccacattggtagttagaagggcaatataactcttttttttaaaaatgagagggccccttgcctcttagactggggtgagaatggccctttttttaatgaaccctacagttttcaatggagtacttagggcatccacaatgtacttcaaaaacagtccatagtcaataaaataatacattcagctacctaaccacacagtggaagtagttcataggagagaaatagcaaaagtcatccataagcatatgggctgtccatatagaataaaatatgtcatttgtctctatttcctctctcctcctcctactacttactaactatatacattgtgaatgttgcaatagttaaagtccacaaatgtaagtcccatctatatggactactttaaccatatatattagtgttgcccttatttccaaaacataaactactccacttggtttgcttgcttgctttaatcctgtgcatacaccatatctaattaacttgagaataatatgggactcttatggacgaagaaccacgatgaaaaatggagagccacagtcaatccaaatgaaccacgacgacgtgttaattagtagaacttagaacggcacccgatgaaaacttggatcaataatatagtactccctctgtcccatattataaggaattttgagttttttttattgactactcgtcttattcaaatttcgtcttattcaaatttttttgcaaatataaaagacgaaaagttatatttaaaatactgtagataataaagtaagtcacaaataaagtaaataataattttaaaaatttttgaataaaacgagtggtcaaacgttgcaagtaaaaacttaaaatcccttatattattggacggagggagtatcttggatcgtacgtcttacacatgatgacaagacgttgatggcgtattgatcggtcgtctcgaatttaagatcgagttaactgcggatgcaaatttgtcacatcgtgtcgtgttcaactattcatattcgtcagtgtcacgaggattgcgctgcacagactgtaaaggaaacctgtggcatactcccctccgtcaaacaaaaaaaaaaaagacaaaccctggtttctgtgtccaatgttggaccgtcttatttgaaaaaattataaaagaattaaaaagacaagtcacgcataaaatattaatcatgtttttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaaacatgtgtggtggagagaagaggggaaacgcgtgcgctcgctcgcctcgcctcgcctggcagggcgacaatcaatctagggtttgcctcctactctgtactgcgccgtcgctcgtagactactccatcccgctcgccggcgtgcaccagcgatcgggagagcaggtctccggaacctctgcctttgacgtcctgcaccggcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatatcatgatttatttatggaataaattaaatcattatatgcccataatatcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacagtctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgttctaatgtggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctattgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctacgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgagataccggacatgcatgttggtacaattatggagtctcgtgatgctaccttctttgagagctttttcccaatgaaggatacacatagtggttcgaaccaaccctctgaaataattcccagtttaattacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcatgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtagagaagatcttgaatcgctttggctacattgatagtaagccttctccaacaccttatgatcctagcttgttgcttcgcaagaacaagagaattctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgttaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttcttttggctttaattagcaaagatgttgtcctgcagagcattcttgaaggaactcacctttgtgagcttgactgttggtcgcagtctatgaagattttgggtgaatctgctaggaagcttactaaagacctaggagtatgacttatacgctccactcgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctgttatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcacgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatagaataaattaaatcattatatgcccataatatcaacagttttatcatctaacaacaatgaaaatacaaattataaaaaattttcatataaaacgaacagttaaagttggacacaaaaacccagagtttgcttttttttttgacggagggagtatagtactatttttatgatacgtcatattctacgagtttaagatgatgggagagtatttgctgagaaaactgtacgtcgttgcaagcgtttgtcatgcgtatcagtatcacagtatatatatatgtgtgcgtatcatgcgtgcaccgttgtgcttgcatgcttgctttccgagcagccttttttttcttttccagtgaatggatcgatggatttacgtgtatgttttctaaactcttaaacaacataattttttaaaataccttttatgtattaatttttaaaatactgttttgaacatatcctttttaatttataacagttgattagtacctcaaataattattacaaatgcattttgctattcagctattcatccattcatggaaaacacacacaatagccagttgggtacttacgcgctctagggcattcctaacccaagacactaaatatagtttccataaactctacatcattaagaaactagtattagacactactcttccaatacaaacactactattccatacttaaatttaatactatttatctcacataatgtcttggatgttgtgtagaaaccatgtctcatgcaagacatggtttccttctctttcctcatttatttacttgccacatcaattttttatcctagatggcagcttatttaatgctatagacaccatcctaatcattgggttgggaatgccctagtgatctgttgtcgtatacacgctgcttatgagttatgactgaatattttttagcgtgattctgctgattgtttatttcttattttattttttttatacaagtgcgaacacacattaattatggtaaactcgtggtgcatataccaactggcaagtagtacagtacagtattaaagaaaattctaaattagttggaagcattcatttggattgcataaaaatggcaatctgtaattgtttttggatccttgcaacaatgaaagatgtgtggatgctaacttcccgttgttgttcgtgtcttagctggcctcatgcatgtatcaattgattggtgcatgctttcttagggcccatctccaattgaggaaatgaactgggcctagttcattttgggtaattggatgcccattttggtggcaaggatttataaggactattttgcattctcaaactttttttaaccaatcaacaagctaccaatttcattaaatatagcatgaaaaaactgtacaaaaggaaagtgtaaaaaaatgtacaagctagtcccctaggcccaggtagcggctatggtagccaagcagtgagattcctaacccccgctagggcttatgtttcggcctcctcctttaccttgtgttaacgaccaaatttggtaatccaaggatcagaggtgagaagaaaccaagatggaattcaagatggaaatcgtcccggaaacagagtaaggatcggctaaaatccgaatcggctacgactaagatcggcagagttcgagtcggacgaggttagccggttgagccgaatccgacaatatgacacggcatatgttgtcggtttaggttgatgtgcttcatgatgattgccacgcatggatagagtcctgagaaggcaattgtatctattaattaggatattttatgtaatttccttagagctatgtttgggcaaaagtctgccgcaaagacttatgatatcttagagtttgttagagataagagtcatgtccgatatggacatattctgtaattctcgggtataaatagaccccgagccccatgtaataaaaataacacacgttcaatacaatctcggcgcatcgccaccctttttactttcgttttgtttcgatgagttcttgctttcgggttgagctgcatcgatttcgatcttcaacaagaggtaaaacttgttatggtggcttgctttctcgggattagtgcttccatctttatgatactctaatcttgtttatgtaattcgtcaagttatcatatattttacataatcttcgacgatatcgttatctaacctacaatcggctaacatctgctaatagaaagcagccaattaggttaaataccgatgttgacttagattatataagatatccaccactctatgacacttccaacggcttgattgtctagatattgtttttcttttcatacttatagctgcatcagctgagtttgatcttatgagtcgtgattagaatctcaatctctagcctgtctttggttgccgattagggtactatcggggtttcagccgatcttatctgatttaactacatttatcttgtatgctttattgacatgttaaatctgccctttatgttaagatcttgttgcatttaagtatattaggctttttgtttgatatattctacttgctttaatatcttagtatatagtagtatcggagtattagccgatacatgctaaatctatttgatcggctatgctatgaatatatagtcttgttgttaatatatatttcgattaagtgatttatattgtctcggcatggcgatcgatctatcccaatcacttaatttaagtatatgtcgacatgaagattatatattgttaatatctacagccgatcgagtagatttagttctttcttacttattaatgaccgctgatcgatgcatatatgacatcggctcaaagataaataatatgtcatcggcatctagccgatcggctatcgtttatggatttaaccgcggtttctttatctttgtttcttgttaattgtaggatcaaatcaactagcacgctagcatatccaaaagcaagttttggacctgcactggagttaagcagatctctgaggcctcgtgttacacatcaacaccttgttgactaagtggggcacgacaactctttgtgttgaaaggtcctttaattggtttctttcctaccatatctcccagaagattagcagtactaaagtgcggaccgcttgttttgacgctcctcttgtgttagcagttaccttccaccattcttgcactggtgtggttggttcctagggtttagctgatcgcacaaatcatcccttctgctagagtcctccaaattcttttttttttatctacatctaactaagaggtggagggttgtctcttgcatctgaccatatagggggcatatggagttgtttcattattctcaaatttcagcaaattctgaatatatccttaaacttcaaaaccaaacactattaatgcctcaacttttcaaacagattattttgcattcctagtttgaaccaaataaaggtggttatagccgattttgcatcctctctcttccattattcttcttccttttccctaccacaactaggataccacataagtgatatgtagcctaaaaccatcctaggttaggccgagagatgcaaagtaatatatttgaaaagttgaggaatgttacttttaaagtttagagatcaacttaagattataaaaaatttgggaatgtaaacaggacttttcactaagaatttctccgtagtacgtacaatcagtttacaatatcattatgacatcttagtacggtacttgagttggttatctctctatccatgattatgaaccatcttataaaatcttatgaattaaatgtcccatagcaaattttacctttagactaaagcttcactcaagaaggcaaatttgttgtcctttttaaccacacataaaacaaaaacacacattagcttatgattaattaagtactacctccgtcctagaagaagtttagagttggacatagttattaagaaaataggcagaattaaatagtgggaggttgtgattggttgagaggtggaggtaagtgggaaaaaaggatggtggaggattgtgattcgtaaaatctatttcgagaggcatctcgatttagacttaacgagtagtagcgttagcgttacagacatgcatgcaaagtagtttttgctattaggttgtgcatattttttttcttcttatgaaattttctcttaaattactcatccgatctataatccgattacccattgtgttcgtaacaattaaatctttacaacaagatctcacatgattatattttgatgaaaaatcacaaattacttttatgatatgtctaaattacttttagatttcactaagttacttcttaggcatacaaaagtaaattcagtaaagcctaaaagtaatttacatatattatagaagtaacttagaacaaaacgaatgtaacttagaacaaaacgaatgtaactttggcatgtcatttgaagtaaatccgttgtagagataaaaacatgactctatctagaaattaaattaatcagcacaaattatgaaattaactaaaaacaataataaaagtaatcacctcagagcattatgaatgtataggaagtattttaatcaaatctaaaaaagtaacttatatatatgataatttgttcaatgaaaaaagagtattaattaaagttactttctttttttataagttacttctataatatatgtaaattacttttaagctttactaaatttacttttgtatgtctaagaagtaactaagtgaaaactaaaagtaatttagacatatcataaaagtaatttgtgatttttttatcaaaatataatcatgtgagatcttgatgtaaagatttaattgttacgaacacaacggtgtaatcggatcgtagattaaatgagtagtttaagagaaaattgtatttgaagtataggtggatggtgtctcttatagatgaagtggtagctagtttctaccactagctgtgtagtcacgtccattgtgattggttgaggaaaaaatattggtggagaagttgttatattttggggaaaaaattgtgggatttagggaaaaattttaagtgctaaaagttgttatattttaggatggagggagtattaaatattaaaaagttggaaaatgaatctaatttattttttagaaatcttctatatagatttttttttttacaaaatacatcatttagcggttcaggaagtgtgctaaaaaaaaataggaagttgtcatttcgagttactgaaaagaactcagcttaaactcatcttaggtaactgtgcatgatatccctgtacgtactagtggcaaaatcctaatttaagtcttgatcccgaaacctagttggttgcacatattgtgtgaaatcaataccaactctcaaatatatgaaagaaataatgcattcacgaagctttttcagggaccatagatacatttcataagttgatcattttcgataatagttctgatgaagacattctccactattacccgcacgcaaagacgcaacaaggggccaagtggtccagttgtagtcgggcggcgaccttgtgagtctctaaataatcccaccttgcttagcttgggaggaggaagccaccttaaaagagagagccacccttccccaattggactagtcttttagggagattggatctttccccgagtgggtgtgcctaagaactgttgactattacccgctggcaaagacgcaacaaggggccaagtggtccattccccgagtgggtgtgcctaagaactgttggggtccggacaaccttaatttgttgggcctcggccaacccccccccccccccccgggccggatcttggggtccgggcaaccttaatttgttggtgtcggtgatatgggcctaggggttgatcgccccaaagccctcgcccggctgccacgtggcggctgtctgagggcttgagcgggctgaagcgccgtccgctaggcgcatttatgggtggcgccccaaccgcccccgtcgcacttaatacggcgtggcaggttgtgcgccgcccgctggtagacgtgcaccccaacccccccgggccgaatcttggggtccgggcaaccttaatttgttggtgtcgatgatatgggcctggggggttgatcgccccaaagccctcgcccggctgccacgtggcggctgtctgagggcttgagcgggctgaagcgccgtccgctaggcccatttatgggtggcgccccaaccgcccccgtcgcacttaatacagcgtggcaggttgtgcgccgcccgctggtagacgtgcacccggtgaccgctttttgaccggtctgtgacccgacgatggatggatgggacaggcggcagcgcactcacgtccgacttcgtgtcagacggcgtaggggccagtatggcatgtcccatcatgtgcagggaaaggacgtgcaggtcgccacctcccatgcgcgtgtgcccatgaagtcgccaagcatttaatagggaatgacggggatgtcccccgtgttaggcgaaagacttcagtggggggccacctaagggcggccgcatggatcgcttccagcccaaggcatgggcgctctttaatgtaggcaatgtgggcccctctcccgggcggagagggtagggacagtgcatgtggtatccccttcacctagaaaaggagtacctcgtcctgcgggtaaaaggggacgactcttgataaaccagattctgggtagaggctggccaagccctagtttgtgcgcccaggatctgaactctctgtaaccacgtgaagatcatcacacacacaggagtagggtattacgctcaatagcagcccgaacctgtataatctccctctcttgtctcctcatcatccacctcgcaagcttgattcccaccgatacacctcgctcgcacaagaatacgttcctaagcattgtacccagtcccctggctgaactcagaaaggggggcctcacagcctcccgctagagaggatcacccctcgacagttgggcctcggccaacctcacctgggccggatcgttatcattaatgatgaggacatcctccactattacccgctggcaaagacgcaacaaggggccaagtggtccagttgtagtcgggcggcgaccgtgtgaacctatgaataatcccaccttgcttagcttcccctattggactagtcatttagggagattgggcctttccccgagtgggtgtgcctaagaactgttggggtccgggcaatcttaatttgttgggcctcggccaaccccacctgggctggatgcatcatttggtatcagagctgggcccttgtttaaaggggtgagaatgatgaggacatcctccactattacccgctggcaaagacgcaacaaggggccaagtggtccagttgtagtcgggcggcgaccgtgtgagcctctaaataatcccacctttcttagcttgggaggaggggcaaccgtgtgagcctttgaataatcccaccttgcttagcttgggaggaggggcaaccatgtgagcctttgaataatcccaccttgcttagcttgagaggaggaagccaccttaaaagggaaagccatcattcccctattggactattttttagggagattaggcatttccccgagtgagtgtgcctaagaattgttggggtccgggtaaccttaatttgttgggcctcggccaaccccacctgggccggatgcatcaagttctatgtaagcaattttaatcaatttgattaaatgacctactaaccaaagatctcaatcgagcatgatagacccgttggtaaatatggtggagacacctaagcacaatggcaaagccaggatttagagattgggggacccattggtaaatatggtggagacacctgatctcaatcgagcatgatagacccgttggtaaatatggtggagacacctaagcacaatggcaaagccaggatttagagattgggggacccattggtaaatatggtggagacacctaagcacaatggcaaagccaggatttagagattgggggtgccatctatgagatgtgggaactcacttaatcgagcatgataatgatagacccgttggtaaaaaatggtggagacacctaagcacaatggcaaagctaggatttagagattgggggtgccatctacgagatttgagaactcacttacggttcgatgaacagtactttgtagcgttgatgcgtggttggcaacttggcatcatgcatgttacagcgattagctacaagagagaacgagaacccatagatcatgattcgccaatttaaaatccagtaatatttttaatatatggatgattgaacggtttgttccatgtttttaattggagtcttgcaatcacttctgaaatgatgaattagttagctaaggttgtgttcggcattgcctgtttccatcctcgtttttcgcgcgcacgcttcccaaactgctaaacagtgtattttttaaaatattttctataggaaagttgctttaaaaactcatagtaacccattttttaagtttattttagttaatacttaattaatcgtgcactaatccatcgctcggttttccgtgcaggaggtgagggttcccaaccctcacccaataacatagcctaagtcattttagaagtcctatatagctatgcagctgttctatatagtttgtctcatctacaactaatggtgtaattaatggctagattatacgggttaatcacccttagaagaagagaggggaggggaggtcgcataagggttggggaggggggtgctggtcctccccggcccccacggtggcttcgccactgcctaagcaaagcatggacattagcacataactctagaacaatagtaggagatgattcctcctacgaaatataaaagggacttgatagagaggaagagaataatgaaaagttatgtgtttcgtactacgtctaattctcatagtaaacgtctaattctcatagtaaacaatttctagatgattttttatgctcatgggagtgtaaataataaaatattactccctccgtctaaaaaaacccaacatatcacttcgatgggacataatctagcacaacgaatctggacagactgcctgtccagatacattatactagattatatcatatcaaagtaatagttgggttttttttagatggagggagtatttgtaactcgttccatcgctttcactaattttggttatgtaaatcgttttcgctctaaacattctgataaaaccaaacggtggaccccagaaatattaactactcaaaaccaccctaaactctcaaaatatttcttgatagaggaacatcaaaatagaagagataaaggacatctacaccgattgtagcacagcacagctaagagcaaggtcaatagtatagcccgctgttggctccaaaaaatagccatgtcatctatagtaagcagtatagctaatgtctacaatagaaatactataacacaaatattttattgtttcatgggacccaccatcttctcctacctcccattctctctctctttctcccatccgttgttccgttcatgtcttctgttctttgtttggttcttgagcaacagagatggcgggcggggggaaaacagcggcagcggacacaggagaccgggcggcggcgggcggaagagggcggcggccgtgcggcgggcgtcggagacggcggcggccgggccgagcggcggaggcggaagaggacggcgggcatcggagatggtggcggctgggccgcaggacgaaggtggccatgcgtcagcgccggcgagggcggtggtccggtggccgcgggagttggcgacggaggcaggcagcgcaagcatctaggcgggccccacgaactcctcgagcggcgcgtgcagcccagcgacaaattagtcgccggctcactctctctctcattccctctctcctccagatcatcacaaaatcttacgtggaaccagtatcgcccgttattgtacctgctctaagctgcagagtgatagagcccaacacaccacgccttgtcctgtcctccttcgatttgctcacacgtgctcagctcaccgaccgccctcgcttcgcttcgcagctcgattcgatccccacccaaaccaatccaagaaaccaccgcgaatcatggacaccggcagcggcggcggtggcggtggcggcggcggcggcgggggcacgagcatccacatcacggcgctggacggcatcgtgaacgtgaactcgctcttcaccctggcggccttcatcggcctggcgtggcgcccctccgccgacgggcccgagctcgccggcggcgccgaccgcctgggctccgcctgcgccgcgggggaccgcgtcgagtccgacctcgtcctgttccacgtcctcgccttcgcctgcttcctcttctccagcatcgtcgcgctctgcctcaagcagatcgtgcgcacccacccgcactaccgcctccggagcggcggcggcggcggatccgccgtcagccgcacggccatgatcaaccgggtggcgctccgcgtcgggatcctggcgtcggcggtgggctccgtgtgcgggtgcgggttcctgatgatggcgctcgtcaacgtcgtgcaggtcaagctcggccgcctcggctgcggcgccggcggcgccgccgcgtggggcgccgtcgtgccgctcgtctcgctcgtgcccaccgccatgctcatctacatcggcatcgtcttctacgccttcacccgctagcccaaccaccggatcaacaactgaagcgcagcaatgctagtattgattttttgcttgtgattttgagagatctagatgatgctgcattgctgccgacacggcgacattgtatatacaactatgcaagtgtatgcagcttgtgtgttcttggagttacctgctaattacctaattaatatgttcgatgttttttatttcttccttgcaagttgatagatttgttgtgatgtgtttggtcaagtaccaagaagattgaagtcatgcagtgatgaaacttgagtgccagctgctggttgaaatgataccagctcagattcttcgattcaggaaatatttggtttttgttacttactctgtcggcaaatgagcttattgtggtttgattcagctgcaggaaatctcactgctttcatcattcatggttctgtttcttgttactctctttaccacctactaaaatacttcaaatgattgaaagaaagaaaaaacaagttgagttacacagctactaaaacatcctggctcaaaacactaagaattgtggcatgactcgaataggatattcaacaggataccaagaaaactcaggcagacccagagttcagagcaaagcactagttctcatatctcccaataatcagtagagtttttttttcccctgttttctaacactatcttctttctacttcttttgagccgattttttttttttggatttaagttaaatttctatctaggtgaccttttctttttggattttagttaaatttcattctcttaaaaatgctctttttcccaacttcctagattaatcctatgctcttttttatttcaagcttcccagattaatatagtttctttgttttctgtatactatatttctcagtatacctgtgcatgagtaaaggcataaccggataagatgtggatgattaagccatccattcataaggttccgtaggttatctgacgtctatctgtaaatcagaatttagaagtggctgttatctgaggtctatctgtaaatcagaatttagaagtggctgtaccactgtagtaagagtttatactacagagtctagaaattttttttttgtctggttattagttgagttggagaagtataatttccatggacatgatatatttactaccttgtctgagaaggatatggtgaaacgaggaaaaactggacactctaggagagcttgatgaaacgagttactttcagtctttcagccatttcagctataacagcaaacaacagaggcgaagcaatgtaaaaccagcacaggactcggacttgattagcccaaaccaagatgaccgaatttattcgacaagagaaacaaccgaattcaatatacatccaatcttctaaatcttggagctactgatttgcgcatatggaaggctaagcactatgacatgctgaaactttcctgattttacaatgaatcctgttgcattctaaacagaacatacgacctcatttattttggagctctgcagcaatgcaattattggtaatagcatcacatctttaaatagagacggagcaaattcgacaaattttgggagtctatggctggcaacactccacatcgctgtgaatgataactgcaataaaaagaatagttcttagaagcatgtcatctagtcgtaccattgataatgtaactatgttgaccatcggttactcaaaagaaagtccttttccagaacattataacgagaagagatggctacatttaccaaaatcacattcatatgtgagaaatggaaatcacctcaccatgaaaataagaatgccttcacctcattgacaaccggtcattctagcccagtccacaaactgcattcctccataaatgttatttgcaaagcgcacaccgacagtgaatgccagagaaacagctgggacacgcttggcaacaggtgaagcctcaaccacacgctcaagcccattaataatctgataacgggtgttggaagacacaccaaggaatgcacctgaaacattgagcacgatttctgtttagggagcatcaatatatataatcaagtatacttaaaaggtaccgtaaatgtaacagaaataaacagttagaattctttgaatcatgcaaatattatattgtgagcagaacttaaaaacttttgagttagttagcatatagcgaagatacctaagctcagaagtactgcaggttttggctagaaacagaatcttaacgattggcaatttcattcaggcccactttaaacaacccaatagcagtatgctgacatggggaa

SEQ ID NO: 69361 - DNA, 2119 bp, Oryza sativa
tgcatgattgcactgaatggggagattgcaccggatacttccccatgctgacattagcttctacggacagcatggtcaaaacacataaattacatggtgtatatcaactatcaagcatagctgttatataatactatcatgctattggttaggaaaatcatgtctaatgccacatacaaataagcacagtaaatggtttctcatcttatgatacaagttattgcagacaaacttacgttgaaaacagaatatatatagcacatataaagcagctttgaaggttaatccacacattgccatatcatatgctaaccacaaaacacaaaactaggtgaaagttaactcttatgttcattgtaagaaaaataaatatgaaccccacaatgtattcattacatgcatgactacctatttatccacatcctcccggtacaaaaactaatttgttttagtatactgcacagcaacagaggggaaaaaataatgatatagacttcaaataaaacggctaaacacaaaaatacgcttaccccacaatgcagaagttttgagcagaggtgggacaggtacatcatcatctgacttctttacactcctgaaattcaaaggaaaataatatattcgagatgcataaagactaaacagtacaaaaatacaatcaggtcaaaaacatattctgcatttttgggaggaataatatgagtgtatcatgtacatttaaatcagaactcaacttagatatccagcaaccagcatttgaaaaggattagtataacatccagtgtcgattgtcaaatgtaagaataacaactaaatgaacttgtgcacagaaattgacttgcatatttgatcttacgaacttctcaataactgatgtatgcatcacagcaattaataagctttgatagaaatgcgttggtgttaatatgagcatttgcatatgttagtgagattgtttttattagtaccattccagattatgaactaataattaagtaccaaggggatccatacaatgtatatgattattctgttaaactctaattttgctcatgtcaatatgtgatacatcgtgatctaaatgttatgatggataatcacaaaatgcagccgcatagtaattattaagtcttcctatatctcctgatgatttacagaccttgtctgaggctctgagccctctacttagacgcataacaatttttcatgttactatcaattgtaactagagaagtatataaatataaccttaccatgcatggaattacagtaaaatatgtcaataaactaggagcttaagtctttcgttttcttagcttcagggacatgaaatgttcttgtttttacacccataaaactggtcaaagtaccagaacataaagaaaagtgagataccttttggcagtcattatcaagttcgcaattccttgacccacaagaccacaaaagaatccaactgtaccatataaaataccctgttcgcaaaggtattttagatattagaatatacaatataagtcagcatccaaacacgaggtgaaattaaaaaagagatgcagcaaacacaaaagaaaattaccttaaaaaagtatgttcctatccgttgttgaatggaaaaactatatcctggcctttcagcttcaaacacgctgcaaaacatcagtttcatcagcattacttaggacagatggtcagatgcactattattattttttactgaacaaagttctcataagcagatgtaattaacaaattctgtatggtgtttcaaaactaagagctaacatcaaaagattcaatctatttttggtaatattgtatttcacagcagttcaaggcaattaattgactcattaacatctagaacattttgaaacatatgttacaaagtattcagtgccacagtataatatagtccataccactcaaaagtagatgccattttagactctagtgcaggaactaatgtatgaagtaataaaggaaaatggcagtgatcaaatatgggaagggtataagcaaggatggggctcaagttaaaattctcaagaaaataatagaatgttctgtgtttaaaaacaaaattagaaggctaaaatgagatgtatttgaaacagat

SEQ ID NO: 69362 - DNA, 1206 bp, Oryza sativa
aattctacacacatcatacacaagtccaagtatctcatcatgagtgagttcttaacaatatacctgcatgtccaagtatctcagcagcagtagcttctgaatcccgacgctctttgcggcctcaatcatatccgcgggcaagctgggcaagctgacccctcgcttctccacctcctggaccacctgatcaaaactcaggatcggcccaaactcatcatccccttcatccccaccgtccccaccatcaccaccaccgccgccaccaccattatccccatctccgccgccgccactggagggtaacttcccattcccacccgagccgtcaacatcagccacctcgccacgctcccccttcgggagcacgctcggaggtgcaaccgcgccgacctccttcacgtggtcagcaacctccccagcatcaggcacggcgacggtcgaaccggaggtggtggcgccgccgcccccatccgcgcaggcccgcggcggcagctcggcgcggatccccctaacccccagccccctcctcccgcccgggtagaggcagcagccgctccgcctcaccaccgcggcgccaccgccaccaccaccaccaccccggcatttccccacgccgacccgcccctgctgcagccgcgcgcccgcgcacgagaacgccatgctcatgctcgcccacccacgcaccactacagaaatggtcagattggattggaaatggccacaaaaaccgcaaaaaaatcagagaaaaaaaatcggagaagcccgcacctgattgcggctcgacgaggaggcgacggatcgcggaaaactccgaacaaaatccggtgaatgattaggttcgatttatcgtgggggatttgagcgcgaggaggtgaggcgtggaggggttggtggaggagggggattggtggcgagtggcggcggcgcggcgcgaaggaggaggggagcgtgcgtgcgtgcggatcgtgaggtttttcgggggcgttttgtagcgacgggtgagaggcgccgcgtgtgaggctgtcacgtggggcccacctccggcgaggcgtcgcgcgtgaggctgtcaggtggggcacgtccccttttttgttgccttgtgggggcttcggatgggtgggtgacaggtggggccaactgacatggaggttttgcaagtgggggtttcttctcgttttggctgacttctggtcaaattgcacacga

SEQ ID NO: 69363 - DNA, 2185 bp, Oryza sativa
ctgatggaggttgaaagcttctaaacttgtgatggtttagttaattaggaaggcttgcatttaaaattgctccatgaaagcttcgataataattaaattatatatgtacaaacttagtaccatgtgtgtttgtattgaccttatcgtttttgcaaaatataatagattaacaataagtgctacaattattttatatcactagctaaatgcacatgcgttacaatagagttgtaaaagagatattcatctttataaaatcatttctcattgtctattcatgaaactatactttcatcaatcaaattttattggttagctataaaatgattgctaatcatcatcataatttaaagttgatattaaattttcttacagatttctttttacttttatagcctggttcttttttatataattgataaaatggcatgtaaaatgtctaactaacatttaccgtatatgggcctcactgtcacactgggcagagggtgatggcagtagaaccaccaccatcatttgtgtctttcataggagtatatataaaggacactatactactcctctcgtcccaaattataagtttacactggcttcaatgacatgctttgacctaaatttatttcatgttatgttatcaaacacctacgaaattagtatcacataaaattattttaaaatataaatctagttatataacatgcataatacttagtataaataagctaatgtaattattagtgaattttttttaagtttgagttttctaaaaataaggacaccctataatttagaacagaggagaagtcacagaggagaataacagaagcagtttttcagtgtttggcaaaaaccaatgttagtatttgcactattgttacaccatgagttgaggagaagttagagatgaagaagtattgcagacagagcaattgtaagcatggaaggtacagagaacataacactgatagcttctgaagaatctccatggccatgggggttgttttttccctcgctctctttagcatcatcaccctgcccaagatcaacaaaagaaaaatagttaatgaactaagggtttcttgaagatatccatgaaaaatttccattactatagaaattgaatatatatgtctatgaaaattcaaaaggatgtcgaaataggtggcaaagagaaattatcaagcgtgcatctctctcattttctcaatggtctcgtttcgatgcagtccacgagcatggacacatggatcatgaatgaataatgcgtgtacgtaccgcggcttccgtctccggcgagtcgccgtcgccccccggcgtcgtcgtcgcggcggcatcatccccctcttcctcctcctcctcctcctgcaagatgcgccacaaaggagtttcacaacgatatgtcagtcagtgtcggcagccacaaaaaccatgcatggtgatggcgacaatgagcgtcgatcgtgtcgagcacggacgcgcggcacgcaccggattcttctcgtcggccgattcgccctccgatggctccggcgaggccgagccgtcgtccgacggtgccggcgcggtggcttcgtggagaccttcttcccaccgacgacggcgcgggcgcactcgcctcatagccggcgcggcggcctccgactccgagtcacgcttcgtcacggcggcgccgctggcattgccgcccttcgccggcgccggcgccgacgctgatgacttcccctgcattacgcaacaacgttcattgcactcgccggcggcgcggcgtacggacggacggacggacgtacgtaccgtgtctttcatgaggccgacgtcgtacatgggcgtgaggtcgggcttgaagaggccgaagttgcgctcggcgatgggacccggcttgaggttctcgttgaagagcgcgaagatgtaggtctcgaacgtccgcttcggcatgagcggcgtccccgaccccgagctggcctctccgatgaggtagcggttgtactccgccgcctcggcgacgctcacgccggcttgtccgggctccgccttggtcggccacccggtctcccccaccgtgatgtccacgtcctcgaaccccagcttcttcatcgccgagaacaccgagtccagctgcgcctcgagcatgctggtgtaggtgatgcccgtgcccgggtcgagcacgccggggttggggcgccgc

SEQ ID NO: 69364 - DNA, 3575 bp, Oryza sativa
  unsure (1)..(3575): unsure at all n locations
atgcgccggaagcgggcggcgacgagcgccgccctgagggtgcgcatggccgggacgaggccgccgatgagggcgttgtccgccgtgttgatgatctcgttgccgacggccacgagggagatgtccgtcgccgggtagtacggcgcgatgttcgccgccacccaggcggcggcgccgtccttggtgcccagcgtcgggatgtcgccgtttccggcggtgaccatgaccgtgatgcccgtgccggcgaaggccttgacgatgtccgggttggtgtcgaacagcttcacccggtcgatgcgggtgcggttcgcgaggaacttcgccacggtggccggcggcggcaggttgtctcccttggtgccgtagttgacgccgattgcggcggcggaaggcagaaggatcgtgaggaggacagggagaacggcggcgaccgcgtccacatgccgtgacggcggcgccatggcggtgggggaggacggcgcgcgcaatctgactccggtcgaacaggtggtgacgagagcttctggcttttattggtgcgctaattatagcactagattattagctagccaataaacaacacgtattcaccctggcattgattgctggaaggaagggattgcttttaatagaagtttatctatcagggtattaaacacaaggcaccgaaatgccgttgatatcattattgttcgaattaagaaatgtccattatcagttcttcgcccccgcgtcgtcctccctcacggaagacacaggaggtggaaaccaccaccgtcgcccgctccccccctccttcctcctccgcctcgccgccgcccgagcggccgccggcaaagccgcacggccgcaaggatggtgatggaggggcttcgtctcgtctctccctcccgccaggggtgggggccgcacgggacggcgaaggccgcccagttcgaggccatcatgaccggatctggcagggagaccgccggcgatgggtcagcgtggtgaggcggtggcgattggcggtggtggcggcggggatggaaggcggcggcgaggatggtaacggcgggcagggctcggtcgctccggaggcggacacccccccccccgagggccgatccagtgcggggcaagctcacggcggtggtggggctacgggactcgcggcgacggcgtcggcggcgatggcgtcgagcacgtcgcgacaacgacagtggcaacggcgtggagctcgtggcgaaggtggtggtagcggctggacgatggcgacagcacagtggttggtagacggcactgccggctgctgtggcaacggggcgcactcacggcggcgacaacggcgcggagctcgtggcgacggtcgcggtagcggcgaggtggccatcggcagtagtggctgcaatggtggtgaggcatggcggtctcggaaggctagccgggggcgtggcagacggccgcacctggccggtgcggcagtgattggaggggtcggaggccggcttggcgtagagaggcacggctgttggcagtggaggtcggcaaggcgcgagaggcatggccggtggcaaggaggccggcatggcgtgagaggcacagccgatggcaggaaaccggactggcgcgagaggctcatccggtggtggaggaggacggcgcggcgcgatgaggcacggccggcggtaaaggaggcgaccacgatgtgaggaggagctgcggggggtgtgacgcggtcttcggcgcacgaaggttggccagcgggaggcgccggtgcagtggtcccacatgtcggcagaggttgagcagtggtggagcatcggtgcatcagccgtggacttggaggtgagcggcgagtgaaaacctagcccggccttgcccggaccgacaacaatggtttccccctcctaagggcgttgtcgtgccgtctcatccctcaagggtgtttgtcgggcaaaagcccaatcttggctcttttgagtccccgacggacagcgacggcggttttccgtcgcttatctccttggagacgtcgtttaggcatccccttgtcaaaaccactcgaacgattggtgcaagcacactctagatagagttggctttgtgtaggttgtaagggcttttgagcattctcgtctatgttcctttgttggcctagcggcggtcggtcacgcttagccgcggccggtccagtgctagtcttctctcggacctgtgtgttggcgctgtcgatgtgtatgtggtggtatattttttcctttttcctgattaagaccttctagggttgtaatcttgtttttttttctgctctatcagtagaacttcgcaccgtcttgtgcgagtcgttaacaaaaaatgtcctttgaagtaaagaatcagtgtgcctaaaatcaatttgtttgaaaaaaaactcattgcaattgaaattttgttgctaggagatgttgcattggatttttttaaacccttttcatctcaatttctaaataagccttccaaaaaatttatgtacatatatgaatctgggaaactattttcatcccttgaggggatgtctacttgtttacttaaaaaccatccaaacggatatgaattttttttgcagcactcgtacaacatatctccatagaatcttaggtctaaactcaactcacaaatcaagatataaaagagataaatttaacgtatgaatagtagtgtattgtccacatctaaatttgttttttttctcgatgtgtagctcgaatttgaacttgatttttggggtaccatagatatcactatgttctacagtggaaaaaagtttagaatttttctacaactatttgtatcaaatttaaaggaaaaaaagtacacaaatgacattccctcgagggattagaatccactctctatgaatcttcaagatatgctatttttattggtgtggcaggacaacactcccgcacccaagtatgtaaaacattgttgtgtgtttgtcgccacacttcatgatgtacttcctccgtcttaaaataagattatctttgctccctcttatttatctcaaaataagttcattttttagaaatcattacattggggtttgtgaaaagtatgggacaaatgcattggaattggttaaagtgaggggaattgataaagcgaagagtattatttttccacttttatactagaatgtgtgggttagatgaaaaataagcttattttagaacgggtagtagtaacttgccaaaccattttggtggatggccacatagtttattctataagggcaagctcaatgtatgtgcaacgatgaccgtaagggtggggcctaatgcaagtgacataagttagtaccaactctacaacagttaaaggttgtgaaatcgaatttaggtacccctcgggttcatcacccaatgaactggtgtgaactgtgaatcaataaaaggatcctatgttattctcttatggcacaccttaatgttaaggtcaatctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69365 - DNA, 6551 bp, Oryza sativa
aaattaagcaaacacctcaaggtacttttgtgcatcaaacgaagtatacgaaggatcttttgagacggttcaagatggagaattgcaagccaatttcaacaccaattggttctacagctgtgttggatcctgatgaagatggtgaagctgttgatcaaaaggaatatagaagtatgattggatctttgttgtatctaactgcttctaggccagacatacaatatgttgtatgtttgtgtgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgattttggaggttgtataattgataggaaaaatactagtggaacatgtcattttcttggtacatcattgattgcatggtcttctaggaaacaatctagtgttgctcaatcaactgctgaatctgaatatgttgctgctgctagttgttgttcacatattctttggcttttatttactttgaaagattatggtcttacttttgagaaagtacctctcttttgtgataatactagtgctattaacattgctaagaatcctgttcaacactcacgcacaaagcacattgatattcgttttcactttttgagggatcatgttgagaagggagatgttgaattgcagtttttggacaccaagttgcaaattgctgatattttcactaaacctttggattctaaccgatttgcttttcttcgtggtgaattgggaataattcatccttttggcatggtttgagggggagtttgtacctcatgcttttatcaagcaataatatgacaatgagaaaaattgataaaagatagctttgtttatacatatggtattttcttgtgcatgctagcaatactttgaaagtttatttgtctctagcacagcttgtatttattctagtcttttcatgagatttagattttacttttaagggagatgatgcatgacacttaaattctacttgaattaagtaaatatgcaatgttgatgctagcatatggtttgatctataaatgctatatatatatatatatatatatatatatatatatatatatatatgctttattgacttgttattcctcaaatagctttaattgctcattgtgaaaaagagaataaaaaatatgaaaaaaagaatactgaatccttggaaacagtcttgtcgacaacgacgtattcgatgtgagcaaaataatgggtgccgaatccctagaaacagtcttgacgacagggacatacccggaataaaagagaaaaatatgagcaaaaaggctcaagcaaagaaaaaaattgaaaaaaaaattctcttagttattttgtgctaaaggttatttgagaaagagtaataaatgcaataggtatgtgtgtttagtgtttattcttcaacctatgtgcttgttaagatgttgcattataaattgtatgaaatcatgaattttgattgttgattcaagattaattgtaaaatctttggttcatggttatactttaatgcatgcttgttatattatagatgggtttatcttctttttattgcaacacatgacttgatatactatatgtatgttaagctcttgaacattaatgaacataattcctatgcttgatgaaatcattgtcaaaagggggagaagtatgtgaaaatttttggatttttgggagaagcaaggtgaattttggtgagttgttgagaagagtatgtttttggttcaattgggaatttctttcttttcaaaagggggagaagttttcttttggatttttgagcacgatgtgtacgtttgtacgaagtgtgctttttaccacttttgtttttatttttccaaacaccaaaacatttttgataggtttgccaatgtgttcatcaagggggagattgtaaaatcaaaggtgtttttggttattattatgtgatgaacaattgggcatcggagattattggttttgttatttggaatttattcacgaagtggttttggagatgattggatttcacaggtgatcacaggattcattatttcatgtgaccggtcagaccgggctgtgtatgccggtcagaccggccgacactgtgtcagtttcggtttcgggttgtttgtttggatatccgtgattatttcatgattatgacttctagatgaatactatacgtatgtaatactgttgtttgctactaatgagtcaagttggagatagcttggtctcggaatatggtttctttgtttatttcgtgtgtaggtgaatcgatgcctcgggagagtatttgcggtgacggaccgggagtcggcttggggataagacgacgtccgtggtagtcagagatcatgcgggatacttaggctagagttgatgcacgtggttgatggagattccatatggcatacgatggagttattgtgtgcgtatgggatgcggagtcgaatttggaaggagtccaaatttggtacgattggttatgtaaagtttctttcttatactagagggtttcctaaggtgtttaggactcttagtatgagtttggttcgtggctttaggctacctacctcgggtataaatagagggggagcgtgaggcttcccggtattacttttaagagcaattgagttgagcttttgagttagagtttcgagtttagtcgaaatttttgtaaggagtgctgttggtgcactttgtaaacacagagagaatcaataaagtcgtcatctactttaagagttcttcaatttgtgtttcaccgggtttcggcggtctaaccggcgatctaccagcggtcagaccggcggcaagcggcggtcagaccggcggcatacgggcggtcagaccggcggcggcgacaggcgtggcaggcgtctcggcggttcgaccgatcgatctacatcggtcagaccgacgttcatcaagtgattagaccggcgcaataccttcggtcagaccgcaatccatcgacttcgagggtaacttttatttccgctaaaagttttcggtttttggatataccaaccattcaccccctctggttggcttagttcttgtgattcgatcctaaaagtggtatcagagccaggctaggttaacatctctggcccgacggacacgtgtgaaggcctgatggaccgtgagtgcctgcggggcccgtatacctgatggaccgtgggccggtgggggcccagatacggtgaaagggtagtgaagggctgagagacaccaatgtgtgaaaggggagattgttgaatagtcccacattagttgtggaagggcaaaggaactaagatataagtagggaagtcactcaccttaatggctagcttttggggtggaaaaggccctttacgatcctacaattatcattctttactgtactaagaatccgacttgtgtatgggccacggacccacggtgaaaaccacccttattgagaatttgtcaacatgaataagaatctctttccggtcagtcaagttgctacctctccactataagaagtagactgctgatgcctccccttaattacgggcttatcatatcatatccgattagcatatatacgagcaacaagcgattttttcttctaacataaaggaatatcaatacgagcaacaagcgatacgagcggcatgcaggatcacttgttgataccggtgaatcgtcggtgatatgtacgcatcgcactttttaagtgcacataaaaagaacaacagcgagcgtagacagtgaaatccaaagagtaatagatcacaattccgtaaagccgagccttttcctttcagaagatcaattcataccggttacatcccgcataataatgtaataataatagcgtctctattttggataacccaaggactttatcgattaaccaaggagatttttttttggcgtgttaaatcaggaattcaggacgcgtactcttggagaacgatcgaaataaagatagtactttgcaatgagccaaaacgtctctctgctggcgcgcgtgggacgcatggtcaaatgctgcaagaatcgagtcgatcggtcgattcgtccgggctcgatcaataaagcaaacgcatgtacgtacggctaactcaatcatcgccggtataagccatgtgaacttgcttcttacaagggagcagtcaacttcatttcttgcgttagccactactatgaagcatctaataggggatgctctcatatacaccgattcatctaaaattgatacatatgaaacttttcatgcctttcaagcccttacgtaacacctaaatttaaaaccggtactaataatcctacctatgtactgttttttaaatataaatcgacacttatgtttttagtctcggttttgttgattaacccaaaaaacaaactatttgtactggttttatccagaccagccagaaaactggactcatgaaccgagtcgtgtgcctcactaactccaaacccctctttttaatgtaagtccatacttggtccgcttctcatatcgatccagcccaagacttcctcgctctcccttcctctcatattgagctgagtataactcctgagtcctgactctcccattcaaagtgtcggagaaacgggaaccaagatccccattactagtttctcaaaagtcgaaacgtacctgctacctgctcctaagcgtgacccctcatatggattgtgcttgggagcacatccacccctaggtgtggtcctccatgagttgtgctcaagcacattggccctcgggtgcaacaccctaggggttctgctcgcgacatgtccacctctgagtgcggcctctgtgggttagggatgaaactggttcggatagtttctgtccgtccagaccatttttcggattcggatagtttcggtctgaactatctggaaattctcgtattcggaaacgaattcggatttttttctcagaaacaaaaacgaatacagtaagggtactatccatcagaatcggaaaacggtcggaaactatccggaatttttttcggatatccgcagacattgagcaaattttagaaaaaaacacgtatatatacataactttttcatacggaatcagatgaagacacactttatatcaaaattgtagagctcgatgagatctacaactttcttattgactattttattatttgaggtcatttaagggtctaaatattcattataatataccatattaatttttacaaaatctcagatctacaattcaaacgacatctgatggagatgtgttccatatcaaagatgtagagctcaacaggatctaccactttgtagtttataacatttgtattcgaaagaatttaaagtataaaacaaatattacaaattttgaaaatgtgaagtaaaataaataacatctccaatttatacaatggcaagtaagttatgcatctagtaaaaggtcttgagaatagaaaatgataatcatatttgcatatggatctcttagaggaacaaccatgaaaatcgatattcacatgcggttgtgagaccgtctacaaaattgacgatataaatgttagagatgttgaactaaaataataagtgatatctcttccttgatcaagaaacttaatttgaggggctttttatatgccggtaaatattcgctatcgtattcgttccatctcgtattcgctccgtatctgtattcaataatattctatttaatttccgtatccgagttttcgattccgatttcgattccgaaaaaaaatataaaaacgaatatgataaagctagtttccgtccgtttccgatccgttttcatccctactgtgggttatgctccgggcacgttcgcccatgagtgcggcccctcatgcactgtactcggggcacatctgccaccttccccacgtgctcaggatagcaacaatctataccaacctgacgtgcgtccgggacgatggacgacaagatggcgtatgccgaccttgggacaagccatcatcaccctaaaaaggcactgagcatgggggctatcagacgacatggtcgtttgacttgttgccagttccagcccactgtagtacagccccacctagcctctaatgctcaagtaggctcggcaaccaccaaggtgtccacatcacctaccctaagccacacgtcaaaggaaggagcaaaggggtggagagaagccactctatgccttgccaacacgaccgatatgctagttcggagtcgatagtgggcttcgccaactgccgtgcaacaagaccaaacataccaactcctatgggacccatgtgtaaagagttggggactatggtatccccttatagttataaggggaggaccaatgccactagcctccacacaaagagaaatcagcttcagagcctcagaacagaagtacaccaacatcttaaatacatggcaacaaggaatccaaacaagaagataggagtagggtgttacactttcgagtggcttaaatctatctaaaccatagtcttt

SEQ ID NO: 69366 - DNA, 30378 bp, Oryza sativa
  unsure (1)..(30378): unsure at all n locations
tgaatcccaaaaggggggtgccactccttccagctagagaagcacaagcttcgccacgaagcgtcggtgcgtctctccctatgcatcctcacaagagctgcgccatcgccgccaccgaatcgtccagcgaggaggccggggacaccggatctggcgaccccggcctccccgccgatggatccggttggctggtcagaaccttcgttgctattttcttatccaatggggtcgacaacgttatttggtttgtgttcatgttgttgatcccggatctagccaatgtggcgaaggagaaggagatcaccaagttggtggcaattaagggctcaagcgcgacgatggatgaggttgggtgtacggtgggagatggcatgggagacttgggctgctggttgttgtgtcttcctcccttgggtgcagccagatctacgcatggacggacttctcaactcaccatatgttcttttgatatgtgacattttttattcaggatagattaggagattactatgaagttgatccttatttgtgaattggggggattttttattttgtatgttcttgatctgatattggggatcagggaaatgaatgtggattcttgatctaaagttggggatcgggggtagtgttgatgcgaaaaatacacactggcctggaagatctgcttaacttcagtgcaggtccaaaatcttgcctttaggtttgttagcgtgccagttgatttgatcctacaatcaacaagaaataaagacaaaagaaaccgcggttaaatccataaacgaagccgatcggccagtcgccgatgacatgtcatttattttcaagccgatgtcatatgtgaatcgatcggcagttataaataagcaaagtaaaactaaatctactttatcggctatagatattaacgctttataatctttctgtcaatgtatattcaaaccaagtgattgggatagatcggtcatcatgctgagacagtataaatcacttagatcgaaatatacattaacgtgaagattataaacgctcatagcatagctgatcagatagatctagcatgtatcggctagtactccaataccactttatgttaagatattaaaacggatagaatatatcaaacagaagcctaatatactttattgcgataagatcttaatataacaggcagattcagcatatcaattaagcatataaaacataaagctaaatcaggtaatatcggctgaaaccccgatactatctctctcgatgatcataaaacaatccagatatcatagttgtagatattacttaatagatcgaactcaaccgatgcagcattaagcataaagacaaatatgatatctaagcgagatgatgaaaacctacaagagatggtagatacacaatgcaatctagatcaataacaaaacataactctattgattgctttcctacaataagaaccaaccgataacaagttatatagcgcgaccaacatagattacaacgtgtatatgataactcgacgaattacataaacagggttaaagtgtcataaagatggaagcattaaccccgataacgcaagccgccataacaagttttacctctagttgaaaatcgaatcgatgcagctcaacccgaaagtaagaactcgtcgaaataaacgaaagtaaaaaagggtggcgatgcaccgagattgtattgaacgattgtttattgattacatgggttcgggttttatttatacccgagatacaagatatgtccttgccggacacgacactcatctctaacaaactctaagataccataagtctttgcggcaaacttttgcccaaacatatctctaaggaaattacacgaaatatcctaattaataggtacaattgcctaatccaagagctttatccccatcgtggcaatctctatgaaatactttgaacgagtctagaaacagccctgaaaccaccttcattggaatcggctgcatcacctccatcggctgtatcggctatcctctgtccgatccatcccagccgatgcacacttcagccaatgccttcacagccaatgcatactctgttctttgaatcgatctctttatcgaatccgcctcgatctcaatgtcaaacccggttcacatcttaccaaatttagtcgtcaacaggtagatgagggttcgggctgctcggagcatgggcttgatgagctggcttctttttcttttgagccaaggaggcccataagtgtcggttctaccgatgattctcctcataagattgccaaagatgtgcatacatttagtgttttttttgccaaactttgataaatacataagaaatcatgttaaaattttggtaatattgtcaacttatcaaaattttggcattgccaaaatttagtaagatttattttgtcttcaatctaaacaaccccttactaaccggcactgattagagttttgtaatttccattgtaaataggattacagtatcgtactactccctctgtcccctaatacaagggattttaatattttacttacactgtttaaccactcgttttattcaaaaaatttatgcaaatataaaaaatgaaaatttgtgcttaaagtatcttggataataaagtaagccacaaataaaataaataataattttaaaaattttttaaataagacgaatggtcaaacagtaccaataaaatatcaaaatcctttatattagggggacggagggagtgttagtttgttagctacatacacgtccctgctgtccaaccttgtgacctcacttgtgcaaacacatcagcaaattaaagctaggccaagcaaaaatagtactccctctctactcgtaaaggaagtcgttttgtacagcgacacggtctccaaaacacaactttgatttttttatttctctaaaaatatttattgaaaagtgacatatgtatacttttatgaaagtatttttcaagacaaatctattcatatattttttacattttcaaactcaacaaattaagagttatttatgatttatattctcaagatttgacttaaatattgttctaagcgacttccttcgcgagtacggagggagtaatcctataagaggagctaaaatatatgacactgaccttgatttccggttacttttttttgtatgattggcctaaaactaattggttaattactcagttgactccaatcaaaattggataactagaggataaaaaaaatgaaacacgtccaatgagtgctactcatgtctagattaatcctgatctgtcgttgactatagttgtccgacccatgcaggcgtgtcctgcgcatggtagctgatgaggcctgaggaaacatagcggcattttttacctatatctttttcactttttttttatgcaggtcaccttcactaacgggaaatgtcaacttataacatggcagtcaagctcacacacctatccagttttggcattctagttgcccgaatagccgttggtatgattgtcagccacaagtgtactgtacgtacacctcagggtacagtcgtactgcaagatgattaacgggagtaattaatactatacactgtcaacttgctacatgttgcaaaggagccttgtacataaatatatggcgttgaatttcagaggcctttcgttaaccaccacataatttctttaatcacaatggtgaggtacacgcatacgtacgcagggcatggccaacaacagggggcacatgagctacgccggctcaagtccccgtctctggccgttagaactgtgaaccgcccaaaggatttagtggcacatttcgaactttttacggtgtttataattcttgtgtaactttctatttgtgatgctgtattaaatttaatttgctagattaatctacatatataccaccatcattcgttgtgtgcacgtaaaatgtgatccgttttcagacaaacgcattactgtctactttccgctggcaacgtacgtcctgcgttgcgtattccatattttttttttcactccactcggtcctcttttgttcatgtacgatttggtttgtattaaacaccacatatgtgtttggacgcttgtctaaaattgatttcgtccaataatggagccaccatctccatttgcgataattttagtggattcgctcgattcaaccgggtcgttatcaaaaggcagccaacccgaagcgaaggcccgatccaagcaacggatgcatcatgttagcatctgggtggtagttgtgctgcggcccacacgcaccgctgcgttgcgttgcgttcgttgcgtgctcgccccctggctttcattcatcctctgccccgcatttgtcaaaccttctatcaacgatcgtatacaccgagtcgtcgatagaccgacccaccacccataccacatccgcgtctcgttgcctcctcggtgtaggagcgcacactcgcgtaacgcgcgcgcggagggggattctcttattatctcatcagtcgatcagccacgtcgtagtcgaccaaccgatcgatatcagagactggccgcgacggtcgatctgatcctgacgggaggaaaagatttttgcgagagggtgtcgccgtttctgcgcggagaccagagcgagcgaggcgtacgtggacgtgcaacagcgcctccgcgtctcgatcgagagagcagttgattgtcacgagggggcttgtcgatgcgcgctcgttggtcttcgctgattcggtccgcgcgcgcccttcctcctcgcgcggtcgttttccggcgagcgacctgcggggacggggacgcgctgggctggccatgcggcggctagacttttttggctgtgccgctggcggggggctcaatcattgtattgctacccccgtttcgcccggaccgacgtgatgccgcacgggttctcgtgtcgactctggcggcgcaatcaggggcctgcagccatgttggcgctgccgatgtctggacggtttgcgacttgcgaggggtgcatgggtggagtaataggggtcacaaagaaatggttggaatcgtggaatgttattatctctacgaaatggtactagctagtaccgttttcgtactaaccccgtataatatcacacatgccaaacatagttttaactaggtttcatacatcatatgaacactggtcgcgttgtggcaatattgtcctgtgcaatttataccatagctcgaattgttacgcctacaacttcggcgagtttccacttgggcacaaatgattggcacccctcgagctatgaaccaaacttgagctgattaagttcggttgtataggttccatgaactagggacgatgccaacgtatctgttatcgtcaatctggccagccgctacttgacgagatggccagagcggttacagggaatatgacaccgtttctattccatggaggtagctagccccctccatacattattagccgatgaccggataggccaaagtagcccataccaataagtaggcatggacagaggcagaccatacttctatatatccgtaatcgcgtagggcgagccctagctagcggcatcatcagatcaaagagcacccgttgccttccacccttgcatatacctgcctcgagacaacgcgctgacgcggtgtgacggcgaaggattcgccctcacttcaggacgtttcagctgggcctgggccaccaaccgaggtttgcttttagtcctccatttccacgatggcgtgcgtccacgagaacgcgagatgtggacttctccagggcctcggcctacgagagacaaggttgatgtggagaactgaacggcccagaaaagccacatgtttccgcaggaggaataagatcatctgaggtccctcaacttgtcaaagaatccgatttacgtccctggaccaaaaaaccagacataacaggcccctcaactatcaaaatcggtgcagattaggtccctcagcggttttgatggcggttttagctgacgtggtgcctacgtggctcacttgacccagtcttcatctgacgtggcatgacgtggcgcttacgtggcaattcaatctggaaaaataataaaacccgtgagacccacatgtcagtctcacacagaaaataataaaaaatggtgggacccacgtgggtcccacatgtcagtctcacagaaaataataaaaaatggtgggacccacgtgggccccacatgtcagtccaactcaaccccctcttcttccttctctctccccatctcccctatcttcatctctctctcctctctccacgcgacgagaaaattgcatatctaccattgcataagattggcttcgcagaaataccatcacttaaatcggcttcgctagaataccactcctaactagaacggcttcgccaaaatgccattttggacaaaaatgaccctggttcttctcccttcctccaatgccggaggagctcgtcggcagccaccggtgccaccttgccggcgacgatgggggcgctgccatcctcgtcgtccctaccttttcatcctgcccgccgcgctaggaggaggccgtagccgatgccatcaacgttgatggggccgaactcatcggcgacgaaagcggagcggatgaactcaccggcgatgagggtaacgcgttgaggtgcggcggaagaactcgttgaggatggggcggtgcgtcgaggcagcagatgaactcgccggcaatggggatgattcgtcgaactcgtcggcgacggaggcggcgcgtcgtggagactgaaggcgttgggggccgcgcagctaggtgaggcggacgaactcgtcggagaagaccaccgtcgacctttcctcatctcacccgtcactactgcactgcgcaccattgccgtttgctcgtgccggaggtggaagagacggatgcagggtcatttttgtccaaaatggcattttggcgaagccgttctagttgggagtggtattctagcgaagccaatttaagtgatggtatttctacgaagccaatcttatgcgatggtagatatgcaattttctcccaggcgacggagagacagcggcacgcggcggccggcggaagaggagggagcggcgcgcagcggtggaggcacggctccggcggttgtgggcggaagaggaatcggtggcgggaggtggcccttgttgcggcggctcaagtgggacagcagaggaggagcggcggcggtcgagctcggtgacgttgtggtcgtcgcgtagcttccccccgctggcactgccgcgcaccgctccctcacatgtcatcctcactgctcccctcctctctttgtctatccttttcttttctttttcattctttttcttcttttgctttagaagatggcatccggcggccgccgcagtgacatcgtcgccgtcccgaccgctgtggaccaccgcagatcaaatcctcgcgccaacaacctctcctcatcagtgcaatcaatagccctcaagaaccgagaagaatggagcgccgaagagggagatcgaccccatcttcttcaactccggccgccggcatcaattttcgattcccgctgcttcggtgagcctcgcgttgattccttgcacctgtaccactctagagacctcactaacatcaggaaaatacatgcaaattagttagattggtggatcgagccgtcgtcgtcttccaggagctccgtgccgccgccaaaccattttctccatccggcgggtgggagggagaggagcggcggtgcgcgccgcaccggcggagagggcggcagatgggagcgccgcgagggaggaagcgagctcgtcgcggcagccggcgggagaggaggcagcgcgcgccggccaacgggagggagggagaggagcggtggtgcgcgagcgtcggcggtcggcgggagggcgggagaggagcagcggcgcacggggactagcgggggggagcggcgcgcggcggcccctaagtgggggggagaggagcggccgccgtcgcttggagaggggagaggagagagagatgaagaggggagatgaggagaggaggaagaaggggggtgagttggactgacatgtggggcccacgtgggtcccaccattttttattattttctgtgtgagactgacatgtggggcccacggggtttattatttttccggatcgaattgccacgtaagcgccacgtcaatgacacgtcagatgaagaccgagtcaagtgagccacgtaggcgccacgttagccaaaaccaccctcaaaaccgccgagggacctaatctgcaccggtttcaccggttttgatagttgagggatatgttgtgtccggttttctagtctaggacgtaaatcggattctttgacaagttaagggacctcatatgaacttattcctccgcaggaagggcccgtggtcagttattccggcccactagtgatcctctcaattttaccgactaaaccaatatatagtcggcaactactctccaccaggataaattcagagaacggcggaagagaccgtaaattggctgctcgtcgaatttgcaatcttggagggcgccgcggtgctgtgctcccggcggaattgggaatttgagatggagcagcagttcatcctccgtgtgccccctccgtggcggagcggatcgaacgcctcatgaaccaagccgccggcgcgtcatcctccaaccccgacgacgcctccctcgatctctccttctcaggtgattctttctgtcagtagaatttagcttccgcatgcgcgtaggcctgtcgtataacagctgcgcgtcaaaagctatggttttgttgggaattcgctagcgaggtaccgtgaccctacgctgttcggcgaaatgcgcataccgtttatgctgtgcgagtgcaagtggaaaacctccgttctgtgcttgtggaagtgcgggtacaccagggaacgcttccgatgggttgttcctcacttgagtggacatatgctggtgtgttgtcatataggtgttaggtcataagtccgcagtatagcgtgttggtagattttttttattggtactgtattttcaacgcagcaagaattatctttcctgtacacatatattaaagggcaatgctttgcaagcttgtggtttctgatgcgggttaccagttgcggggatctgatctctgtgctctttactctttacctgcagagatctgagaatgatgacatattgagtaatccatttagcagcagatgccatatttaaataatacattatgaagggaatgcagataatagcacactttacgattttggaaatcttgtttccttgtatcattctcttaacgtttcctttttccacaaatgtaatatttgctacggttactttctaagacgtccaattgcctaatcactattagcaatataaaaaatgactaaagtccagtaattatactttgaagaatttgtatcttctcatggtgtaatgcaatgttcttactcgacaggttctactctttagattctggaaatgtggtttgtgctaatattttctaaagcattctatttgtgcatgtctagtttctctactcacttctaattttggttcaaaacaatggtctatttctgtttgatggatacaacttgtattgtaatactctagtactgttatcactgaaattttcagttaatcttttttgacttgtggattggtgttcttttttcgtgctacagaggatggaagaagtggcacatttatgattggaaatgaaagctttccagcatctctcttagatctcccaactgttatggagtcatacaagacatacaatgattcagtgctaattaaaacagctgatattggtcaggtaaaaggataagatttgtttaagatctgttttatcaattgtaggcttttaagaatcttacattgagtttgtaacagatgattatggtaagagaagaagatgatcctgctccagaaggaattgaatacacacatggtcttactcctccaatgagggatgcacgaaggcggcgtttccggagagagcctgacttaaatgtattcaatgccttccctttagctcctcatggaagcactttgtcaatcataactgttattgttccattcactcatgtttacaggcagaactggttcaccgagttgaaaagcatctcatgaatattatgcatggagtatctgtcagtatccttttggttttgatggttttatcaaattatagcatatgttaccttaattacagttgagtaaaaatttaattgtttttatttatatatctttagttgacaggttttttgtcgtttagtttgtaattggctcatgaacaaccattgcttgaagttactgctttttaatcagaagttaataaactatatataataatgagttccttatcttgatgacaatggtaataccatgaactttttgagcatggtgccgagcctaaacttcaacatctcgtattgttggaacttggaaggcaagcatcattttcttggtaggctgttatgttgaaataacaatacctgctactagttatctgactgcttctggttcactaattgactggttcttgttgagccattccatgccatgtttacgtatgaaaataatttttgctatatgtattcctatcactgtatgtgcaagattccttgactcagttgatagaccagaatgctagcgtaattggagcgggagaaggtggcaagaaagctgcacctgctccagcaaccaagcgtaatgttcaacgacccgctgcaaacggtgaagaagctgaggcagagaggagtgactctgatgagtctgttgacccatgaattcaagtggagtagagtaaataatcctgctccaattgcccgagcacacccaattgacttagcagttcagaagtctatatcagaaaatgaatatccggaccaactagggcatgctcactgttaaggttttgcaatattcgtgtaaaatttaatgcgatacatgagatttaagatgaaacgatatcaatgctcgtggatgaaagaatagctagggcagtcagacattttctttactctttgtagccatgaatggtgatggccatagcacaatagtgacgcagattctgtatcagattgtttctaagtttttggaacgagttaattcgtccgaagtaaacaaaaatagttgattgcagctccatcctgtttagcagaggtagcaggttggagaatgctgtagaaatgaaagtcgtagacctcagatctgatgtggtcaatatcctacaaatctactatagctcatcgctgattggtcctttgcaccgaactggtcaccatatagacttgtttctggcacctaagtcaggtttatatgaaagacaactaaatacaaagacgaataggtatatgaacattaaattgttcggcatgtattaatcatcattttatactaggatgtttgtaaaattagacggttaacgagagcatgcgtacgtaggaatgaactcagtaagatcacaactcacaaccaacgcaaatccttgcaccatttcatatactcctatgcgtcagaacaactaatattacaacaaggcttgtctgcttatatctctcgcaccatttatatgatatggagccccttgtttgtgttggcatgcacttgtctcctctaataaaatagggttataatcatttttatttaatttaatatggtttgtttagcccataaaaatattttcagcatgcgggtaatcaaacatgataaattttaactcataatataataaaattgatattagtagattttttataaataccttttattttatttcaataaatatattattgaaagaagtactccatccatatacttttgatagacatattttcaaatttgaaaaatttacttttgataggcatatttcaatccaaccacctatcctcttaatgactttcttgaatttaatgtgtgactatatattcttccacacaatattggctacatgggcatcgaaaaatgtaaatattaatgaatcgtttgtttacgaggaataactagtagcatatttaaatggttacttatcatcggtcaattgtgccaagatgaaatataactatcaaaagtagatgaagtgagtaacattcaattatgggcatcgatgtgtgtgtggtactgtggggtgtgtgtatggatgatgtaatgtgtcccataattatgagattttagattgttttggaaaataaggagaaagaaaaaaaagacaatgatgtctcattaaatgaggtatagttaggggtgagaaagtagttgggtgtaatatgaaaaaaatgaatgatgaatgaatgatgtgataataatattctagaatctttttattgtgtgataagtaacattctagaatcttttcattatacaatgaaacacttttccctctcccagccttagtgtaacagttgcaacttttggtcccacgtaaaaatgggagcccttatccaaagctcaaactcattacatacgtcttggcatgtcatctcgtaagcctcatggtacagcctagagtaatttttttagtcgattttatatggtaattgtacttagatgtttaacattaaatttctcatgtgaccgggcctggcttggattaagcaagttttatccatgcaaggtcaagtatggatatgagcttcagggcgctcttggattgcagcgtgtgcgcgctcgacgttatttaccctgtgtcgtacacgttgactgtacgaagatcgtaggcaaaatgtcgtatatacgtagcatttttcatactattggaaagattatcggcgacaaaagtagaatttatgtgacaggaacgtgactaaaaaatggaaagatcgaatgagttagagctagctgttctgctaaaaattttgtagcacgcaaagcgagataagtcactaatatatgattagtcacttttgggattccctgactcccgtgccactcactctaggcgacacgggaggcgaaaaggccgtgtgcgcgggggcttcccggccgcgtccgctcgcgtcgccgctgccgacggcggttcctctctccttcttcttcctttctcttctctccctccctcattttctccggatctggggtttccggcggtgacggctgctcctccccactcggcaccagcggcctccttgtcccgggacgacggcgagggcagcacggggacagctggatatggccggtggtcctctcctccggccagatctggggtgtctctagtcacctccggcttcggtggcctgcctccctgcatccggtgttgtggcagcgttatggcatcggccggtggtggtggtgtgagggggatggccggacctggctcctctaggtccagacccgacgcgtcctcagtcggggtcgggtgaggtcgggcccccgatggtggcggcgagacgacggagtttgggcggcctgtgtggctgttaggtggagccggactgttggcgccgtcagtccggctccgcctctcgttggagtcaggccattgtgcaggtgatgtgaatagccaggtgacatttggtggcttccgctatggttgctatggttgaatgggactccgaggtaaaagctttgctctgcttgccagtgctagcaacagcgatgccctcgaacgtcgttcaccttcttataggtgttgctattggagcttcaactctattttaagggaattctccgggtgaaaaccttagattcgtttggatcggacggtgtcaccgttctgtcgatgtaaccttcttgaatgcttcgttttaggagtttttttcccttgttggactgctgttcttgggttcattatgtcaatgtgagggttttcgctggttatttataaattgaccgtgccgacgtaaggtttttgatccgattttccttataaaccgtgaattgtaggagctccttacttgttccctcaaaaaataatatatgattagtcaaatattaattattataaacttgaactatatatatatattgattttctaagagatttttttggcacaaaacaccccgtttaattgtttgaaaagtgtgctaaaggaaaacgagaaagatattctaagaaaccgacacttaattagttaatgcaaagtttcattgaatatagtagaaaaaattataagactataacctgatagattaaagttaggaaaagaaaaaaataacaccaccatcacgcaccgatgccgctatcccacacaactgaaggaaggtactagttcctgaaaaaaattagaagtttgaaaaaaagttgaaaatttatgtgtgtaggaaagttttggatgtgatacgatgtgatgtgatgaaaagttaaaatttggtggtagttgagggtgaactaaacacggccgtagtctagtaccgatctgatcgccgcgatgcggaaagatgtcaactctagttgatatttgcatcattgcatgctcattcgaactggtcctatataactcacttcatgccagcgcgctcagtctacaacgacacctgcttctttgtatgttaaatcatctacttttccaacaactgctcatttgacttcaaaatcggcatctataggccacaacttgtccctcttgctagatcacatcattctgtttggagatggcgatatctagaaggccaataagtacctctcgtgctcctgtcctctttttcagactctactgtttttcgttcgtttccaatagcttaagctttgctgcatttgcttttgcctgtggtgcgtagacattatgccagacgtagaggccggctcagttgttgatcctcctcaagcacgaagctgctgctgctgtgcctgtctgcgaggcaacacagggaagttccttctgcgcacggcaactgtggttatcctgttcctcgcggtccgttttggctttgctcgtcatagcgtcggggcaaagttagctgttgaatcagtggcctacgtcgccactgcttgcttatacttctgctccttctcaagctggaaggagaagacggtttccggaacattccttgctgtagttactgtagtggtcgtgagtgtggaagcaaccactggaaatgaccatggcgtcgccattttgatcggcacgatcgtggctctcgtggtgtactgcatctggaagccttatcaagcacttctctcctgcatcgagcgtcgcctccgccgcaaggcggcggcggcggctactgcggcggaaccactaccaccggagaagaaagaagatgcggggcgtccccttgtgcaggcggagcggctgcgcgccgcgtttcgcatcgacgggctgctccgggagtactcgcacggcgagatccaggccatgaccgacaacttcggctgcgtggtgggccgaggcggctccgccaccgtcttcaggggcgtcctcgacgacggcacggcggtcgccgtcaagcggatcgtctgtgatgagtccgtcggcgaggccgacttcctgagcgagatcaccatcgtcgccagcgtgcaccactacgcgctggtaggcttgctcggatactgcctccagcccggcggcggccggtacctgctgtacccattctacgagaaccggtcgctcgactactggctcttctccggcgaggagcggaggcgccacgtcgccgtcgacgtcgcgaaggggctcgcgtacctgcaccacgagtgcaagaaccagatccttcacctggacatcaagccggcgaacatactcctcgacggcgacttccgggcgcacgtctccgacttcggcatctccatgtccatcgggagggacctgaccagcgtcgacacgcgctggaggggcaccctcggttacatggcgccggagatgctggtcaacgcgctgtccgccaagtccgacgtgtacagctacggcatgatgctgttcgagctcgtcggcggacgccggaacttcgagctcgcgggcagcgggggcgcctcgcaggcgcgggcgccgccggatttcaccaaggaattcctcccgtgcgtcatgcgggacaggatggaggaaggccggctcatggaggtggtggacgccaccatggcgcgcggcgacggcggcggcgcggctggcgtcgacgaggaggaggtggaggtcgtcgtgaaggtggcgttgtggtgcacgcagcatagccgggacatgaggcccggcatgacggacgtcgtggacatgctcgaagggcgcgcccccatcccgccgccgcctgttcgtcctgaatttctcggagacaccttcctcgtcagctgcgcgcggacagctatgagccggtgatatatgcatgagtggtttgtggtatgcgactatattgctatttgtagcacgaatgatcgctgagtacttttacacacttatgttatcaatattttcacgataggactgtctaatgatcattcgaatgttttttttttaccccatatcagtcaaaatatgaacggtttgatggctgccatctggcgtgagacactagatgaaaaaccgaatgatttcttgactcaatcttatagtaaaaaaggtaaaaaaaaaagtaaagtacaatgtcgatccttaaagctagaatgaggtgtcacttagcttcactatcttgtaaatcagacatttaggtttatgatcttgttttaataaatcatcacgagtttaaaacatgtctgactgtgttgaccattgaccgttgacgtagtcgtctagtgtggcagcaactttgtagttagcctcatccacacccagttgacccacttctcaaaatatttcctctatccatagcaatagctcccactccccctccccctccgctcggcactattgtgatgactccaagggcgatgtcagcgatcatgggcactctgtggtggacggagatgcgatttgggtagcacgtttggtcggcagtcgataggttgatgatggcggtgcaatcggtggtgtcgaggcgggagatgaacctaaccttgtgggaggacgagtgaagaaaatacgacccgattagcatacatcattgcaatgagctcactgtgttattcttgcggcagtaagggcacaatcaacgagagatcgggcctttttctcttggcacttgtagaagacatgctgcttcaagtagccatggcctctcctaccggcacactttaggaatacccctagccgcctcccttgttagcaccgtcctacccgcctccttcatcgttgccaccctaaccgggtctccgctaccatccttgtcaccgctaccgcaaccataaattgaaacaatgaagaagagatgatatttgaggaagaagcggatcgactaggtacggagggggccaagtgcaaagttatggccacactggacaaccatgtatgcatatcagcccagtcggatgggctttgaacccatgatgattcattaaaacaagattgtggatttaaataactccttgcccaattttaaagatcggcggtgtactttactttaaaaaaactaacacctagattagtaatattattgcttcattttctccctgtgggaaaactattttatacttttgagggacatcatttcgttgtttacatgtcatctaaatagttgagaaaaaaattaaaaaaatcaataagataaattaatatatgataaaccacttcacaaacatacaagatcaaattttacttctataagttacaacgaaaaaaattataactgtgaatatgcgttaactagacatagtttaatttatttttttcgttgcaactttagaagttaaattttaacttgcatgtttgttgattgatttatcacatattaatctaattttgttgatttttttttcataattatttgagtgacacacaaacagcgagataagagttatattatgtatcctatattatgtgtgcatacaacactgagaaagaattactcataataacatagacatttcagacatatattatgtatcatataatagttttcagttttacactacataagagtttgcactgcatatttttgcatattttccccttctagttcaccaaacgtttcagtatcagaaaaccctgatcccaacatacaacccccgcttgttccaacttacaaacacaacggtatgacatctgacaaaatgcaaagttgacatatctaggatatgataactacggtgttatggactcatggtctcacgaagtcctgttgaagccaacagcattctgaaacaaagatatatcagcagttcacagagcaggaacctcgacaaaaaagggacactgaggtagaatcttgcaggaccttctgaaatttgattatccaccactcatggctcctacagttcagaaaaaaagatagcataaagatcaaacatagaacagaaaatcgaaggaagaatagactcatctatgacgatgctaaaaaatgtacaatatgattcttagtgtcatagcagctatctgtataatgtgtgacgtcaagatttgcatatattcatctacatctgcaccataagaccataaacacgtctttactggatatatatgttattactgtcaactgttaagcatctgagctgggaagtataaacacgggtattaaaagcagccagacttcactaactacatgtgtgaatacacacatggtgaagtatggttgtcttgtctttttgtgcatagaccaattctatggtatcaagtgaaaattttacacttagaaatgctgaaattgtttacccttgtctatatataatagaaagaaacctcataacaacgtatagctgataaatcataacaacttatcattgtttagttagttggcaaatggtgtcctattaaatactcctaacatgaatagataaaaaattgattacttcagtgcaatagttcaagtgataggtgtcagaataaactgttttcataaaaaagatagcccgaagccccacaccaaaatcaaataaaataataagtgaggaatgccatgcataacaagaagctcacaaggcattcagtttgcagtcatatggacaagcgcattactgaatgttctctgtcagatcagtacaggaccatagtgaacctaactatatgtcgagcagaacaaagccacacattgaaaggtgaggaagggggagtgattttgaaaatgtaatgatataagtaggttaaataactcatttgattaatacagccctttgttcgagtgctagaaatcttacggtctgacaaattaattgactgatcaatcaagagaatagaatgtactccatccgtcccaaaatataagggattttgattggatgggacatatcctaataatacaagtctggacaagacatcctaatactacgagtctggacaggctatgtcccacccaatcaaaatcgcttatattttaggacggaggtagtataagactacaatcgttttgattgggcaagattatagttgcgtagatgcactataatcattttgattgggcaagaatatagtggtgtagatacaatacaagtactatagtgctacagtgtataacaaagacaactataaagaaattcaaatgtacccgtgcaatggaaatggcacttccattagttaaattgaaggcacttactatcttgaatggggaatgcacacaacatcagatcttattcatagacatatatagtgatatgtattcccaaaaaaaggtagattaacaatgcaatgaaagaggagcgtcttaatgacaaaatgactctcctgactcagtgttctgtatgatatgtctgcctgaattcatgacaactatttattggtccactatccacatgcagtttttttacacaacactagctaaatactcgtgctttctatggattaaaatatattatatgtgtgctaatattgcttggaacagattagtttgatggtttggggagaattttgtccctatatgtgtctttgtataataaacatgtgctgtagaaatgaaataagatagagttagaaggactatttttaatattaaagcatatgaaagaagagtaggtaaaaacatggagtatttggtaaaatagtactctacacaatagagttggtggggtgacagattcactaccaccatcattgccttctttcgaaaggagtaaagataagtgaacaaaaatgtcaaaaacagataccagagaccagcacagttcaagataacagcaaacagtgaatcaaactagtacttggagcctggtattttactgaacgacagaagttcaactcatattgttggaaacataaaatggagaggaactaaagtacacagagatatacaactggatccgaaaataatctgatgatatactgaatactcagttcaacacattattttgtgttcctcttatgacgattgagcactttttgagcttgctcgaactaagtatgtacaggtggaatgccacgttacataatggggccaggcttagggcccataaataaaattttccgatccgttcaaatagttgatctgcatgttcaatttgtgatatttcttttattttttttatttgagctagagggaggaaacccctctcctttccattagaagaaatgcataacaatgtttctaccacaccacaccacattcagtaatgcgcaatacctaacgccatcccatcaggggaatcagtgttgccagaaggaaaggtttaatcaccattgaccagaacaaaaagcctcaaaagtttctaccagcaacagagcaacatagtcactagcacaattagcagtgcacgcaagccattttcatacaccatcctttttctgagcattgccaggtgcaaaaataaccaagcaggaaaatgttgccatcaacttatccccatcatcctaggagcccaactgtgaatagactgatagtccatccactgaaatttgcattgtgctcctgatcagtgatcaccaacgcaccctacaaataacatttcaacacaaaacgcccctttccacagtcactatcctcctttgtgcaaatcggacacaccgaaattacgtcgcgggcacagcctacatcccacccgaacttggcaatatccatcattgctattaacattcgaaaaggactgcctttttgcaaagaaaatgcaaagattttgctacgctataaacagacgcgatgagtacagattccagggggttcactgaaatgctaaagagcaggattaagagcaaaagcacactgccagatgttacctgcttcaccttaaccacgccggcgagggcggccccgtgctccgcgaccatccggtcgagctcgtccagcgtcgcggagtccgccctgtccaggtccacctccatcatcccgttcacctcccgcaggcacccgtcccgcttcttcatgatctcggccaccgtcacctgtgcacccaccggcagccgcgggagcaaaccactgagcctccgcttgcgctcggcgtcgggcgggcgcggtggcgccgcgagaacggagggccacccggcctcgaagatttcggagagctcggcggcgctctcgtacacggggtcgcccgcgctgttgtaggacatggcgttgttgaaggtgagccggacgtcggcggcgaacgcccacgggtccgcgtagcggcggcgctcgaggcggcggcggacggtgccgaggtccatggggtcggagatgcgcaggtagtagtcgacgaggcggagggcgcgcgcgtccaccggctcggcgaagacccacccgtcctcgtgctccaggagcttgtccaggagcttgccgcagcgcaggagcgcgtcgccaagatcggcgggaactccagcgacgccaggagacgccgcggccaccgctggaggctgcagctccggcagatggtgtttccgctccgtggggaagccaggcggcgccggcggcggcaagggcgaccggcggcgctttgggcgaggcatagtagggctggaggtggctggagaacgaggagtgtgtggggctttggggcttttgggattcaatcgtggatcaatttcacgcggccaacgagaaattggacattctgcccctatcaaaagagggtttcgctataatgccatttcgcccattagattcgttaaaatgccatccccaagctatgccaagcattttttttttgccatattcaccatattcactccatttccaccaatttttgccctcggactgaccaaaatacccctttaggactgctgcttcttctagctcagctcactctattttcaagccgaggaaaggggatccagccgcctccggtgggaaatttaacttgttgccttattaaatcctatgatgatgatgatgaacatacatgcaacaacaagaacgaacctccgctcaaaaagaaagataaaagaatgaacttgtccatgaagaatatatacacaaccagatcacaactcatgtacgcgtgtgtagaaagaaacattgaagatgtgctcagcacgatggcggatgcgacggcggaccgggatgcgactggcccgtcccggtgtacacgccggaggagagcagcatcacgaaggcggacgcggtctccgccacgcggcgcctcccgcgcgacgagatgaatgccatccgctcccggtgcatgcgcgtcaggtcggccggagcagctcgaaccgcgccgacttgccgctcgcgccggccgaggccacggcgaccaacaacactgccgccgccaccaccaccaccccaaccagcaccaccatgcggcggcggctcgccattcccgacccaccgctcgcggctagctagcaagctagcctgcctcgctccccgccaaaaaacgcgcgatatagtccactgggactgggagatcaacatggcaacgggcgtcgcggcgacggcggcgccaatgtgctagaagaagggctgagctggaagaagcaacccaaaggggtattttggtcagcccgggtacaaaaattggtgaaaatagagtaaaatggtgaatatggcaaaagaaatgtttggcatcacttggaggtggcattttaatgaatccaattggcggaatggcactatagcgaaaccctcttttgacagtggcaaaatgtccaatttctcgtggcgaacggtgccagggcccagctgtgaaaagtgtgaaactatacaccaaaagttacctaaaattctagtattttctaaatctcgttttaaaatatttaatagaattgaatttaatgatgataagatatacttcgatataagaagcacctccaaactcccgttttaaaattataaatctaattacactaatttggagtattaaatataaactaattataaacctaattacacggatataggttaatttgtgagacgaatcaatatggacgatgttagaaagtcttataacctgaaacggagatagtagaattgtatttaatgatgatgagatatacttcgatataagaaccacctccaaactcaacataggtcgtctatctcctttccccttgtggatataacgtatccttcccttcctgcaatctagtcacgtggatacggcagcatgctctgcttcaccgctcaattcatcggtgatagtgggatcggatgctactacgtcatcaagcagtttcttaagcatttttctatcaaggttggaagttatctaaaatatatatttggaagtttttttttaagattttgaggttttacagtttttttaagtcgtttatggatatttctcaaattagattcagatctagtaagattgtttgactctatgtctttacaacctgatattttacgatataacaacggtgaaaactgagttgggaaaaaaaatctaacccacaatcagttttatttgtttcgatgtacccaaacactaaatcattcacatgtgccccgattatcaccacttaataaaaagaaaaaggaagttgctagaaaaaagtggcgacatatcactaggaaaaaaacatgtcgatttttggaccatccaatagccttaagattcgtgctacacgaagaaaaaaaaacaaaaggaagctgctaaaaaagtgatgacatgttattagggaaaaacatgtcgattcttggatcatccagtagcctcaagattcgtcgatttttggaccatccaatagcctcaagattcgtgctatacgaaggaaaacaaaaaaacaaaaagcccgtgccacacactttaggcttcgacttggcacagagggatcgggctcctccgcttgtcatcccggaaccagagcgccttgcagcggagatagccgaagcccttgatctccccttccacgctgaactcggccgcccccacgatctgccgctcgctccggatcaggccgcgcagctcctcgcgcaccgacgtcgcctccgcgctggccacgccgtcggcccgctcgccgcccgcccgcttcccgtggacgcagaaccgcggcacgcggcccatggcgacggccatgccgtggtacgacacctcaagcacggagccgccccctccgacgcacgcgtggtagttctcggcgaggccgaccacgcccatctcgaggcggaacgccgggggcgccggtggtgtcgtcgagcccgtcggcgcgggcgaggacgaggaacggggtcggggcgggcgggcggatgatgtactccaggaggagcaccagtgagacgctgaacagcactatgcaggcgacggcgagcatggtcatgggactacatgggttttcttgtggagggattttgccattgccgtcgtccggtctgcgcacttcttcgccgatcgatgtcgatctgcacttcgtcgccaccggtgccgccgcacgccgtgcactttcgctcgctcgcggcacccatctagtagcagcgtcgcttcggtaccgtggaaggtaggtttgtctagacatcgctagtcctttaatttgttcttttaggcccctttcaatgaaaggatttatttagaaattttataggattcaaatcctatagaaaattttcctatttggccctttgattcaaagaattgaagctttctaaatcctatgaaattcctatggaatggcacattgcatgtggattttggaggaaatttagcaagagctccaacctcttgaaaaatttcctttgagtctatctctctcatccgattcctgcgtttttcctgcgctccaatcaaacgaccattcctgtgtttttcctatgttttgcaatcctctgttttacatttcaattcctgtcagaatcctgtgtttttcctattcctccgttttttctaccctgcgattcaaaggggcccttagtatttatactagcttggttcggatacatgtatcacactccctccgtttttttaatagaagacgctgttgacttttcctcacatgtttaaccattcgttttattcaaaaattttatgcaaatgtataagatataaatcacacttaaagtactatgagtgataaaacaactcgtaacaaaataaattataattgcgtatttttttaataagacgaatggtcaaacatgtgagaaaaaaataacagcgtcatctattaaaaaacggaggtagtattttgattcggggcaccgtatagctgtatgactgtatcttgggttcgagatttttgagagaattccttatatgccactgaaaatttattggttttctgatatatcacttaaaattggttgttctcttactgagaaaatgtcagtgtgttataatgggaggaactatttagccttttaagatgataatatgttttttcttggtaaaattggatgatctttaagttatacactttgttcctagtttacaatttttatttgtccaatatatataaataaatattcagcaactataaatattgagattttttgtcgttctggatatatatatatcacgatgatgctctatatatataagcatgtcgagcaacttccagcaatcctagtcataataaaaattatatttttgtgcaagcatagattggtaaataataaaggtaattaatttacttaatcctttggattagataaacgtatgcagcctctcgttaccttgttgttgctgctactgcttgatggtttgcgattagcagatgatttgaattctggacaggcatataggagagagacatcaaagcgagctttgcctgctcgcgtcgcggctaatcgaagagcagccataatcaatgtttgcatgtaatttatcgatatgtgtccacgacatgctttgcctttctttctctcctcgccggctcgtgcgtatatacaccaatcagggatcggcatcttgttccttccttgtacgagacaatggggcgattgtgtgtgagaatcgtgcgcgtggatcgaataggaaacagaaaacgattcaggccacgccctaacgcaatcgttcgcaagacagataaaacacatggacgcatggatcagaatcgatatgtggcctgttcgctgctttgtaccgccgctgcgctgccacagccaaaagaaacaaaatactgtgtttgttggctacatcacagtaaaaataagagcagtcaaacatagccaagttatatgtatgagcgacatacaaaaattcatgacaaaaacatcttcaatttttataatagtagataagagatatgctgttagatcaaatttacacactgttttatgccattaccatcactctgactaacagtagtctttgatcaaactgttatcttttttataaatgacccaaataaccttagtactaactaaaagtatcaatgaaattagtatccctacatggtgaggacgagcgtggatatatatatggacgtagtaaaacaaaaaccaccactagtaatataccgaatactagaaaaaaaaagaaacagtacatatacctctgaaaactattacgtgatctagtgtataccgaattgtaaaaaataaacagtacatacctccaacaatagatgtatatgccaaataaataaaaagcagtagaaatcatacaaatttgcagtacatactatccacatgaatttccagtacatattttttaaatatgctggatatataaaaaatatatgtatttttaatatgctggctatctccgtaattttcaaatagttctcatattataatcatcagtaaatcccataagggcaaatgcgtctttttactatggagataacagtaacacacaatcaacacagtagtgacataaaagggtatgaaaatttgaggtaatgtcatataaggaaagagctaatttccactgtcatataagaaaactggtaaatttttagtggtatataagaaatttcttgagttttttatatgaaacataagagaaaattgccattatgtcatcgtcagggaggggtttggtcaaaacgctaaccataaggcctttttcgttaatccccatgagggagggattagagagaatttattctacacctattgtattgtggaattattccccctcaattctcttcgattctctttaatcccctctaaaccgaataaggcctaattaggatttgctaaattaccaggtttacaccctaaaatactatcctgacaaaatttcccatagtcttgtccttctacagccgttgtccgtcgaagtggcccaagttgccggagccgtcactcagcctccctcttctccgcaagtctggcaccgacgagccgaacaataagtctgcactggtaccgacgtccgcgtccatgcccagaaggaagcagggacggtgagaggagtgatgaggagcgggatgccggtgagtgagatgagaagcacacgacagcaacctctatccagcccaagcaactgtcccagggccgtcgaattcccgagcgacagatctactaggtggtcaccaaagcatgctgcgggccgccgtgcgacgcaacgaggagtggatgatgatgagcaacagagacgagcaccagagctgcatgccacaggcctcatcgttctcccgagccttcactgttgtcacttccatcggcatccgttaaaagaaaaatcaacagcatcaaatattaacaacaggagggaatacctgatatacctgactagttaatctgacatatatagtgcctgaatatactgatggtccatccactagaatttctaatcatgcctcaaatcatcgaattgctctacaaatttcataagcattctaagtacaccaaaattctacctcgttaaccatagatccaaactcttaacctccaatcaaatctaactcgctaaaccatacggtggacgttgttctgaaaaaaaaatgagaccatgtaaagaactaccataagtttgaaagttttattttaaaaaaacttacgacagtttcttacaattccaaagaaatacaacctccacggctaaatcttcacctaccactcttacaaagacctaacagctgtttggttgggggaattattagggagaaaggagttgcagggtggggattgttaaatttattgtttggctggaagacgtggggttttaagagggtctggaaggagagtttaaaagcgaactcccatctttacaatgctcaccgggccacgcccactgcaatcagccgaagttttctggcccaatctgtcggcccaacggcctcgcctccattttagcagctcggaccagcaaaaacccgggacgccagaaccaaaacctgaaaaccctcgccgcttctccccgtccttcctttccgagctgccccgcgccgtcgttactttcccccccccccccccccccccaaccagccatggcgggcgacaagacggcggcgccccctccgccagacgcggccgccttctcccccgacggcgagctcttcgctgccgtctccgatcggcgagtccaggtcctcgctcggaacccgtcacctgaatccccccttccttacgcgctgttcccctcgtccttcggtcgttgttgattaggggggaatacttccgctgctggagcgttatacggtcgctgcgctacgatgtagtagtgtgcttttggttttcgagatgtctcgtggctcgcgagtgattgctgtatggttggggaactaggttcgaacgcttgctctctcacggcgattaaataggggagtttggtgaagttggtttttgtttcttccgggtgaagtgctgcttggttgtaggcaatagttttcatgatgtatcactatttaaatacgttgggcgtctacctcaagactcaagagtatataattttgcttataagctgtttgtagagagtgatagaagttaaaagctgagatctgtgaatggtagatagcctatctattttagaaatggtacttcggagaggtgaaagtctactactactaacaaaaagagggtgaaaagttgagctttacatgatggaggaaattcggatggatatgtgtttagcattaaaatctttccttcgctcaaaacatcaatccaaattgtgagattgtagctttgatgtatgctaacctatccattttttctgcttgtgcttttctaattgagaaggtatggcgtacaggaggaggagaaataatagaaggatggactgatccaatttcagccccagatgattcatacagttgtattgcatgttgctctgttcagaaaaaggtaattttttaggattgaaattaggctctgtctcatttctgtcttacaatttgctgtttttgattgggtattttttttgtagcataaaaaggatggaaaccttattcttgttgctgttggtactacaaatggtcaagttttagttctcgattctactggtgtcatatggaagaatgctcctcatacttggtaggtgcaatcttattatgatctatgagcttgatgttcttgacctttaacttgactgataggggttcttctgcaatgttctgaatttcgtttagtacttctaattcaaactagaatgtttggcattttgaaacaaggagtttggccatttctcccttcgatataaacatacataacattcagtactttgttcccctacttaactgcgctgtaggcttatcacgtgtactatgctatatcttagtcattgcttaaaagttaaaacaatatttgaacttacaagtattttttttaatctaaatggctggttctgcatggatatgctgctctctgccgggaaaaaaaaacttcttttggcgtatttgttgtagctcaagactcagtttctttctttccttctgtgcttgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69367 - DNA, 25942 bp, Oryza sativa
  unsure (1)..(25942): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattgaaccatacaatcccaaagataggacctgcgtagagtggcttctgttatctgagacctagtgcccttcctaatgaccgggagcacctgcctgaaatcccctccaaacacaatcgtcttccctccaaacggagaacgtggacaacccattatatctctcatgctcatatcgagggcctcaaccgcttgcctctttgtcatggaggcctcatcccatattataagcgatgccatctggagaagctttgccgtcccactttgtttggtgaagctgcaatacgacccttcctcaatgttgagtgggatcttgaaccgcgaatgtgcggtccggcctgctggcattatagaagctgcaacacccgacgtcgcggttgccacctctatatcaccattgccacgcactgtagctagtagcgccctatataggaaagtcttccccgtgcctcctgggccatctacgaagaacacgctcccctgagcactaccaaccgcgttcatgattttattgaatgcagacctttgctcatcattgagctggtctgggaggttcatatcatctctctccacaacaatggaagactcctcaataatctctctgggatctcctcgagtactatcatgtgattcatctatttcagggagcgggaacgatgagatttccttacccattgattgtagcatgccccggatatctatcagcaccatctgttggacagcataagggcatgcgttgttacatctgacatggaatctagatgcttgtcccaaagtgcacggacatcggtaggttcgcagtacaccaatatggtagcgaataacctgcgtagcgacgccggcatttggtagacaccggcctccgtaaggcactcgtcgagggtgttgtctgcctctataagaccccttctttcagctgcagcacggaacgacggcatgagcacaccatcaacagtacgtaggtcttcaaatgaggtggatcctgtcacatggtttagaagcacccgaagatagtagcgctccccctctgccgggtgggcacacacaattctcccgacctggccacctctatctcttttcttccagtacttacctggcgtctgccaagtaaaccacattgggaaatctctataaaggatatctcgagcctagacatgctgcctgttagcctcgaaatacgccgtaagcatcgatctgcctgcgtcttccttatccagaacatcacggagatccttgtctgcatcgaaagccaacatgtgcatgtttggcagatgcaattgcaactgcctcacagacggcgagatgtggcatatgtcaaaaccatatatacgccacaaggcttctggaggggtcacccacctcgcatccctgtagcgctgaatctcatcgatttcaccgtttttatctgcctcgtttatggatatcgaggccttgtcatgtcccttgtaaaggtatttaaagaggtactttactgccttgatgctcgagcaaatctcgacattcatgtgacagttgtacatccgtagaagataaggattgtacgggacaacccacctgttatcgagaggatgtcctctaaccaccttactcttactgtcattacgtctcctatacaacgggtatgaatccttgccttgcgaggttgtggtgttgaactctcgtaggtagttgttcctgcactttccatctcgcatgcattggcacctaccgttgagtcgaccacaagggccatgcatcatatgcttgacaaccatattgtatagctctggatattttttcttgtccggtagctcagctgagacgatgcggtcatattgctctgcagacgttagcttgtatcgaccactcatgatcagcaaaaagtgtgcgtgtggcagacccctcttctggaactcaacaacatatacgtgtgcaatgactttgccaaggatgtgcttctcgaacagctgcttctttaggtcctctaacttggctcgaaagacacggaccacgagatcaagacgatcttgtggtgtctggccaggctcaagttcacgagtaatctcatcctacttggggttgctagtcattgtaaggaatacatctggcttcccgtacttctatactaaagccatggcatccatgtatcgacgcttcatatttcggccaccacagacaaacaaagctggcaacacagttcttttgccaaccgcgcttgctcgactctccccagcctggatgctatccatcaacccttgatacaggtccgcccttatctccttctggttgttcctcacatagtctagacgggagctctcaaccttgatgtacatgtcaacggcaaactgctggaacaggagtccgccgtgaagtataggattgaaaatcccacgacgcatctggaatttatagcagtagtagtcccttacagagactcgtatcctgctgttacaatctacacgtgagaaacatctaggttagtacagtcatgtaacgcacaatgatcaattctctaaggcaacatagtacgaagataaacttaccaggatcatcgccattccgtgcgtttgcatcctccatggttattttgtcctttggaaggctttgatgccaaccattctctctagggaagaaaagagggtacgagaggggatcataacattcgtagaaaggctggatagatttccgcgtacggttgttcctgtatattgtcacgctaggctcgaacttccttctctcatttccctcaacccagatagcagcgacctcagttgtcaccggcacattgtaacgcctttggtgcaacctatgatccagatttagtgtcacgcgataattcgcgaggtcttcagcctgccctagacttctaaatgtctccgagtacgggttgttccgaaggacgtctgcaacagtcctaatcacatcctggtcaaggctaggggaacgttggaatctatgactcaatgttggatcgtcatcgtagaaatacaactcgagatgctctggaccagaatctctaggactgaaagaatgtatattatgatatatctgaccatgagcccgaaaagtgtacacgcccgaactcatgtttgcaaaggccttgtcaaggcttacaccaagggtagtgaatgagaagtggccgttgaagtatctattgttatcacggaaatgcttggcgtctggatccgagcttgtccaaagcctcatcagttcaggaggtgtttcattttgtacaagcttgatcttgccaccccgacaacagaagctcggcggttcgtactggaacctcttggcaccacagtgtttacagtcaggttcaggcttcagaacatttgtgctttgtggaatgttgctgtacatatagtcatacggatcaggaacagaagaggtcggtgattgcgtgtcatcgtcatcagattgtaccatctcgtcatcctcatcgtcgcctggtatggtttagcgcaaaggatttatagtccgcaaaaattatacatgtgaaagagacattaagatatcacgacgacgatacctagcccagcaaacatgtagtattcatcgtcggagtcatcatccatgaaggaatccatatcatctttagtacaatgagatatgagaagttagtatgcggaagggtacaaattataggggaatttaactaattgccacttttaggtttggcagttatccaattcccttgttacgtttcttaactaattggcacttttgccatggattgccacatggccaacagtgacaaatagttaagaagccaccatctaagaggggcaaaaaattaagagcaaacttaagaagggcatttggatagttgccaaatctaaaagtggaatatagttaaattcccccaaattgcgagtacgaatgaaaacatatatagatgataccatcattgaatgtgcatgatcgcgcctgatgatctacagcatgctcagtttgcaggctcgatgtagatggcacatcaccggttgtttccaagcaaggcgttggatttagcaacaatgggatagatccctcagggcactctagtgcaatggattcagcgcatggtttgtcacgcctagctgcatagagtgcgttacgtcgtgccagatgagcagatctttccccaggagtaacattttgtcgtcttgatctacggcaagcattcatatcatggatttccacatctggcatagattgccttgcaaccctacgacgggcattcaactctagtctctgttcttttgttagtgattgacgttgtgttctccgttggtccaccttagcttgcttttgctccggtgtaagagttgcatacttctccctagctcgagctagctttgactgcaatcgttcttttgtctcattggttggcgcacgcaccaattcattatctagtgatgtgccaacatcatcatgagtagatttatgggattgtttgctcacttcaaatattaaattgtacaaacatgaatagataataataactaacttagcgcacttctcatatgtaagcaaagaggttttatgtttgacaagtttatataaaaaaaacatgtgatgaagtaaaatgtgttacctagagagatgtcgtcatcgtggtcgcactcattttgatcgctgccttcaaaaaaactggattcatattgattttcacatcctgttgtaacatagtcagtaatatatattgtaatatagaaatttataaatggcaacagcattgtaatcccattaataaaaagatattagcatacctgaattatcaactacaaagtcagaagtattcatgtttaggtactttgagtgaagcgactcattggtacttcgttgggaccatagtgagctacattgttgatgattgtaaatgggagacgtcttggtgtgatattaagatgggaagcttcactttctatttaaacatagaactatcaatttccattcagtcgaataatatattgttcaaccaaactgtacaaacaataaagacattacttccttgatgcagcggggaagaatcagtcacttccaattggcacttcattatatcaacagcgcttatatttgaaatatcgccaagtggggctgttcacacgacgagaatttataatattgtttcgcataattggccagacatattttaatttgtacagataaatattacagttgtacctgaaacttgagtttcctccttctttcttttccttctttcacgtgccttcttgttcctatcatctttttgctctggggtcaatgctgcgtaccggtctctagcacgctttctttttagttcagccacactaaggtgactaacatcttcatgcaaacctgtacacatatgcacattgctgggtgtattgaaggacgcatcgcggttttccgcacatggatgactattaggcgtcaccacaggatgcacaacttcatggccagcatcacaagtttatactcatcacattggtgttggtggatacagattgagattgaattaaaataggaaacaagcaatatgtaaaagataccatttgaagcagttgggagtgttatttgtaaagacatcacaattctcgtcgtatctttcaacggcacgtaacgacttgtttccaaccttgccccgtcaatttgccaaaccggaaccacttatattggttatgtcagcaagagggcctaagaaaggaacacatgggtgaaattagcatgcaaagagtttacattcgagttaataacatgcacatagctaacctgattttgtagttgatgttgtggagcccccaacaatcttatccatttctgaaaaacaaaacacatcagaccgcctaaatgcagtaatcacacttcattgagtctggatgttttcatcagtaacttcacaactcagacacagacatgtaaaaccagtaacttcacaactcagatatatatcgttggagagtgtaatattcctagagtgatggcagtgaaaagtaataggagatatttactgaatccaatataaaacatgtgtggcagtaacagacatatatttggtgcatatgttaaaaaataaattaatcagagacatgacatcccacaagaagcatcagtttataaactgtaaaaccaggttatatactacctgaaattaaagcaacaaaattggattttctcggggaaagtgaacattaggggttaaaatttacctagaaaggatatatatagagaggtgcagcactaaaaacaccaggatggctgtagcctacaagaagataaattagacatagaatgagaaaacagagaatgaaacagcagtgagctagcctagacagtgctgattcttcttaattgatctcacactgcaccccgagagaagaatatggcgatctggggggagggggaaccttgcaattaacgaaggaatgggaaggggagggagagatgtttacctggctagcggcgtgggggcgaggaggcgcgaaggggaccagacgacgagtaatcgacgacgacttgttggaaacccaatgtaagaaattcaatcaaatgctgaaaaattaaatgataaattataaatcagagaaacccagtgtaagatgaagcttcattctgaaatgcaataaaaagggattgccttcatgataagcaaaatgtatataacagtatctgaccaaccggtacgtcctatcactaaacataaaccaaatgtaccttatcctatcctatccaacagccaccaaaatttcaatcccctaaaatattcacccatatagatgtggggaagatgaggccaccggcgtgaaggatcgactcacaaaccaaatgaaacttatcctatcctatccaacaatcacccaaaattcaatcccctaaatattcacccatacagatgtggggaagatgaggccaccggcgtgaaggattgactcacaggcggacgagggtgcaaagaagagcctccaagtaatgcataatgcataataatatggtatataatgcatatatccatgacacacaaaataattcacaatggcgttgatatcaatatttattacatatatttacactgtttctcatcgagattgatacttcttaattgtaatttgtgagaatgttgtaccataggatatcaaacatctagtatttgcccccatttaatatttgctttctctaatctgatagcccaaaaaaaaaaactgccaggatcccacataataacacatttactcctcttcgatgcatgtggccagatccttatattggttcaaaattactttcaggataacagagggaaattatcagtgttttttcaccatccatgtgtgtactgacgttgtgactctcagagcaaacctcttgctattgtgtgttatgcatcaccacgcaatgcagactgaactggagttcttttttttgttttgagaaattcatcgacactgacgtatacttaaaattctcgtgccatttgcaaagcggaaatttcaaaccaggaaaagaagactaatttaaatgagacacacacacctgaaacactgatctgatgttgaggaggccggaagctggcagcaatattctgaagttaaattcaactgcaatataggaacgtcagcacatctactgtcagaaaattagatgagtcaatctgtaattgttgtcatacagatttagtttattagcatctaataagtattggatgtgactcaacagaaaagtgattacatcggatgcaaaagctgaagagcaatttgaagtgtcattagtcattacctgttattagatacaaatcatgagtttagggatcccaacagcgttgtccattgctgtaggccaaggcgtggagatcaataaccacctgcacacatacagtagcatatagtttaaaagaatacggatcgattgctagattccacagcctcagccgtgccgtgggaccgagaaaggatcagtggcagtgagaagcagtcaccgtgtaaggcgtcggcggcgtcctggcgacgggtaccctgacaaaacatgccgttgccagctgtcgaactccaaattaggtgcttacaatttacaagatcaaaactgattgctctatcggaactatggacagcacaaaataatccgtcagtggttgttaaaatgcattttactgggttaaagaagccgatgctggatgagcagggtgtgattcactatatcattggggattttgacactggattctaaagtttttccatgaacagagtggcagattgtttctgcggcattcaatcgaacacctcatgtgcatgggcaaaaagctttactcgttcatcgcaatcaaaatcaattgggtagtataagtcaaaatagtttgctcatcacaatcaaaatcaaatcggaagggagaagagattgaaagacaacaaaagagaaaacttgccgtacagctctactggcctcaaaccacctctccgctcggtctcggcattgtagcggcgtgaatccctttcctcaggcgctcgggaagatgatgtcgatgaccgcggcggaggtggcggctgaggggataagcgtcgaagcagaggaggcggggcggcgggcgatatagcgcggaggcgaccacgagaagatggatgaaacagcgatgggggaggtggcgcgggtgtgggagatcggcttggggtgggggggggggggcgacgacgactcaggcgactccggatcggtggcggcgaagccgtcggcacacgcggaggcggtcgacaagtcggagattgggggcggcgcggaggacaccggcgaggtgggagacggcgcgggcggcgattagggtgcgggcgtgcggcgttggaggttgttgagggggagagaaacgctaaaaaaaaacagggtgtgcgaacgatggggatgcggatgcgggggcatgcaaacgacgggaaagacgatatgagccgttggatttagcgatcggatggctcatactccgcgtgtctgccagtgttggagtcaccgccaccactatagaattttaaaatagcagagatagagcacttgcccacaccctatacagtatgccactaacttttaacttgctgtttctggctttcattcggtgacggacggcatgatgcatgcatgtgacccttacttcgctaatgattttcaggcagttcttagatcagctttgcattccacttggttaatctgcaagactacaagagggtttaatctgcaggttaggtcttctacttgctagagggtaggagaaggctctgatttaatattacaagtttttagaggtggggtcttcctcagctcatttgacatcacgatgttccaattaaattggcattttcaccgcacaacgccggccacaggccgcaaatgctctccattgaataatcccaaactttgtgttgcgccgcgcagcgcgtgctttgctttgtcatcaaaattttctgaaatttatcaacttcccgtctcaatcgtcagagtatactactaatataacagccacaggacaataactctgtcttgttcgattggtcttccgctttttgttcttactttcggtaaacaaatgatttgtctccaaagatctggtatgggttaatctggcccttttcttggagtcggaggccatggtttctgactatcggggtggttttgcccctaatccggttattagttgtctcccatgtcttgcagtgtaaatgtttctcatctgaaaatcgggtgattgtttacaacaaccgtgatggtgagttctttattagtagtaattaattattagctgctgtctaggtagcccaagagcgacctgtgaatctatgattagttgttgtttgatggttaagctctgccaatggtagagttttcgtagaggagagggcagccgtctattaactatattcaataggagtacatctccttttagcactaaccttagtacagtacctcgaaagtaaaatcaaattttggatctaaaaatataataattagatcctgagataacgaaatccaagcaaatcaaatcaaactcaggtttgtaggcgtacttaaaggaagttgcaccggcctattccacatgagaacaatatctcggttgcacacaagggatgcgtgagttcttgccactcacgaaagcaattctttggaccccataaaacaagcatctttcaacatcttcacctaatctttggccataatctttcgttcgcttgttttgatttaaccgtatatgaataattattcttgtgcctcaaaaccatccacccaggtcggcataatctgttgatgtctcatcatttgttggtggagcagaagaagaaaggagttttagatgtagcctctgcatgcaaacctcaaatattcagtctgacacgaacctacaactcattaagttattttaatctaactatattcgctttgttcttctctggtttcttggtttatgttggtttggggaggcagttaagtgttgccgtcatctgctagagggacttgcacactattattagggatgagaaatgatgcaccaggacttccgattgactctgcatcaccgtgaagccgaggcctaagcaacacaaattaatgctcttttcaattattgagctgtataactccaaataattgagtatccaagcaagcgattgttggtcaattgatcgacctctggataagagtctagaagaaaaaacgggaaactaattattattccgataagaaaccaatagctctgctgctagcttccttccttgcacagaagagactcttcactctacactccaagccttaatcaacacacatcattgagaaataaagaaaaaagggaatcttacttctagtttctctatcaaggtgatatgcaggcttcatcttggcgtcctctgtacaaaataaaattttgaagggccacagactaactacgtacgctagtgacctagcgtgtcacgggcttacggctcacacaggtcacacattttcctgtgaaagagcagaaaagaaattggtggtgataatccaagtggcaattctgctattctctggatagaacatcctggagtgcctttgtgcctttccccttctgttttattttctatcatatgcatatgcataacaggtgcatgattctgactttaagagggaaaaaaaaggacccttcctaatgcagctaattatgttagtcccaaactcccaattgctcaagaacgaataataaactcaacgataagcttgctgacgtctatgcaggaaatttattttcgcccttatatatgatctctttgttgggatggagccatgaaaattctgttggtttcccgccctgttttgttgagataggccagctctactagatttataatctttacttgaacaagaagactaaatattcttggaagagaagccgtgagcatccaaattgtaggagcagatgcatgcaacttattctttttatcaaattactaatttcaggaatttgtgctatcatggacggtactaataaaatgttggcaatacaaaaatgtttaccagcgacaaaatgtcagtatccccacagagaaacactagttacaaataatatccttttatacgtttgcataaacttatcctagtgaagtatatttaaaaaaacatattctagtagcacgtactctaggtccttggatcacacaattataaatactgaggacacttccagttcatgacaaattcttgtgcactcattccgaatacatggtgcaaatgatcctaaaaattgatgaaataatttgacaaagtcgatgtatcattttaaatattttgaaatcgacgtgcacaagcccaagacaagcaattttagtttgttattttgaatttatttataaatatttttccccctctaggcctctactgaacaaatttagacccttttttttctaggtagatatgcatattcggaattgatcatccaccgcccactaaacagaaaacacaaactatatgaaagcaggccctacgaacacattcttttcatctcaaccacaaacgatgtagtacaaatttagaggggaaataaatcttaaaaccgcatgaaacgcaaatttcgtttagcaggtcaacaaccaaaaaccgtctcctctgctctgtataaaagccacccacaaaacccccacgaaacttgtcccccaaacaaccccatccccaagaaactaaacctcatccccgcccccacccatgtccgaccaccaccacctcaccggcgaccaccacccctccccggcgagcgccgccaccaccgctctaggtcccctgctcctcctcccgtcggagctcctccacgacatcctcatccgcctcgccctcccggagctcctccgcgtccgctccgtcgcgcgcccgctctcccacgtcatctcctccccggacttccgccgcctgtaccacctctcctccgccgcctccgggccaggccccgcggccgcgtggctcctcgtcttcaagaagctccgcccccgcgacgccgcgctccgggggttccatgggccgtccggccgctggttccgcatccccgtctccgccatcctcgcgcccgcggtgccacccggcgaggacctctacttcctggccgcgtccggcagctccttcctcttcgccgccaacggccgccgcgagctcgtcgtcgtcgacctctcggcgcacgccgcccgccgcctcccgccgtccccgctcggcccccgcggcacctcctcctggcgccgcttcggcctcaagctcgtcgccgatccccccgggtcgagccagtttaggtacccgtctttttctcgcccgaggattctggaaatcttccaaatagtaattacgtaattaattactgttacgtattactccactccactactactactgtgcattgctgaagaacagtcaaactcaattgttaattggttgattactgttaacttacaaggtttctgttcgctgagctggtgaacaacacgccactcctcttcgagtaccagtccgagacggacacgtggcagtcatcggaggcggtccaggcggagggggcgtcgacggcggccgggacggaggggacgttcctgtgcgcggcgcacgccgggccggactgcgtgatggtgtactccgggccgggcgtggagcggccggtcttcttccggccgcggttcccgcacaacccgaacggcggcggcgacaggctccacgtgtacggcgacgggagcgccgcggtggtccggtcgacggtgatcgacgagccgggcaggccgcgggtgaaggtggtggccggcgtggacctgtacgggttcgggtcggtcgtcggcggcgactggcagctggcctccaccgtgccgggcgagctggtggaggggttccggaagccgtacgccgtgatgaccgggctgctgtcggagcgggagggcgtggtccggctcgtcctcatctccaactgccgtggcgcctgggacatcgtgtggctgtcgtacgaccgcgcccgcggcgagtggtggtgggtgcccgtgccggactggggcaccaaggggctcaacgtggccggaatcgccgtctcctccaccttctcccgcctctggccgccggccgccgcctcgtcctgcaccaccaccacctcccagtgaaccgaactcgccggcgtctctgcgtcaccgtgcggcttacggcgagcggtggggaattggattgttaggcccaacgtggcaatgggccccgcacccgtgtaagtggtgggcctcctcccccgtgcccgtggggccgtcgcataatgcgacatgatcttgcacaatggcttctccgatggcgacaaatcgtcgagtgcgagtgagtgtgcttcagataaggaggggtgtactggcgtgcgtgcaagcactcttctctatagttctcttttagtatcactgttcattgttcataagccgtgtgagtgtagctttgtgttcatcttctcgtaaaccaagtaaaaagggcaggctggtactctgttctcgattagttgcagaactccatccaggtgtggcttttatgtgacagttttgcagccgtaaaagattacggattaccttatcttaaacgcagttgcagatcgggtagaatacttgttctctcacaacacatcattcttatgtcagaggaaggtggtttctggacagtttgatgcctgttttgttgacgtgtccgcttaattgctttggtcaagtctatgatgcttctgttgttgcagagtactgagaacgactaatgggagaaaattgatcacatgcttctgtactggcaaacgagaaagcgtaggtagaataggagagttttggacctgaatttaggtgatctgtccacgtcgagttactgcatttaccttttactagcttttgccctaaagaagaatggctcacaaagtttctaagatacattaggcggctaggcttcatccgcacggatttatgcacaaacggatggaccaaacactcgttaaaaacaaggctcagcatcagaattgcaaaattccaacggagtgaacgagcaagcgggctcacataaggcatggatcgtactaaacagcaggcaacgatgagaatctaaatctaactagtacggagtatctctaggaatttggcgacaaaatcaaccaatacgtccggcaagtgttgcagacttgcagccgagcaaccgatggatggattgctcatgtacatcagtatcatgcatctgctgaaccggcacaaaaaagacggactcacatgcatctggtattttggcctctcggctggccagtcattagtcatcactgggcttcggacttcagaattcttctcatgtcatagtcaaataggaaaggaagtgagaatggatggatgataagtttgatgtgatccggtacttgaaatggcagacacagaatccgccctagatcacttggtgcgtggttagcaataagattggagaattaccataaaaaatattagtataagccctggaatcaatataagtgatatttgctggaatagtgatcttattccctttgagctctcagccattgcttgtttgatcctgccatagcctgttatgacatcatttcagttaattagagcaatgggataacaagagcttaccaattgacatggcccacttcaataggcaagcaaaatccattcacaaggaaaattttgcaaggcgtgggaaacctattcattcattctccctgccagaacggttgaatttccacaatggcgttcagtgcacttgtcaaaatttgcatacgttacaaacaaaataaacaggcagcttgattctgcgcactgttacaaacttgagaaaccgtgaattgtttcatcaccattatttctacccactgcaatcattctcctacctatcgattgactttgtcaaagaaagatgaatctaattacttggagatgagtttgatggtgaactctcagttgcagtagcttcgctctctatagtgccgtttgtgtgctccaccaatacatcagcctcaggagccttgagcagggaaggatctaccttctcttttgcagacatatcccttttgagatcttccttagccaagctagagaattgcttgtctagtgaacttgccgcgcctagccatgctagaacaatcaccaacagtatgccaccaaggtagggggtggagttagctaaagagccaaatgtaaggatcatgaactgttgaataagagctccaccagacttccccaatgggttgcagacaacatcaatggctgcctttcccttcacctgcaaacagaggaagcagagttggcttctgcagcataattggtggtgcaaactcgccctagtgctttgtacaaagcccacaacatcaaactttatggatagagaactgacattcagttcaaactgctcaattgctcatgccaatggattgcacttattggtgtaactaaagcaaatatgatgcaatgaatggaagcaggtaaacacaggcaatgttatcttacaactacaggatcaagacagaagctttaaattacttaacagatactagttcatcaagaattgctagataatttctaaatgatgcacatgggatatgcatatatgaagcaacaaactgcttaaatgaatcacgagagtatacaaagcagaataatgcgcaaaaatatttttaaatgttcatcgtcgaatcacatgaataaatatgcaatctggtatagaagcaaaccttcatatcttcatccaaaggaatgtaggccatttctttgcatggatcaaataaactatactttgcactcttgctgaatatgttctgaagtgcacccacataaactgctgcaagaagaggggtcatgcccattgtggcaagcataggagtgagaggctgcccaaatagaatcagggagaagaaaccgacgccagtcagcaacaaaactgtgggggtgatcattgcagccactccccagccgaattttcggagtatgatccggcctaacagcatcattgtgaaagtagcaatgccagtagcggttgagaaatcacccatgaaagatgaatactcatttggactagggaactgccatgatgaagaaagaaatacttaattagaaaaactgtttgacaaattaatctgaagatgaaacaaacaaagctgagaaagttacctgtgccttgagcttcgatttccatgtgacctccacaaggttgatactgatgccatatgcaaccactaaagtagcaaggtcccttacatatcttgaggagaggagaactttaagactctctttcattccaagcttaggtttatcctgttgaaaaaaaacgttagtgcattatttgtagtagtagtagtaaaaaaaaaaaagaagcacatttaactattcggctgacctttttcttcttacggtcagacttcggaagagaaggatcattcaaaacaaacttgttcaccccccaatagatggaagtgatgacaagtccaagaagcaccactaagctcatcattcctttcaaagacacctcccatccgtcaatacctggacccaatgtcttgcgcagatttgagaaatacttcacagtacgcccagaaaagatgagcgcaatattagccccaagaccaaatagagggtagaattcttttgcttcctcaactgtagtaatctgcagaaggatggatgaaatcagttgtagcctgaagggtcaccatttgatgggaagttcagaaaatattaaacaggtatatacaaccaaacgtcagacaacactagaaaaccccatccagcttgcaaccaattgacagttatacacctctggtcaagcttcgtgaacaacaaaaaacaaccactgtgaactctgcataactgaggacattgatcacctaccattcagatgtaattctgaaatcaaatagctgaggacacacgtgttattcggatgcaccaacattactcattcaggcatgaccaacagcccacaaagccactctggcaaatggcccagaaaaaaaaaactctatatcccctatgcagaattattcagtcagagagttgacacaatctattccaccgtcttctctcagatagatataagagagaagttcaaacatttgtacttgtgaaataatgccattctatcacctagattgtcttgaattattatcagctagctactcatggttgtgtagagtatccctatctcctgaaaagcttgtttctgtctttgttttctcttattttaaatcttgccctaagtatttcttccccctcttgaacttccagcaaggatcctccctactgtttcacacaaatgaaatgtatgtataaaactatccaatataagcattcaggcattcctttgtgggaagaaaagtagccataatatggccacatgttatgttaaaggctgcagcttgtttggtttggtagtaccaaaattggctagggtttcatctgcaactctggccctcaaaacaaacaggcccacatcaatcaacattacttattgcaaaagcagttaaaaagtgtgaaccatatccaggcaagtggttgtaaaagaacgcatatcacaacaaaaatgcaacttaaccaactaaatataattcagattaacaaaagctagcaaagtagcaatcatgaagttgaaggcattcatgccagaaagcaacaagcacctagacttagccaataggtttgacaatacactgagcaatactactaaatactaatcaaaccaacgtttctgtaactacccattatcccaagagcacatcctaatttctgacggagtgacagaaacccaacaacaaactctgctccttcatgttttgctctccacagccaaacatcaggttaaacattagctaatgagatggccatcaatttttgactgaaaatagacaataaattgacatttgcacatgcctagattgaccacaaaaatccaaacccatgactcacctggttagcgaagccccagaagaggaccgagatgacgacgctgccccacagttcggccatgacatagaacaagcaaaagctccaaatcctcagaatggcgacggggccaagaaagctcgggccgagcgccgcaaggagcttgtcggcgagcgcggtggggtggatcacattcctgagagggtagagcacgaaggcaaaggcgccgaagaaggcgatgaaggggaagatgacggtgtagaagagcgcctccctggagagcacattggagagcttggtgtagaggagcatgaagccgatggccatgggcaggttgacccacgtcttgaggaacgggatgatctccccgctgctccccttggcggtcaccaccagcacgtccttggtgtcccgcaggatcgtgtacttgaacaacatgcagaagaacatcaacccgagcggcacgatcttcttcagcgtcttcacctccacgccgaggaacttcttcccctccggctgcgccgccggcaccgcccccgccgccgccgccgcggcaggctgcgccccgcaagagaccccaccaccaccaccaccactagcgccgctcctccgtctcaagagcccgcaccccaatcccaaccccacgacggcgtcccgcgaggtagggccgcttctcgaagcgaggaggagcggggactggagcgatacgggggccgccggggaggaggggagggagacgcgcgcggatcgcgcgcgcgggagcgggaggcggagcccgcgcggggagggaggccgccgggcttggcgtggaggagcgcgagcgactccatgggcggcgccgctgcttccgggctccgcgaaacgcgaggtggggggaggcggagggagggaaaggaggaggaggaggagtaggtcggggggaactttgggagtaataaaagatcgcgcactgaccaagccccggcgggatcggccgtcggttcgcgaggcggacgacgatcctggccgttggcttgggtactggggttggtgggggtgcgtggaacgagacagccgccgcccgccctacgcagtcagcggcgccgtggctcgccgggtgttttgtaggagtaactcattccctttttgtttctgtgcgttagaggagtttgtttacaaacttccatgttaaatctcctctatttttatttattttggttgaaacttgaaaaacatgaagtggtaacatattttctctcaatcgaaaactgaggttttaaatcaaatgaagaccacccttctgtccttctgtggctgtgtttgcaactctcttttcccagcccctctccatcgtttttcgcgcgcacgcttttcaaattgctaaacggtgtgttttttaaaaaaatttatatatgaaagttgttttaaaaaatcaaattaatctatttttttaaaaaaaattagcttatatttaattaatcatacgctaatgaatcgctccgttttccgtgcggagggaatatgttcctatccaccttatgcgaacacagcctaaagaggcatgagggtattttggacaggtacaacaaacttcactacccaaaataccctcatttgaagtatcatttgtggagatattgtgtatttgtgtttaaagaattttgggtaatacaatgaacctttgaagtatcatttgtggagatatattgtgtttaaactataatagactataggacaatcatttcattttatactcctcagatcgtaaaataatggaaaaaattattgctttccggaggattttttttataactagtagtatattaatttgatcactaaattgtatatttacacatatactccatccgtttcacaatgtaagttattctaacatttttcacattcacattgaagaaagtacatgagaaatggcatataagtgtaataatattatgaaaggactgaaacttgctcagcatttgattgcacatcattcattaattaggtgatctagctttctgatcgatcaactagcccaaaactaatataatgaaatttaatttcattatgcataatgagagcgacatgcatggtccgacggtctgttggtccatacgaatcaacaattcatgaatcatttgttgaatccagatcattatttttttttgttgaatccagatcatatgaaactacaatcactagtaaccatagttttgtttttttgttgaaacagtatacggtagaagttctactggatatattagaagaagagagttgactctatttataagggaaaccgggatcgaaaaccatacaactgcacggtttgctaagagaaaaccgacaaaaccttacacagaagacacagaaaacctgtgacaaaactacgaaccacataagtaaccgagagagtagcaagaccttcaagacgaagcctccaaagaggtgaacaacgacagaagctcctgccgacacctgcccatagctagactgggttttcacctaagggaggagaccaaccatagttttgtaggactagttaaatctaaccttcggtagttgactactcttttactccaaccagcttttaaagataaatctgaataaatacttgtataaatttataccttaaaaattaatatttttttaacggaggaacagaggttgtacacgcatcatcattcaacagatgagctactacgcagtataagaactcaagaagtagcagtgcagtactagaacaaattaattaaggttcaagtcatggggtttccgtttcctcgtctcatgagatcttgttttggacctttgaggcgtacgtcgttttcagaaaacgttctaattcgcttcacgtatttgaccacacgggctcgtttttttttcaagtcaaaatagctagcctagtacgactgcgttgctccctgtccgattcacctgtttctgattccactcgacattgcccacaagatccttctccagaccttcccgccaaccaccctacttttatgcaacgtgttaaattttgctaaagcagttttttttatcatttttcatccaaatattttttttgttagctttcatcagtcatttaaaagtgcatatatagtaaaaaaaataaaacatattaattctccaatactcaggtttttcttgcaaagatttacagaaaaaatatttttttattttcttcatttttattgtatataaggcattaaggcttacctagatttagtttgttttctactagttatgcatggattattttgttttataggtgttaaatccccccatttgcacttatcttaaagtaagagtagttagttgattgattatttgttcttgggtagccaaacaacagacaaacggtgtacactgaccatggaaggtaaaagaacttgtgaatcaaggttgacaaaattccagttatgtaagtaatagactcttatattaagggaaattaatatacatcatcacaaacaaagtaattaacctaaaaataataaaatattgaaatgcatgccatcatgtcatttaccaacttgacggtaagaatcatatgaccttgatattcatcttgtacaattaaaccttttcaatatgttttcttttgagaaccagaattttcaatatgtcatttaccaacttgacagtaagaaatcatatgttttcaatatgtcatatgaaccctttcaacttgtgccaaaataatatatccttttttattttggaaaatgaagataaaatatgtttattcctatatatatcttatgtattagaatatttcttgttgtttcttcgtgatagccaggcgcctgagaagcagagattatagtttaggcataaaagaccagaatgtatattggtctaataacaagggccggcaatacaaacttggtataaaatcgtatgatacggaagtctctcacgtatacggttccttggaaagaaagaagctaccaattggactttcaccaaatgtatatatatttgtagctcgaagtttccttttaagtatatgttgtctacctgctgaaatattaacacctaaatcttgctggtctgtgaaatatacatttattgtcatcacattattacatttctttatatgtgcatcaactacatatgcatctccacaaaaggcccatttaattccattttccaatagcccaagtaaatttccttggactggatattggaccttcaaagttcttgcatgatacatttgggatagcaatggagttatagaaatcacttttcatctctgatcatttagggcccgtttggtttatcaacaaaggctagcatagccttacctaggaaggctagttgtctggaaccggtaaaaaaaaacttgcttttaggagcgaactaaccttgcaaggtgagaaaaatctcgctggtcagggagaaccgattcagctcgcctttgatggcaaaaccccaagcgcacacaaaaaaagaaagctctattcacatgaaaaattgagataagatgagagcggtccgggcttcttcgaaatcagagatatttttcaacaacttgccccaatctcatcggcctcttcccccaccttttgttggtgaagtctttcgctgaaatcatcctctcccacctacccataagccgcagtcacctggaaactatctccttacaatagtgagacaacagggtatctaatcgtaccgaaataattgtttattacttttttttctttttctttacttccatgtaataaaatttctttaataaatgttaagagttaattttgagtcgatgtcatgcaaagtaacgatggttgcttttcctccattctctttcttccacatcaccaaaattatttacatgcatggtaacaaagagcttgttactaaacactgttatacatgccctaataaccgtagtgaactattaccatcacagagttgatattacaacgacatccttacccttctcttcctctcatgcaccaatagatggtgcatcaatgtgaggacgctatgtgagggaaacgtgttttagactcttgagaagatatcccctcttttgttcaagcactatctaaatgattgttaaaaaatctcaagaaaatgacaacattcacaacacatatataaacttctcaaaagaaaaaaagaagtcaaaactcaactttgacggaatgatagatgttacaaaactctacattatcaatatttttttagagttcttcaaaaactacttacattgaaattgagagaaaaacttagacgagggggacatcccctcctcaagggattagaattctctcacacattaaaattgagagaaaaagttagacgaggggaacatcccctgccccctcgagggattagaatcctctcccgctatgtgagcttagagctcaatgacaactccaaatgaagaacgtactcacaaaagatcgagggaaatttcaatacaatccacttcaaaacatcaacccaaattataaaaatgtcactgcaaaaagcatagcgatcgaccttaccgttggtttgtctatattaagcatttccatgcatccaagtccattcgatctcgttaatggaaagctggagttgtacttcaattatccaaaaatactaagcatttcctagatacacattttgatgcaagccctcacacaatctctgttacagttttgttgatttttgattccatctgctagaatcagaaaaggggatgcagttcttctgatgtacaattgactgatacgattgcaccatctcttaatttacaattaaatctgccactcatataattgcattcaactgatgcaaatatgaacgattgcataaaagtgtgttaacatgcatgcaaaaacagtatggtgtgccaatataattaatgtgcaaacagtggcatgaaaaccatagtgcatgatatatatatatatatatatatatatatagctatttctaaagtgtgcacactaccaacagaatcttatactgatatcaagctggcctaaaagaaccattataaaaccacgaggcaaagtttagacagtatcaacattaattagaaaaccaaagtttagatatgcatatggggtgcgtgtgtatcatccaaatatgtctttcaagtaaaaatacaacacgagaaactgatagcctagagtggtagcatttctatcagtatcagattcaaattaactagacagaagggaattgcaccagattgaaagcatagctatagctagcagcatgcgtagttgcgtacagtacgtgatccggccagctcctgggtctccagggtgcatatatcatgcaaacaaataagtagtcaagtgcgtagatatcagtttaatttattgcaacggagatcaacaaccacagtacatgcgccctgctaggctgctacctgctagcgacttgactaactgcttctgtattatgtgcatatatatagcttgcagcgcagtttgcctatcggcacgatgacctctagcttcccggtacaaaaaccacacactttgtactgcctcatagcttagactacggttactcggggaggtacatatatatattagtagaagctaattaccataaactgatacttaattaagtgagtacctacttgcgtgcgaccaaataagtagcatatatatgcagtggcaactctattaagacagtactacagcatgtcagcatgacttcgtagctgctaattaatcttcaggtaccatgcacactagctactacattagctagctcttctttcacccgacgacgacgactcaggcggcaggcgcgcagtcatagtcgtcgtcatcgtcgtcgccgtctgtctcggccatcctaccccgcgcactgcagcacggtgcgccggcgtaaaccgcaaaggaggcaataatgccgccgtcttggtggacgagggggctggcctccgacaccggcgccatggaaattaagcaggaggggtatgctagctttagctcgctcaacactactgtggctgatggggctagcactctggaggctctaccgctctagctagtgcgctgtactctataccagctagctagctgtgtggtggtactggtgtgagatttagccgcgtgctgtgcggggatctttatagcgcgcggccggcggggcggcaatgtggcggcacgcggcggcaggcgccgggagcgtgcgtcggcgtgcgtgacgtcccgcggcacgcgtcccgggcgagcacacccggccgcgggggcgtggcgccccacggccgcgtgcctctgacaggtgagcgcccccggtggggggaggggaccccgcgcatccgacgtgccagcccggacgctgcgtccgcggggtgaggtggtggccggcgcctcggtggcgcgcgagaatgacacaggaaacgagaggacagcaagcgatgggggggagagaggggggggggggggggggg

SEQ ID NO: 69368 - DNA, 2750 bp, Oryza sativa
caaaagctagcgcgtcgctcatcatccgctacgcgcagcggggtccttttcgtgggcatcttggggtgatatttcggtgtgatagctgcagacatattcggctgagtcctgtagtgtggcattcgcccagcaaagtgcgatatgcggcgatttgtcgattttacgtgttgtttggatggatactaactttatcataactctatttatcataactatgataagccacacaaaatgtagtgaataaattattggttataactatagcaaactttggctagaaaataagagtatgacgtgtggaccaatgtgctagtaaagtgtggcttaactcaactaaacactaccctaagaaattatggtgtgcctaaggtttggtgttgtaaaccgctgtcactatccaaacagcccctaagacaaacgttgggtgctcgattagtatagacaaagacgattagtattgttaagtaggtaaatggcgaaataatataatagtaccacgtgcacgtatacagttgattattggtaagtaatgtcatgatcagtactgtatctttgacttacttagtcttctatactatacaaatcatggtcatagaaagctgctacccctttcgattagctatcttacagtacataggtagtgtacagttctatcgaaaggttcctatcttttgtttgtatgaaatttcatagccctagctaccttttctaccaaccgtcagaaaaaagaattcttaaatttaaatttaaaggaaattcaactttttctcatcgtcttttaaataccaccctatgaaggacttaattaggattttttttgccaatgagtcatacatgagctctcccatgacattttaggacgccacatcgtagggctgacgtgtcacctgaccgtgttgccttgccacctttgttcttttctccattggtggcgccattgccactgccatcctcttctccatgagtggtggcagaggagagggaggtggggagggagctacagcggcggctgacgacaagaacgaggttggcactagtatcagtggcttggacttgagcgacggccaagacaccattgtccatgctcgatctaggcatcgccgccagctttcaggcactagcttgagaaggcaacacccaggcaagctcacatccacatgcaaaggagctcgagcaagtaaagggtgaggtcgcgtgggcgatggatctgaagcaagtggcgacgacactacctcatgcaaccaacatcagaggaggagctcatggtaatcgtaggactagctccggctcaccacattggattcgcaactccacctcaactgaggttgtgatctcactgggctcctcacacgttgtagagggtacaggtgccccgacaagcctgaggtcacttgatggtggagccatggtcaccagccgtgagagacatgtctctcgtgcaacgcgtgcagccctcccctcccccttcacgttatttgttggtgaggcatctagacaatgggaggtagatctgaagaccagagagacaggtctagaaggaacataccaggaagacccctattgtcgccatcactggcgggtgagatcgctggccagacacacccctgatccacatgccaccctgccgagcttcttctacgccagatctagaagggcatggctggcttggatccaacatcgataaaagaagattgacgcccaccatgactacacaatgttgatttgcattgttggaggggctcggcggtggtgcacgagcaaatctagacgatggaggagctcataggcccaagccgttcaagagggttagacgatgacatcattttgaaatgggacaagttcagtaaccgctgcttttgatccacacccgccacgagctcgtcataatggcctaagagtagagaggaggcggcggacctcatcaccggggagggagagttggcccatgggaagggaagagtggacaagtgaggtccgaggagaggagagtgaagggcaagagagagcttgtgtttaatgtaaggcttctatcctaattgaaagatatcctaattgaaagatatgagaactaaaatagaaagtgttttgggtggcatgaaaaattgatgccacccttaggcggttaaaccactttgtagtgtgagaagagcccatttaaaccatgtgcttagcttatgtggtattatactccattgtgaatgacctgagaggtattgtgctcgtcacaatcgtgacgtattttccattctatgttacataaagtctatgcatatacgaactgcacaagtttctcgctgaaattaagctagcaagtggttttgcatcgaggcatacaaggtaccccgatccgtggtgacgcatggctggttgtgtcatcgtgcaattgggaaatgtattcgcgctttgacagaacaacttgctacagtggggtggggttgaaagacaaaaaggtatttctcactttttagcatttcatttaccaatcaaaacgcagtggaaaaagtacgaattacccccccctcgaactatcgcggtcggccgaattccccccccccccccgaacccgaaaaccagacatgattcaccttgaactttcaataccggacgaattacccccctcgacccaatctagagcggttttatcctacgtggcgtacgcgtggcatccgagtcaacattttctttttttaaaaaatgggggggcccacctgcaataactttttttttctttccttgccctttattttctc

SEQ ID NO: 69369 - DNA, 2299 bp, Oryza sativa
  unsure (1)..(2299): unsure at all n locations
tcgcctccactcccccactccaagcccacctccacgccaagaacgttcacgcaccacctcgtcgacctcctccactcgccgctctacctcccgcgccgcctcaccatctcggacatcgcggtgcaccggtggtcgaagcgcaccgcggtggcctccgcgctcctctccccactcctccttgccgccatcaccgcgcgtcaccacaacaaccaccctccagtcctcctcaccatctcgctcgctggcgtcctcctcgccgccgccgccgcggccaccacggacgccgcctccccacccaagagccgctcatcccgactcccagcgctctggtcgtacgtgctcgcacgcgagctcgtctccctgctggtctcactactagaaaaataatttatcgccacgaaaaaaaatagtagcatcaatgctaaaattgtggcaatagatacacgttgctacaatcttaaaatcgttgctagccgtggtaataaatagcatggtaataggttattgcaacgatttttatttagttgtaataaaatttgatattgccataaaatggatgtggcaaaaaaaatatatattgcaacacgtcacatggttgcaataaataactattgctaccactccatgtgtggcattagttatacgtagcaaattaaatgttttcatattaatttatcatcctaattattttcttttgatatcttgtcatgtccaggatccgaacccaagatctctccctcacgcgcgctctctatgaccaactcacctacgcatcaattttgtttaaaaatgcatacaattccatttgagactacctaactaagatttgaatcatgaatttgagtatttaaaatatttcaaatgaaaattttaagtcgtagatctcatcgagagctataaatttcatataaaatttgtcctaatccgtgtccatatgaaaagaataagtcaaattacgagatgataaattttttattgcaacgaatttattgatcatggcaatagaaaatagtgaaaagtaccatgtactatgcaaattgccacaaaaattaaatgtgtggcgatagaacatgttttttgcaatagtaatgttttttgtggcgatagctcatttcctattgcaacaaaaatactgaataaaataatgattgtaaatcgttgcaacaaagtatagttatttgccacagaaaaaatatcgttgcgatagtataatatattgccacgaattgtttttcgttgtaataaattggtggcgatagctcaattctcttgtagtgtctccatcggcgtggcggccggcgggctgggcgcgacggtgctcgcgtgggggaactcgcgtcccacgctaccgccacgccgcctcggtgtcccgcgccgccacatcccacgccgcagccgctgccgcctccgcatcccacgctgtcgccgccgccgcctcggtgtcccgcaccgccgcctgccgtgctcgccgagagagggggagagagaggggaaggagagagagatagagtatatgacaggtgggtcccaccatcttttaaaaaagaaaatgttgactgggatgccacgcgtacgccacgtaggataaaactactctggattgggtcgaggggggtaattcgtctggtattaaaagtttagggtgaatcatgtctagttttcgggttcgggggggggggattcggtcgactgcgatagttcggggggtaattcgtactttttccaaacgcagttgtggacttgtggtttgtggctttgtgctcacccatggaagacgggatacgggcgaatatcacttttactctgtgtgaaaggttgatgccgatgtgtccggccatataaacttacgctctgcggtgaaactaaagaaggtggcgatggacagctatgtgcagtctgctgtaaaaactagaaaacttttcaaagaaacagctctctatatagtccataaaaataatatggcatttcatagctcactgaaaatggtgaaagaatcaagagtttttgcatgaaaaacgatcatggccccataattttagaattgcatgtggaattgtgaggatgttcggccctaatatccccccgggcccgattatggtgtttagtgttcacgtagagaanagtccacttgtcattccctcaatcttttctattcaagtttaatggacatccccaaactataatactagaaatcctcatttccaacttataaaatcgggtaaactatggcctgatattaaaaagtattaaacgtaaattactgacaaaacccattccataacccctaggctattttgcg

SEQ ID NO: 69370 - DNA, 24318 bp, Oryza sativa
  unsure (1)..(24318): unsure at all n locations
cattactccgtcaaggtgaccagcgacgtccgtggccacgtgcacacttcaattgttgtgccatgtcacatcatgcgtgcgtgatgcagagcggtcccgaccgtcgccattcccgccttccttcccatgagcgcacgatcaagctcgacctcatgggggcgaactatcactgcaccacctcctccatagccagcgccttgctcgagctctttcatcttccaccacgatgaagatccggaatagccccgccaccaccgggggtagaagtttggccgctccctgatgaatgagaggtgggcgacttcaggaacgtcagggagggcatatccgacggtggtaggtggtcctcccgtccctaccgccagccgatggctagaagggtataaccgaaggtagcaccggtgtggcaggaccacccaaggcagatggcggggatgcgaaagggattgcgggggtagacatcagtataggaagggataccaagggcacattcgatggtgtgctggaggaggcgacgacttcgctagcgagggcagggaggacttggatggggtgggtagtggcggcaccaaggtgggatctaggtgcaacttgccggcatggagttgacaaggcgaagagaagggaggagaggagtagaggaagaaggtgaggtgggcatttacatatggccccacatgtttttttagttttctatttatttttttaatatgatgccacgtcaactagaaccatccatacacacgattttgctaagatgagatgaaaggtgaagttttgtcgtattacggtttaaaggatgcaaattaaactttacgtaaagtgggcttatttctcacgtttattccgtgcaacccattcggcccaacttccacttgctcgtgccggacggccactgtgcctcactgccctgtgcttgtgcccgtctggttggtgtgtagtgctatgctcccagcctcccacggtcccaccatatgctcgcagttttcttccaacaactgatggcatcgggtgcggcgggtggcatgcagtgcatgggaacgcatgcccacggtgttttcagttttctcttcgtgtgtttgtgtactccgctctgccggcgaaaacaaacatccggatgtgttcggcgtcccatcactgctcggtcggggtcaagcagggcaggccgccacgatcgcgggcgtacgcgacacggcccgacggtcaggccgactcaccggccacgcacaggcacgcccggtccagccccatgccgcgcccatgtgccgtcgtctgactcggccaggcgcgcagtccggaagctgcgccgagctccacaaatccaatgatcatgataccgtccgcgatggcggcggcgtggtctcgtactctcgtgactctctcacggcttgtggttttacgtgtgtttagtataacacgccgccgtccacacggcgtgactcccttcctgtcaacgcggtcagcggggactgggagacggttaactagcggtggtggcgcagccgctcacgggttcggagaagaaaagtttgagaggaagtaaaaacaaggagaacgtcgttaaattgccaaaggtactacctatatatttgtcgataaattttcttctaaaaatttgacagatataattatagtacaatcgtagtataattacactgtaacttgtatgtaattacactgtaacttgcatgtaactacagtgtaacttgtatataagtttcacgtaattttgaatcgttagatctattacaaaatttgttctggtgaggaagaaaaaaaatcacatcatacacatatgtgaaagaatttgttctcacaacctccattttaccgaaataaatgttatggagagatttttgaaagttacatacatgttacattatagttacagtgtaattacactacgattatactataattacatctgtcaaatttttggtggaaaatttgtcgacaaatatatagcatattcgattccaaatggcctcaaaacttctggctggattgggctcaggcccaggacggtctattcgattccaaacgggcctccacgcacgcttaccttaccttgatcagatatcgttagaccgatatatattactcacaccacagattcgtctctcattctcttgtagagacaggaatacttcttacatctcccagtcccaagtaatacgctgtactacacgtaataaaacaacagcataatgtctagctgtttaagaaaaaaacactcaaatcacaactggactaattgcccgacacacggaactaaaatctcagagctagcggcaagcaacaagtgacaacctgttcttgctcagcattgggcccttttgcccttacctgaagaatttcgagcaggacaatctgccccaacctgattcctttgcctgccccactgatgagacatgaacaagcggggggtgtctacggacaaacttgctgaaatcttggcttgcatctctcttctttacggacaaaaagttatcaaaggacagcatacttggatacataggccgttgggaacttaatagaatatcatgattcatattctcttctcttatcatttgcgattgagttgcggttgcaggagcagagaagattccaattgctccggttgctttgttcgtatgcaatcctaggggccaagacccaagagtggattcatgtaccagtgatgcaaaaagaagaaaaagaaaacaaaaggggctatgtttctttggaaccgccagtgttggatccatctaatcctgaattcctcactgatgttgagatctgaacgccgtattggcttcatccgcagatgacaaaattagcaaccagtttaaatgctcttggtgggaagaccgttcgggatgttatggatgtttgaacgcaacctgccatgttggaaggtttgcctgatcattgcctatgtcgatcaagaaaataaaattgtaagagcaagtataatagtaggttataagccggctaaatgctgaggtggaggagagaagagaggagagagaggagaagcgggctgtaaacttacagacggtttggacacaagaaccaaaaaactcagtgagagagacaagtggaccatgtattaattataaagagcaaactattatatagttaggttgagagaaggctacaaagaaccttatagccaacatatcggctgtattattaaccttgctataatgctaattctagcatttgggattttggtatgctcttgatgactcctttaccaaatggcatctcacacatcgatccacacgaccttcctgccttcctgactagaagcgttacatgaaatcattttgtccggttagaccaatgccaacttgtctaggtccaaatcatgcatccacttgacaaaacccctgatttgtaggcagtaggcacaatgagtatattcacctccccacatttctagcatctggccgtcatggctttggactaaacaaaccggcgctctttcctgggaaatcacccgcggccgcggcgcatgtggttgcatgcggccaaaattcggcataaagctcgtgctgttcttgtgcaagtagccaagtactcctcccaacagtatacactatacagggccatgtggaaggtagcctccacacaccatggtaaaatctccaaccaaccaaccacacagttcggttaagttcatgctcttggagctttgcattggacacgacaaaagaaattgaacggtatttgtagcagacgagagccagtgatttaattttgaagcaactaatttacaatatctactagtctaggtagacgatcatcacgattcagggcagttaagagcttctcttgtaaaggtgacatctgtagattatgtgtacaccgcgccgtacgcacatgtaacctgtgattaaagaagatgtggtacccagggctgaaattataagcaagaattttcaatatgtctggccgtgctgccgtcagttaattgaagcttcgtgtcaacttcagcaggaaattagatgcatggacggtctgtgcgatattcgcttgagttttcaatgttgcgtgatttagcatgggagaatagctactttagtccctaaagtttttctgtaggatcagtttagtccctaaccttttaaatggtccaaagaaattcttaaactttgtcataaggtctagaattgtccttgggtccaccaaaattattatatggatatgtcatgtcatcattcatgcaaaatctatgatgaattgtccaatttacccttacgtatatcgtagaaaaataaatataagggtgaattagacataaccataggaaaaaatacttatcctttttttcacccttttgagatatattttgctcttacattttaccttttgttttttattttcctatgatatatgtaaggtaaattggacaaatcatatagattttgcataggaatgtgacatggcatatccatgtggcgattttggtgagaccaaggactatataacccacatgacaaaattaaaggacttgtttggataatatgaaagattaaggactaaaatgacccaggaacgaaactatagggaccatattagctattctcccatttagcattgttgcaggtgttgcacatcaacagatagccggttttcaaatggaaaatcgatgtggcaggcttttcggctacatgtatggacaaatcttgttgcccgtcgttgttgattttacttagaaaatgatacgtttctgttctttctgagattttgttttcattgattccagctttatcttgttttgtgctagtgtaagaaaatttttaataggtttaaatgtaaacgccgggcttgaatggagcaagctcgggctggggcaatatattacatgcatcatcacgcgtagattatcccatgcgagcgatgacccggctccggtggaccagttttttcaggcggcgtcacttacggtccgcctggaatcaaatatgggcctcgtacagaaaaaaaaatatttctgtagtagtgccaataagaagcctaatacgtaataggcaatggctttgcttttactcatctttcttcagaacatatataaggtaacaaattcgtttaatcatatggaagacacgcccgcatagacgcctacgatactacgcacatgaaaagcaaattttattggcactgattttccaacttatgcatttattctgtttgtatactcccttcgtttttaaaataaataacactgttgacttttagatatatgtttgatcatcttgtttaaaaaaattatgcaaatgcataagataaaaagaatatccttaaagtactttcaggacaaaataactcaaaaaaactaataatgtaaaacttttaaataaaacgaatcgtcaaatgtgtgttcaaaagttaatgcattattaatttaagttgtggtttccattagtactccatcaaaatttattcgtttttaaattcatatttcatggatcatggtaaaccacaagaatacatgtagctaaccttgctttataattttgatggcaaagaaagcataactcaactggttaagttacttgtggtggaaccaatccatctagattttaagttctggacttgatatgagtgcttatatttatggctaattattcttgcagtggtaagcgtcgtattcatcgatagcgagacatccgtggtggcttcgtcaatctcaaaatatattgatctagtctttcagaggtgttcatagaggtagggtatgtgtggacgtttataagagaaagtgcgcgcgttgcgagcatgtgtgtttccaacaaaaatttatgcttgataacacatattatatcgattagtgtgaaagtgttttaatggcctaatatgcatcatgggttcacaaatataaacaggttcaagccaattaatgttcatgttggtccccatgatgaattgtatcttggtcccaagcaattactaatctgtacaagctgattattgccaagtttatgaccataataacatgtttgcaacatggtcgtttttttatgccacatttctcttttgctacgaagtgaaccaatcggtgccatgtttagtggactcaaggctccataaagtgatataatcctgccctagtcatggatccacggttccaccgatgcatcatcattttttagacacaatttgcactgaaagaccatgatccaacttcatctgtgaaaacctttaaacaaagaaccaataggatcaaccaaaaagataaatcacttttgacaaatccactctaattaattaattaatttcactgtccttgtaaagacgagagatagtataactcgatgagatgggttatggccgggtacatgggctttcattccaccaaccagttttagtgggcatgacagggcgatgatacagacacaatcttttcttagctgtccctgtatccaacatggcacaggattgaagattggatagaactactttagggctgatttatatgctgtttgtccagagtgtgctcgcttggcaagcacctaacctaagtttaggttccaaatacttaattaaagcttgacctaagaagaacccctcaatcgaattaatacaagaattaatggtatgaatttcatggaaaaatagttgttggggcacttcttttcatatttatcatgtcacatagcaacaatggtgccaaatgtcctccttcaaacaattgataccaaaggtcatcctcttaatttactctatgttcttacatcaatttttttttaattctagatgacacctcatttagtcccattgacactagttgcctaccttggggcttgccgaacaccccatagcatcgaagcacccccaacagaattgaggccagccagacgaccgagcaaagctccctcaccgttcaatcgctgttggtttgcatcatgccggtcggcctgtccagctgcacgctcacgtacgggcacttgttcccattggtccaacgttacgatggtcgatgatggctacattgcccccgcgatatgtcgagcagaggcgtgcagcgcgtcgcagattgagacgtgcggacgaatctgtggcgcgccgcgcgcttacgtgcacgagtgtacggcacggggcggcggccctgctccccgttactgtgcatctgtaaccggtacgatcgagctactcaccgtgctggcagcatgcgtacagcgtaccatatccctcccatccccgggcggctcgtggatcagcagcgtttccgtggcctcattgaccctgcatgcatcatgggctctctgatggcttaagccgtactgcttctactactactactaccacttggtgtcacggtattgggcatgcttaagtattggtaatgacgatgacgaccaccattggatccagttttttttttctttttttgaatgtttttggaaccggggcggaacgatcgatctggatctcatgcctgattgaccggtctttgtatctccatgtgcgagcaacggtcctgctggtggcgcgctcagccgtacgtggaatctaagatatggagcacagtacaaatttgcgtggtttcagggtgcggcgttgcgtgcgcggtgcgcccacacttgagtctcgaccgcgaagggcacatgccaccgatgcaggcactcgctttttggcccgtatggccgtatcagttttaccctttgacgcaacggcaatagaacttttactacgagaaatacgcaagtctgcaatgtagattactaccacggaaatgcactggcaaataggagtacgatgtgtaactgttttttgaggcaaagtggtggctgcaaatctgcaatgctcgagtaaatcggtaaagcaaagcgagtaaaaaaaaactagtactgtgcatattgtgggcctcctttcgcctttgggtgaggatccctatgtgcaaattgacagaggacctgacactgtcagtgagggcacctgtctttctctctttctctgttcggcggaagtttttttttcactttctttccacgcgcgctgccgaactcgtgactgccgttctctctcgtcgtatcttcactcaatggcaggtaggccccactgtaggtggacctacatgtcatgcacgtctagagtgagaggcgagtgaatcacccccctgtcatgccctgtccttcaaggttcccgtgtgcaacggcctgtacagccgggcatcgttagatttctccacgggtgacttgacttgtgcggcgggacctgcaaaccgggggcccacatgtcagctgcagcgctggcccctgggtgggcctcggggttgcagcgctggccccgtgcttttggccgttaccgttacctcgaacgcgccccgaggaggagcgcctttcggccgcgtccccacctctacctttccaggggcacgcggttgaagcctttgctcttcgtcgatgacttgtgggcccggaagctataaggccccacgttgtcagttcgatgccgctctacgggctagtgggcaatgcgtatatgaaaagacgagctttttccttcgggctccggtccgaccgcgattcgactcgaccagcccacccacccaccggccggcgcatactgtagtcgcacggtcgtttcgccgtccaaactcccggatgtacccttggcctattcttttcttgtactagtgcgagggtttcctaaaccaccgggccggagttactgagccccggcggtaagcacggtaaccgcggtaaccgtaaaaaaccgtatgaagccgtgtaaaatttattaaaaatttaaattatttttaaatttatttgaatttaaggaggttaccgcggtatttatattaccgtacccccgcggtaagcccggtaaccgcgcagagtcgaaccatgactagtgtaccggtgaggacaaatgcgctgatgagcctctcctaagtcctaatcgacaactctcctaattactctgcatttttcgtgctggtactaccacagagtcatacagacacgtagtgactattggcaaagcattggcaaagcataatgagcctgatgatcatgttaccgacggtaagtcgaaccatgactattgtaccggtgaggacaaatgaaatcgacaactctcctaattactctgcatttttcgtgctggtactatcacagagtcatacagacacatagtgaccattggcaaagtataatgagcctgatgatcatttagggggaaaaatggacatttttaatctgaaaatgtttcttactgaaccagctgctactactggacatggcattggatccgtgattagtggaggtactgctgcgactgaaaggtgctacagttcaatagttgatgctgaacagtcaccgctgggtacttccttttaggtggaaattagcaagagcaagctccgcgtgtgtggtacatctgttgatagctgtacatattttaagtaattcgagatttaaagttgtaaatgctaagtttctttaatgtgagaacatgaaaacaaatagaaataagacaataatacacatgcaaaataaatgactagtaaacatagaaaaaaataattataagaatgatcgtttggataaccgacaaggaaaaaaatgtacgagatgttaataattgagtcgagatttgaaaagatagacgtccctctaaactttttttaagcaaaattataagcgtgttgaggatcgaatatggaaccttaaattgaaaccatgtatctcttgtcactgcactatgcactatcaagtgcatctctaaaaaaaaccacagagccaagaattgtttatttaatagatgcaccctaagcccaagcatacagaacatttgcgctttgcttcaaacccaaacaccgaatagaaaaaaaagagctcaagatggatgctagttttccttcgaatttccctaattcatgccaaaagaaaatttcccacgcttttcttgtgctccaaccctacaaaaccaccggatgaacagtagcacttcacataggattttgttcatacgtatttccttcattaaatttcctcctacaactaactcacccagagctacaactaattaagcattttcaaaggagaaaaatgcatcaagctagaagcatcgcacaagcctgagtttgaatcccattaaacacatattttcttattaatgattgaaaaaaaaagaacctgttcactttgatgaaaaaaaaaaccttaccaaaatttggcaagatgccaaaatttagtaacttgccaaaattttggcaggatttcttatatagttactaaaatttgacagcaaactaaggctgagtttgagagaggggagatagagaagattggggagatacgcaaaatgaggtaaatagagaagattggggagatacgcaaaatgaggtaagtcattagcgcataattaattgagtattaactattttaaatttcaaaaatggactaaaatgattttttaaagcaactttactatagaaatttttttgcaaaaaacgtaccgtttagtagtttaggaagcgtacgtgcggaaaacgagtcacaatctccccaatctctccccgatgtccttcgaaagaacgcaacctaaatgtagccactcttttttggcaactttaccaaaatttggtaaggttgaaaacggtatcaaagtgaacagggctgaagattatgagagtgccaagctataagttcgcaaacctttgtatcttgctttggaatcgactttcagagctataattggactggatgaggtaatcatgaaagaaaattgtgacacttaattatcaagatcggtagtactaatttagtattttccaatgagcattaccatcgatgatctaaaactccaaggtgccaagctatcctgattctcgtacaattagtccattgctttaattaagattcctgcttcataccaatcatgcaatctcacttaaaatactaacctccggataaataacaagaaccattattcaaactaagaaattttctcaatccaaatcatgctttgccaaccaatctctgttgaagcctcagacataaactatcacccggaagaattattgttaatcatgaggggcagcctccagcttagctgtcctggaacagtggttatgcatccaatccgaaacattatggagaccagcggtgtcagtctacacactgacaccacggatcaggattaaacaaaacctgttcaaacgcatcaaaaatacacatcgaaaagcatcgaaaacgagacgaaaaaaaaaagccctactggctccaacattatgaacagaatacggcgatacactaaaccatacagtacgtgatacgccacgggagcaggggggaaatgggggcccaacgcgtgaatcacaccacgctggatgcggggcccgctcctctggggtagccggggtaggcgcatgttgtaccgagcgatgctggagccctggcccgcgccgtatctccagtggagccgtgtggagcggggctggccgagttggccggccatggcaagaaggaagagcagtggatcgatcgccgagacacgagcagcggacggccgcgatcgcgtcgcgtgcagcgtgctctgctttgccgcgatcggcatcggcttgcgtggccccccgtcccgtgctgccgcgtgaggcggcgaccgtgcgggccggcggggcactacgctgttgctgccgcgctgcggttgccggccggccggggtccgtgtagtggtggcagcatcggatgaccataggcacagtaggcgataggaccgcctccttttgccgcacaaaggcgggaaatcctctatcttcttctgataagttcggtaaaaaaaaaaacttctggccagtttactaccacttcgctagctctggaatctcgctggagaagagggaggaggagtttcaccgaagaggaaatagtagtgggcacgtgggaaaatctcgatagacaacggtggaaatgccactaggattagatttggaacttgggaattaaaacagagggaatgttgtgcattaatatgatatgaaatcatttacttcccgtgtatttttgtcaataatggtatctgtagagttcatttttttatctggtatttccttgcacaaaatggagtttataaattataaggggagccaggccaaggtatgccttctagacatagtatttccttgtttcattgtttgtattttaccaaagtacaagtatagtagtacgaatattatgtacaactctgaaggctgaacttgttgcaagcagggcttttctgcctacagagctactacgtgtatttttcttgttaaatctacacacatgacacacctacaaagcaacattctgttgtaactgaaaacccctatctgtccaaatgcaaaagcctgagcctgctgctgtgaatgacagcaggatggacagaaaaaaaaaaggaacccaagcaacaacacaaggaggaaaccagaacatgcagacaacacaagcaactggctcctctcctctcctcctaccgttcagttagcagagttaacaatgtgattagctgcgtactggaggactactactagcggacacaaagccccactaaagtattcattcgttcacaattcacaagccgtcaagcactgtgccattatccccaataagtagtactccaccacgccttctctcttcttcctctcctctcctctcctccgcttcacctccgtttctttcatcgtctatctctttctccccaacacagcgggcgaaccaaatccgtcgtctcgccggggtccgggaccacctcgtcgcatgcgcgctgggtcgtagacttggccgccggcgatcgccggagttggggagcgcggcggcggcggttccgctctcgccggagcgaggggtgggtggaggatggcggcgggagggaaggggtgggtggagagggcgcggcgcggggtgaagacggcgtggttcatggtggccatggtggcgtcgctgctgatggcgtcggcgccggcgctggtggccgccggcgacgtggccgtcgcgctgtggctcgaggtgcggctcgggtgcctccgctgccacggcctgcgcggccacctcgagcgttacggcttccggagctcgctcgtggacataccgcttgtctccatcgctcgatccgtcgtcattacctgtaagcagcgactagctccccctcattgctgttctaatgcgctcgcaggatattggggaatctgttcgtatgagttggatttcttttcatcttctgagaatttttgtattggttatgtgtgttatttttttaaatattctaatttcattatattttgggatatgggatttccctcaagattctttatttttttcccttttcgtatggggatttgtccatctgaaagctacagttcttgctacgtccgtgcttgtcttcattcgtagacgaaaggatgaaaactttcgtgaaaaaaaccgtgtctatttctaaagctattaatctgatttcgtatctgttgcctgctattcttttcactttccgtatttgaattcagttaaatcccgtcatttgattcgctgaattagtaatagatttgctgaatctgttgcctactatttcccggcagtttgaagtgcgcgccaacaaatttccgcactcggatttggggagaaaaactacgagatgcgactaacagatccgatgtttgctcgtgcaggtgtatacctcatgtctgatgcttctgggctctcccatggcccgtaccttggaacagcaacttgctgttccctggcttctctgctcatcttgttgattaaggccagcgtttacagtccggcgcaggagattgggcctgagctctcgccgtcattggcggatcacaagctcagtctcaagaagctatcgggaatgccggtgcttttcctgtcctccttggtctttgctcttggccatgttgttgtcgcttacaggacaagctgcagggctcggcggaagctgcttatccatggcattgaccctgaatctgtatgacttacatccgtttgccttctaaatctcactaagtgatcaattgtagaaacagggccatgtatgctagtattttcttgcatccgttgtgcttttcttttgcaatgtttgatgttttcgtgggttgtgctgctttcagattctggcatacaagaatgcatatcctggatgctacaagactcctcgatctcccacaccatacagtggaaaattttattctaggagtgacagtgagacgaagagaaaatctgttgctcacgacgatagggatattccaatcagtttccttgcagacggtgatagcatgttcattgcttgccaggggatcactgtgcattacaaactttccgatccatcgagttgcatatcttcagctacagacacttttccagaaatccatcatgatgttatttcagcaagcatttctcctagaagacagagacatgatagcccaccatcagcctccactaatacccgtcgtcttttgaataggagcttcagccatcaataccatcagacatcgctatatgcaccattgttggtagagccagtgacctctccaactttgtcggatgacacccctgttcttagtgttgatgatggcagtgctgatgtatgtttgaaacctatgggatttgatcttgaggctggagaacaggggaaatttgctgttgttttggtgcatgggtttggaggtggggtgttctcatggagacacgttacaaatttgctttctcgtcaagtgggttgcactgtgctggccttcgatcgccctggatgggggttaacatctcgacctcgcagaaaggattgggaagacaaaaatctaccaaatccatatgagcttggatctcaggtgattcttcttaccatatactagattgcgcactgcccaatagcagcaagtgcttgcagcacttgccctaatgttctttgcactagctactagatatgttgcaatatcccatactcattccatggaatttgttataagcatgactgactgaatgtaaatatgttactgcatgtgttttctcttagaactatacttatctttgggattatgtcttctatgtaccataattctgtgtgacaacagcttttccattacaaatagttgagtacaatcttctgaagttcttttttttccttaggtacatcctatcttacaaatattcatctaagggaatgctcttctactgtaacaactattaatcttttaattaatattactatatccagttatgtttgcaacatattttccggcagcattaacgctatatttcttcgctgtacttggaaaactcagaactttaagaacaacgctttgtatgccttctgcaggttgatcttcttatttcattttgctcggacatgggcttacgctctgtggttttagttggtcatgatgatgggggcctgcttgccctaaaagctgcagaaaagttgcgagcatctggagattcaagaaaggtaactgccttgtgaccttctgttcatttttcttttgtgaactttagtagcttatcagactgtttgcttgatgaaagtctatccttctggtaataatcattttaaatgcctccttgttttttcttaggttgaagtgaagggagttgtgcttataggtgtaagcttatcaagagaagtcattcctgcatttgctcgtatactcctgcatacccctctaaggaaaaagcacatggtacggccactgttnnnnnnnnnnnnnnnnnnnnnnnnnnnnngacgtgcatggtttgatgctaccaagttaacaacagatgttctgaacctctacaaggtacacacttttaataattttcattcccttcagtgtgttgtcaaaccattagtacgcaatctatctctggaagagtttggtcactaaaagcacatagggagcgttatatcatttgcaaataatctatttatcattccaccacatattgtctgaatgcaaggaaagtggaacttttcttgcatgttgttagttatttattgtcttcctgttccttgatgctaaattaaatgttttaacatgcatcctttcacttattctgtgaacatgaactacgaactgacttgaaatgggtttttacatttaggctccactatttgttgaaggctgggatgaagctctccatgaagtaggacgtctttctttctcgactgtcctatcatcaaaaagagcagcagatttactaagatcagtggaagacctccctgttctggttgtagcaggctctgaggatgctcttgtttcttcgaagtcaacgcaagtaatggcttcaaggcttgtaaattctgtaagtaatcttgagtccctttgcctcagtatagtgaatctgcttctgaagaggactcttgcatgatactctatattacttccctgttagggttactccatacattgtgccaatgagttcttgttattttgcagaggctggtaacgatatcaaattgtgggcatttgccacatgaggagtgtcccaaggcattgctttcggctctttctccattcatatcaggactggtgtcatcagatgattcattgcaaagattgtagcatactagttcttttcgttttgccttttgccctgtctttctgtcctctacactgagtagatctctctagttggtgtgagtttgtgtgagccaatgtagtgcagtagtggagcctgacccaaaatctcaagggttcctagagctcctctaattttttgccccatataatgatacctccgaatgatttcaattaagcaagttgaatctgtacagcacaggcttgctgtgttcagttcatgtctactccagctccagctgtcatatatcagctaactactgactactagtaatatgcccgtgctaaacgctacggtgcaactctatttgtctttaataatttttaaaattttcatgtttagcaaaaaaatattattatatgaactgtgcatttgagctttaattcaatttatatcatacatcaaatatgttgcaagtaaaatattagaataggatataccaatatatttgtgccccatgtcataatgcataataatatgatattaaagatatatgataatgcatatatctgtgccttaagatgtatgataacgtgacagatcaaaggcacttaggttgagtattgcatataagtatttatcatgggtattttagttgttaatgggccattacaggatttggaccatacacataagtttgacatctagcagtcctttactcctttatcatgactgaataggcaacataatagcaaattagcaatactggtttcttatgttaattatatttgctttttttatacgctttcatgttcataaatcaatattcatgtgattggtcagctctttaaattaatggagccctgaagcaaataaaatgtgtttgatctaaagcaaagaattacatgtgtttgatctaaagcaaaagaattacagaaatcaatagtgctacacaacgtcagaaaattggccgacttaatttatttatgtgagatctaaaccacaactggtgtgtgatgtgtctccttatataagaagacatggaaaacaaatataaaggaacattgctatgcatccaaccgtgccaaacaaatacatagtagttcaacaggaggtagagcacatttgtataggtcccagaaatcaactcaatcacaaacaatactgaataggcatcataacaacaaagtttcatcgaatttggttgtgcatttcacaagcaatactgaataggcccgaacgacattgtttactgaattttcttgtgtaattcacaagaaatgttattttattctaaagccaaaacacagtagtgataatactaaatcatggttccttctcggttgcttcatcggagacgtcgtcattgcagatcttcattgttatctcgatgggagaagaccagcgaggatcatacccttctcccaccttccttttttcaccgtatcctttttctaccttcttgcacgtgtagtcttccatggaactctcaacacgtcggcaaccatcacgtatgtattgaaacatcatcatgatggcattcgcgtggcccatgtaataattccccttgtttggtgtttgccctgacgaaggctgcaccttcgcatcatccttggagttcattgactccttaggtgtggcttgatgtggtgaaaaatccacatcatccatggatgccatgccttactacaatacagaagaagtaggagatcaataggtgcaaactaaagtatataataatttccaacacataagagatagtttggagaacgataccaagaaaaagattggtcaatccctcaaaagaaaatatggttggcacagtaatcagggcaatttttttttcttgatttgtaaaccggatgcaggcaattttaaacatcagattctacaacagtgcgaagattgacccacgaagtatacatttgcactatttgcaaggggtaatcattatggaagaaattacctataccaaatagaaatttagtagaatcagccaaaaatttcgttgattgtgcagcaaacaatagtagttgacatggtgtcctgtcagcctgaatttttcttcggcaatctgaattttcgtcctatagattaaatcatttgaaatgaaaggttaagtcaggttgctagatataagcaatcacatagaaaaattgacacaatagaattatctgaggtaggccatttcttccccacaattttacaatgaaagattgacgataaatgttaacaagatgtgaagtatctcatccaatgacaacaatgaaaccccccaaaaaaaaaaaatcctaccacacgaatgagattaacacatgaaatttagttgaaatgcaaaacaggctttgaattagagttttgcatcacagatatccatgcacagtgaacaatgtttgataatgaacaatgggggtttagtcaacaaaggggattcctaaagccattatgcatctctatgaacagcggtggaggacggaaaaaaaatttaggtgtggccaataaactaccacacgcgagagttaacacagaacaagaattaagaaaaaaaaaattcaatgcacaatattgtacaatgtaacattatatcagcaagtcatagtaacaagcacttaatcacaagttcacaattcatcatccatttgcaaataagtgtaaatataaaggtaggtactcaaaaatacctcaagattcactgattcaagctttcagccgtacatcacatatataaactaatgaggatagatacatatgtagaatctgaaaaacaaatagcaaagattgattagtttgataagataaaaagcaatgagtgaaacaaaatgtacaagcatcctaaaaataaaatatttaattgcaatttcagtaataaatttgtacactttgaaattgcaatgttctgaaattgtcaaataaaaaaaagtacaacctctttgtgatgccagtgccttcccttttctctttctgtccattttctgctgatgggagattgggcgtgatggcctgatggctgctactacttctgcttgccttgcttgctgcttggtgctgctgcgccatccgccctgcccctgccctgcttggcgcctgtgctgcacgcctgcgcggctgcgccccgccacgcgaggaaggtctcggcagctaccaggcgaggaaggcgtcggcggcgacgagaatcggtggcggtgagacgacggatgcgatgacggcggagcggcggcagtcgagggcggcggcgacggcggtggcgcggggatcggtggcggagatgacggatgcgaagacggcggagcggcgacagtcgagggcggtggctccgcgtgagtcggggttggggaggggcggcggcgcgtgagagcgatagagagggggcgaagaggagcgcgcaatcgagggaggtgggaggtgggagcgatctcaatcgttgagatttcaccgagacaatctggaccgttgagtgatgaatgaaagaatgagtgaaagtatttgttgaactatagggtagatgactacacatttcgacggagcaaatttcggatgaaatctgaacagctgtggcgagttggtgttttaattctttaatttactgaagtcctactatctggtagtagttcatttaccgaaaataacatgcccgtcctttgtgttactgtgtatctctgagactctgacagcattgggctacagagaatgtgttttttaggaaaaaaatacggttggtaccgtaggagtatgtatttgtgccagttggcagcagtatctgttttctatctttggaagaacttgttgtttttgggtctataacttgtgttaaattgtcattgctctttttgatgttacattaccatgtgaagttgtcagcattaaacatttcatacatgagcatgatatacaatgatgttccacagatgcacagacaggccacctcaatttttttttaatatagaactgttttaattcagccaaattttgttcaaataaaaaggtttgatttttaacccccttttttttgaacttttcattcatttgcccctgtcaaatgtttatgattctcgcaatttgtaagatttgaatttaggatttttaaaaattcagccaaaatttgttaaaattttaatttatttaattaaatatttttaatcaaaattttccactactagtcacgtgcccatgcgttgcaacgggaaaaataactttttaagaaattttatgatttatcgttgataaacactcgattctataacgccttagcaaaagcaagtaatatatgattattatgttttctttctttttgcgttgttatcggttgaactccggtagagcctgaaaagatcatgttcctcataaaatatggcatgtactaagcaagccaagacatagtgcactgaaataactacagattagcacaaatcaactctttgcaatttagctctctcaatcttttccaatgtcttatagggaaatttccaatgtcttgtatggaaacaaaataaacacgatatttatgtatatacatatataaattacagtatcatattccaaatggtcagttgactgtcaagtagcacaaggaacaagaatggtaactttagagttccatcatccctaaataatacgtacattgcctgcagagagttcagaagtgagtccaggagggaaaattatttcccgcatcaactaattagctctcccagtaaagaaattcaacatatggatttaccctggagtaatttctaaacttagatacaaaaatgaatagaagggccagccattgctgatttgcaggggataaagatggagagtgaagaacatggcattttcatcagagttagaggatagtgattactctgtaccttcagggcttggctagctaagatgataaagctaatgttgatcgtgaaaagatttaacatattgatgagcccatgtaagtgatttttttttacctgtagtcaccaaaataaaggttactcaaactgcaaaaacaaaattagcatattttatgaataaaagaaatccacaagaagtaaatttcatatccaattgaaatagtatgaattatcaaaaatatgatgtagctatcttgattcttgactctccatattgatctccgaagagaatgaattttgccttatcaaatttaaattccatattgatatcagattgcccagtacagtaaagtggtcaacaagcagcagtcccaaatgcaatgttaatagaaggtcaggtcatattatccttgtaaaggcctttgaaatttcatggcaaaaaaaagccattgaaattgtcactatgcgaaggaatagcaacagatggtataagttcagtacagtgaaaaggaaaatgcagagcagaacattctctgactaataatgccaaaaggagccccatcccccgtccagttctgcagaatgtggactatcaataaccatttcttaactgctaaatgatcactatgttccaaaaaatatagtcagtactattcgatattcgatgtgtgcataatatagagtgaattatggcagatgacaattagaaaatagagtttactatgcaaaggttgatacctatctggttttcatttaattcaaaaccaagggaaatagatgatcatacctggtgttataatttcattgagaagctagaaaagcatttgaaccctgtacatgtatcaagagtttagattaactaatgtatcaagagtttagattaactaatgtatcaagagtttagattaactaaagacagtttccaggattatacatgaccactaaggttcattcttttagacgtgtggaagacaacttcacatccagccaaatgatcaagaatcatcagactgaaaggctgaaacagacatcgcaggagacatcacaaatggtgtttatgaagctgtatagttgattaattattagttcagaagtcagaacaattattagttcataatgtgaccatactaaaataattattagcctgtcagttctatcatcagttagaaaattatatgtgaatatacatgttggttctacagtaagagaaaaaccatccagaataatcctgattaaccagatactattgtcctttggagatgtttagacacgtgcaggcagttatgcgttgttcatagacatgaatactttagttattactcctattatctaactaaatgaattcttcagtgatactaccacataacataccactaacacagaatgcattaccaaaatgttgtttttggttattttcttttggttgaatctcgtctgatcaaatcaacggcggctgataggggagagatgaagcatagtactgatggtggataaaaaaaaggaatgatcttgtacctttcggtgaatcagatcgaagcggggcgacattgttctggcagcgctgaggagatcagcaaggcgagggacgaggcgtttcgtgctgatgctattccggcggcagagattggtggcggcggagaaggaggcggacgaggaagaggaagatattgggacggcgctgaggagatcagcttggtgggcgacgcagacccaggcgactccgggcgatggtgatctagcggcgcggattggggagagtgagccaagaggcaaaagcagcgagcatcggtctcctggcgaaatggaggagatcggcaaaatagccaacggcaagcgtcggtcacccgacggcgtagtcgtggttgctctggcggtgcagagcagatcaacgaagcagccgagtaattagggttgggtagagagagaagggggaggttggggtgatgcaggaggggacctgtacggctgtacctatagagggagacggtggcgtcgaggacgaaggcggaggcagaggcgacggatcgacctccgtggcggtcatgaccggcggaggtgtcggcggcctagacacacataaaattagacacttagcgcaaatgctaaatgaatagctcagcacaaaatagcaaggttatgactacgagaaatagtaatacttgtgaaaagcattataattttttcccagtggtttaaacaggcagaagaaaaatactttatgccatcacatgataattcccagtggtttaaacatgcatgcacattagtctcctgccaaatcctgctgaacatagtacacaaattcatctaatgggatgccatttgacagaaaatatctccccagcaatcagctcagcagaaaaatctgagtttgatttgctagtaaactgcacaacattgaatgaaaatacactatcgacttacttataacaactgtgcacttaaattacaatgtgccaatcagaagagttgtttgctgtctcacacaaaatcacaccatttcaattcagttttcaaaattactctgaaatatgcaaatggaagaaaccctttatcaatctctgagcaggagtcaggagcaaacaaacggacaggggcagaacatcaagactgaaatcgaaacatggtaaaagcatgaaaggcatacataaaccatttctttctccattttttctaatgtttagagaaagacagactcaccgtatcaatgccaaaaaaaattcagcagatgccaagtgcatgtccctgaactcccgcttgattcctcctggatctaggtttcctgggattgaaaagtggcatttacatctcgtgatcaacaatatacagtacctagttgggggctttgaactgctgacgggggacagtagtcccggtgacctaggctagggatgaggcagcaatggccagttggggatttggcagcggcgacggtgacctagcagggggattcggtggcgatgttgttagctgtcccggcttcgatggctggttggggattgggcaacggcgacgga

SEQ ID NO: 69371 - DNA, 11301 bp, Oryza sativa
  unsure (1)..(11301): unsure at all n locations
tgacgcggcgtgacctcctgctcccgcgtcggcggtcgagggcggcgcgggacgtgggactcggggcacggcgacggcagcgaggagacggcgcgggtcgcagcgtcggcggtcgagggcggcgcgggacgcgcgcgcgggacgcgcgcgcgtggcacggggctgctgaggaggcgatgcggcggcgaggtgagaaggtgaggaggcgaggagatgacgcagggaggagggcgaaggtggatgatcgatccgatgcgaggtggaggcgcgttggagagggcggcggcgatcgcggaggaggccggcgggcgtggctggcgaggaggcgatgcggcggcggggcgagcgtcgcccagggaggagggcgaaggacgcggcgtgggaggaggaggagtgggcgtggggaggagatcgattcaagagaggagcgagcgcgtgatggggaggagattgacaccattggatatggcaatcggatggttgagattacgcgtgtctgtcagatgcgtctgctatgtcaggaatcaagaccaccactacgaattttttaagtagtagagatatcgttccccaaaattgtttcctacttaatataatcggttatgcagcttggtatggtggtaaaatcatcatttccaaaaattcatttctctagaggcaaagatgctaaaactacctccgccccaaaattcgagttatatttcaggataggggagtaaaacattccgtcagtacgtaactgttctgttccaaccgaaggttgattccatgagttaaaatcacccaaatcaataagtgaaggtgagaataataatgaagcactggtacattctttggacttttccttcaaaaattagaaaagcgtaaaactgtacatgccagcagatcaacttgccaactaaaacaaaaacaggctaacatcacaacacgctataacaaaatcaaattcttacgcttctctacttacgaacaccggacgtaacccatcaatttcaccatctcttcatggtggaataactataccaatgatttccagttattccttagctaaccgttggactccggggtaaattctatctcccctttcttggaaatcaacagtaaacaaccaaaaaagaaaaagaaaaaaaaacacacaactcctttactagctcttgcctttcatcttctctgcatcccattcattactgacgagcacaagatgatcgccgtctctgatgagctccacctcgtcaacctcggcgccctccacggtgagaaccttggttggcgcgaagtcgaacttcttggcgccgagctcgaggagcatgtccagcgtctgaggcaggagcacgagcttcccggcggtgttccctttctcggggcagctgatcgtcaccctgatgacggcgttgcggctgccgctgctcgggttcggggagccccttccccccaaggcccccctcgagagcgggtggtcgtctccccttccctgcgcgacgaaataaccccgaagagggagttctgaaaggtgacccgcttcctccggagcttctcggggagaacccggctgggcaggtcggcgtcttcgtggatcatgttcttcatcatgggctcgctgttgaacctcccgatcagtgatgccgccgccgccgccggcgccaccctggtggtggtggagcttgggacgtgatggtggccactcgccgtcgccgccttgcgcgaccggaacaggagctggatgtcgtcgtggccctgctgctcggcgagggctctcggggtccagccgttgccgtcctgcttgtcgatgtcggctccgtgttccagcaagagctcggccatctggacgttgccgtcgcagacggcgcggtgcagggcggtggtcccgtcccggcgagccctgttcacgtcgcctccgtagtgaatgatgtcgttgagcagctcggtgtcgctctcctccacggcgatgcaagcgtataagcccgtgtcacccgacgacagatccgcgccgccttcgactaatagttgcacgacggcggcgtgcttctcacacagcgcttcccacagtggaacttttccttctgagtctggaaaatggaaaagaaaatcgtggcatgtcagatggtgtattgaacatctgtatataagactcatcactcatggagttaattacatcgacgcacaaaacttttgcgtcttcgcaaaaactcatggagcaaattctattaagtaaatcagtaagttctagatgttagattggtagaaaattcaacaggaattttgcaagcaagtttagcctcgtaagatttacaggtgacgtgaggccatgacatattgcagggtttggatataacatccagctgttcataccatttaactcttacagttaaattgtacactatatgctgtcaaaattttccagttttcggcatacctctggcatttggatcagctccatattctaatagaagcctgacgcattgctcgtttcctttggaagcagctatatgctgttaatcatgaacatttgaaagtggtaactttcttggtcagcataagtccatagaaaaataaacaacacagatacgtatagttgactaaactgaccagtgcggtatgcccgtcattatctgactcatttggatccataccacgcttaagaagttgatgcaacaaaaaatcatctcctctagttactgcaaaacagagtgtaattggcaaatccagatttccccgagctagcatactctctatctcctttacgacaccagccattacactgttctccttctgctctttaaggaactgcatcagaaaaaaaaagagtggatctcagtactgctcaaaatactgcacgacataaagcatgataaatgtcaatgaagcaaaaacaaaataaacagcccttatccagatcacaacagacaacagtgaacatcaagtctgatagtcgcagaacagtcgacatattttttagataatggcagaacagtcgacatgaataaacaatttctgtgttcaagataatctagtggctatatgagggaatactagtttaacttcacatattgttaaacaagatgatgcaggttccagggtggttcgatttaggagttactacagagctagtttcagtggtcaggttaccactctgaatatgaaaaatctttctacaaatgcaaacatatgcgataaatgttacagagaagagaccaacaaataaatggtagacctgaataaggttgttcattatgatagttccatccccaacattggattgaacaatgctgagaaaagctgtacgattcaaacgcaacaactggcacaaggatcttgttcgaactgtgaatagctgaggtctgtagcaaagaaccccaatttctccaacaacctctcctgacgtagccacttgtatcacctgcagaattccaagttatcatatttaggaccaattgatgcacgagttcacttggaattaagtctcaaagcaacagaagtcttgcctggtctgcaccattttgctgctctactaactcctgcaaaagtgactcgaatttcagaatgaccatttatataactaaaactgatatcagtactgatagctcaattactcctactttttcaactgcactctctgaagcttagtattatatcaacttggaaataacaaagtagttattaaagagtattcttaccacactaccagaaactaagatgtagaagtcagtgggtgcttcattctgcaaaatcacatcctccctaggtggaaaatattcagctttcatctccgaaacctcaaaaacgaaatcaagtaaaagaaccagataagcatattctgtaacagtacgcaactacaaaaacacagctacagaaagaactctatccttaccagttgaaaaatcagatcatttgagactccttgaaacaggtaaacattttgaaccagatggaagaacagatattgagaaatgctagatttaatagctttaggcagtgaatcaaggatctcttgttgttgaagaccttctgaatctgtcctgtattttaagctaatatgtgaaatcatctgatcttgcagccgaggtggtagctgatttcttactccaaagcttgttgctgcttggattgtatccctcttttagtacaaaacataacaaacactacttgttagaatcaaactttaaaagagcagttagatgcaagtatcaaccaaaggttgaacaaaaagaactcacatagtttcgagtacgactagtgccatggacaaccaaattggtcatgttaccgatcaaataagcggtcaaaccaaggttaaagagcatgtagaaaatgttgaagatcatctcccttgtattttctgcatgtagatccccatagcccacggtggtaagagtggtgattgaccaatagactgatgttacgtagcgaatccataagctccgttcatggaaatctgccatgtaattgccaatccacgtagaagttgggacggggtacctatcagcaagaagatagtagaagcatgccgcacagtgcacagcaaaaagtgtgacctgcaatatcaaaggatgagaaaatgggatgttccacaaaaatgttaaaacttcacaggaaaataacataaatacagtcacttacacaaatgagctttgcacatcgaacccagaagtaattgaagtgtctatccttctccaacctagaaaaagtgaaaagtgttaagtttactacacaaattgaaaaggcaaaaatggcagtggctctagcctaattaatactatgttttaaccgagttcagtcaggttcagattgaaatgttggaccccaaaacagaatgtatatcatagaattttctatatgtgcacgataaaaacatacctagaaaacagagagctgactctgcggagacgccacagacgaagcatgttgaaaaatccatatgacctaagctttgaaggtagtatcctgcgagcaaattctgatgggatggtggaggccacgtcaagaacaagccatgtggtactataacgccatgcgatcttctttggatcatcttcaagcatatagctcattttatccaaataagccacaaagaaggtcagaatgatgtcaaccgcgaagaatgcattcaccacattgtcggctgtagctagagcccccgtaggcttcggaatgaagccaaattcaaatggtgagacccacgcagagtagactacaagaactatgaggaaagtctcccagattctgcatagtattaacaattaaatgttagaattactcattcttctgatttcaatattacaaagtttctatttgcttttcatactagcaaaaacaccatgcttacaaaggaaaaaacaatatattcctgtaggaagaagtccatattccccctaaaccatgaatgggagaattttattttggggaaatccttcccctacctttatttgcataacatcataatataatataacttgcggcaagaatgacaaaatacaaatatgtcatcttagtcattataagcatccaaatacacgaaaccactgttcaaaaatcgaaaccactgcaggggttgcaaactttagggagttagatgttcggttttaaagtttagggtattagatggactttcgttcaaagttccgtgatttcttattcctgtacaagtaatctctgtttattcaacggtactgtatatgtactggccgtaactcggtggcaagtggcaactagaagtaccacagaaactaccgtactacttactgtatactgtgtatacaagattatctccgaaagagtgatccgaagaaaaatggagattaatgtaatgcgattttatgatactatcaaataataaatggacaacagaactctcactagacaaaaaaatatattaattgaatgatagcacagaataacttcaaattgcagaagactgtcattgaggccgacaaaaaaggtaatctgaacaattcgtaaaaccaccaagtccataactaaaatacaaggttattaatcctcgtccgtccaacggcaaataattgcagtaaacaaatcagaaaaaaagttttccatgcgagttccgtgagagagctctttcgacaacgaagcattgcgtaaagaagcgcaaaacgggagtactagaaatccaggaacgtcagcatcaaaatcacgcttttcttgtcgttcctcaaggaaaagaaaatcgaataactaaataaagcactcacaagccatagaattagccatattaaaacggagataatgagtactataaaaagcaagaaatagacaaatcaattattcagtcgaggtcaaaccaggaacagtaaaaacaaaaacctctacttctcacttccgcgaaaacacattaaagacaatttgctgacaattgcggcagcaaagcagccattaaaacagagggagaaaaaacaaaatttcatgagcaacccatctatttcgtgacaacatataataactcattggaattaacaagaggcagaacgaaccaattcagtgccaactatgaatacaaaaataaagcacttctgcgctgaccatcaccaaaattaaagctgtaatgcagccagtatagcaggactgtacacaagagactgcgcaagaaaaaaaaaatctgaaacaaagcagcggcgagagttgtgatggcgatagggaagagagagacagagaaggttgcgaactaacctgtatcggcggtcgtagggggagatgatgaagcggcggagcttgatgcggcggttgctccgcgcgccgagcgacgggaggatggcgctggagatgctgtagtggctgccgtcccgcgacagctccctctcgagcgccgggtccccgccgccatggcccgccccccacggcccgcacgcgggcatcatcctgctgcgcccgtcccgcctcacctcgctggcctcgaacgcgtcgccggcgccgaccctccggttgcggccccacggcccgcacgccgccatccgagcggcgccccacctcgccattgcgctgcccctcggcgggcgcgcgtgcctcccctctctcgggtttaatggagcgcccacccccacaaggcccacaaatctggcggcctgcaagggaatcgcggggtgggaatctctcgccttgaatactagagagagaagttctcggtgattcggttttctggtaagtggaggagagccgacgcccgacggcggctgcggcggcggcgaagacgtgtcgcggaagaagagaagagaagagaggagaggtgagagcttcgatcgagcttggtcggggccacgcgcggctcggggctgcttttatggatgcgaggggagggggagagacctggggggtgggggcctctggggcggacggactgctgggcggcgacgaatcgggaggagagtctgaaggacggttttgcccctgcgggactggacgcgacgcggccgagccgcgaaccgggggtgacacgttttctggggaggacggcagaagtagtggggatgtcagatggctcggatccgccgggtcttgccgtaaccgtgccggtgcatgactctaagcagtacgaagggcaaatctggtaatcacctaaatgggaggcacctacccctacctgtcttacagaggatttgcctcatgaatatttattcgaggtttaagattaaaattagctgtctgggtttgtcttaaatcaaatattatttgatcatcaatttctatatgagtaaactcatactttaacatcatacgatttatatttttagatttaacatgagaaatatgattgtgatatataatttacattttgttggactatatggatttctagaagttaatggtcaaatacaaacgtaaaacaacatgtaatttgaaacgaagggactataatttgatcgaaacttctaaaattatagtcatcaataaatttaattttcaattgcttactttaaaagaaacaaaaattatatgcgtaaatttatcctggagagtattattgtactccctccatttcatcttataggtcgttttgtctcttttttagtcaaacttatttagatttgacaaagattatagaaaaaatatagtagcattacaaacaaaaaacaaatatattataaaaaaatattcaatgttaaatttaatgaaactaatttgatgtcactaagttattctatgaacttggccaaactaaacaaagtttgactagtgaaaaaaaaatcaaaaccacttataatatgaaatagagggagtaaaattgtaaacccatcaggtcttataaagtattattttaatatagacctgatggtcaaaatcctactgcctccatctcgtaatatatgcaattctaaagtttttcacgtgtattaaatagagggatggaattaaatgagggatgtttgtaattggttgggatgagtaagtagatgaaataaataaataaatgagatatggttgtgattggttaggatgagaaaatatgtgaaaaaaaattaaatggggaatggttgtgattgtttgagatgagagagcaaatagaaaagtagctatatttttaacagttctataacaatagaagtaattatattttagtacagatagagtaaaagagagtagatagtctttttaagcgagtttaaatgcaataggggaccatccaaatatcccatacaagttgtttgggtttctatttcctcccaacaactcaatttcataacaaaaaccccatcaatttcttttctaaactgcccccacatcctattttcattgatttatccttattgtttaagtttattgtttcaatttttgtgcctcatatgtctttggcatggtgtgtttttggaaacctcaatcctcgcttccagcttctgcctttcccaaatcccacatgagcaagatgatgatagcagaacaccatggtaaatttataggacaattacaaatttaccactgttttgaatcgttattgtaaaactgccactagaaaattgcaaaaataccactggaactgtcattcgagtggcatccttacaaaattgaaaaaaccggtgacaaatttgcaaatgcccctaaatctattgagttgtgagttagctgtattttctatgatcccaagctccggcccgaggtagcatgagttcctattatcctgtgatgctagaggtccatggtgcatgataaattgaaatgattaggcaaagatgaaaacaaaatgttggtgggaagttagaagagcagttgacttacagggattttgtgtacaaaattaagttgtaggaggaaatacagaaacaccagtgaattgtagtggcatttggattttacccaaagcaatatgaatattcatctagagaagttatcttaggtacgtaaaaaacacttttacgattaggtttagatccatcccgaatattaagataaagtgtgaataatatactttttaacatttatctttcggtgtgcatccttttagcgactaagcatatctcggttggtttactcctatggtaaaacctactcaccaagattcgagtatctgacttagaacaattcctaacatttataaataattattcttttagtggtaggcagcatgcttggtaacaacgagattaatcaatatatctcaatatactatttcagtgtattagagatgttcaaatagaataggatgtatatatgtgttcatagtggtgaatatgtgcggtataagtataaattaatagggattgtctatacatcatttgacagaaaacccccctaaaaatcttgtaaattatggaccacccgattactttaagatttgtgcaaagaaaccaaccctaaaaacgtcgtctcctctcctttctcgggaaatagagccgaggctcccagtttcacacggagcntcggcntcggcctcagtcagccgccgcactaatgtgctgccccctggcgtcacgggctggccggaaggcataaggggggccggagaggccccacaggccgacatcgtccccctccgtttcccatgtcgtccatcttgggagagatgcccccgccgccaatgccgcccaccgccatcctccatccccgcgggtccggtgcagcagcgggggccttgacaaccgccgatccgcgggcaaatgcggggcagggccttccatggcaatccctctaagcccggccacctcccccttctttccccctcccaccccaaccccaccccgccccgggaccttaattcgccggcgccggagaagaagaggaggtcgccggagttagagaagaagcacctggagcacgaatcgtgaagcacatccggtgattcaaaatttgcaagatttgggtatgtattttctgtcgacagatgcttagcaattccgaaattaatatatgcgagtgaatataagcttttgtatttctgtgtttcatagaaagaacacacgcattgcggcatgtctttctagtgggagagtccatattaaagttagaatttccgcctaacacataatatgttggtgccacctaaagtggtgtgaatatgtccataaagtgtattagtatattttgactgtgggtaaagtaccccgtctcaaaatataacaatttttacaaattatccaccaacattctcttcccaaccaattacaattctccaccattcacttttctcatatacctctacttctcatccaatcgcaacactgcaccatttatttctacctactttcttaataattatgtctaattctaaatttttttatattctagaacagaggagtactacatttcttgatggtaattaatgttcctctccacgttcaattcacttcgcaagattgatcgatagcgcgcgcctactaaaatgcactagcacgtataaaattaatcatattccagactaatgtaacacgtgtgtgtgtgtgtatatatatatatatatatatatatatatatatatatatagtaaatttgtttggtgctccatggtgcccgggcaccataattgaaatttactatatacccaattcaaatgagtatgaaactttttcaaatatttaggtattaacgttaactactttactaactagttcaaagcaagtttgaactgaattcaaacttgcttttgttagattttgattctaggtatatagcatccaaacatataattagttaggtatgtaataatggattgtgaaataaagttaaatttgagttgttttgttgctaggtataggtatgaatcgaatacttataagtaggtatatactcacaatttgaaaattttgaaaaatttgggtgaatttgtgtatttcataccatggtgccccatatgagtgtcctata

SEQ ID NO: 69372 - DNA, 2338 bp, Oryza sativa
catatatatacatatacatatatacatacatatacatatatatatatatacacatacatatatacatatatatatacatatatacatatatatacatatatatacatacatatatatacatatatatatatacatatatatacatatatatatatacatatatatacatatatatatatatatatacatatatatatatatatatatatacctaggtgtctatggcattaactacattgctatgtaggacttttagcttatgtggcactatattaattaagagagagagtgaagagaggaagaaactgggtctcatgcaagacacagcttcaacacgagaacatatgtactagacactatcaagttttgcattgggagaaaatagtgtctttataatagatgaagaataaatataattggtagaaaagagaaatgttgtatttattaatggcccactttaagaaaccataggttgtagagtgtagtttctattgtgatgtctattaacatggcaccatagacactgcttatgggcactatggtttggactgccctaaaggaagtcgtttaggataatgtttaagtcaaaccttgagaatataaataataaataactctcaagttgttgagtttgaaaatgtaaaaattatatgaatagatttgtcttgaaaaatgctttcataaaagtatacacatataacttttcaataaatatttttatagaaataagaaggcaaagttgtgttttggagaccgtgttgctgtctaaaacgattttctttacgagtacggagagagaatgtaccaggaactatagtctatagtaggcaaagttgcggttttccatgtgaaaataaatgtttcatgtgtttctccgcatagaacgggccagttcttcaatcactacccacgtgtgtaattatccatttttattttgttattatactattaacatatctgatgatttatttatacatacacatgttgattgggacctctcacatggtggtacttctaaccacacaagaatgtgactaaaatacatttaaagatgaattccttatatatatatatatatatatatatatatatatatatgctggtgaaaatttacccaatcctttgttagtgagacatatcagcggcttagaaaagatttaggtgaatttccagtgacagagaaccagaaggaatgaaaatgatacgctgaactgacggtatcagaaaaggtagaattagtctaatttctccttttatgccatttgttttcctagtaaaactactgggctacatgctgtttcaccaagcaccttcacttaccaatgtttaaatcaagaagcctggaaattacgcacactcgatcgggtaaggtttcaatataatggaaattttaggagatttacttatttatgtattattggccctccatctaatcgagtatgaatttagggggcatacaagtagctagctatgtgtgtgcatatgttaatccaaaaagtaattttctaatattacacttttttcttttgtgcaaacttcttgtttgaatacggaataaaatctgtgaacaaaatatgaatgccgaaagcaacatagtactcctcttatggcctgtttgaaacattaatgcatgattaattaattgatcagtagcatattaatcgcatgtaaaactgattaactcattaatgcatgattaattaaatagtaactattgtaaattttaaaatagattttttttctatttttttaagagtactatagaatttctttacaaaatacactagttagagttgaagtcatgaagcacactgatgcatgtaccaaacagcaatatataatgccagcacgacagatatatatttggattcaccatcggatcacacatatcggtatcctcggaactgcaggaatgaatggagacatcatgcacaaatatactcataccagcagatttctaatcaaaagagccccggcaacccagcgaaatgagtaccccagctagctagctagccaccaaagttcagctaccatcgtcggcagagagaaaaaccacgccccagatcaatggtttcccagatgatgatgcatcaagcatagcagctagcagcctagcacatctcgtcggcgtagcgagtttggttacgttgcagctaccggtgtggctgtgtgctagctacgctggcctcaaatatcccccataacgagttgacgacatgagcgacagccacgacgatgctctggcgcgcgtagtggtggcggcgttttttctcagatgtacgagcacactgcacttgaatctgccggctggtccgaccccagtggaagctccatggac

SEQ ID NO: 69373 - DNA, 13367 bp, Oryza sativa
atgactttaaattcaacttacataagtagaaaaaatgatttcgaatagaataggtaattcatagtaatatttttccttcaaatcatatggatcaaaattaataaaaatgatatatgtacaaccctaacattcgactcctctatacgagcagggctgagtcttattatcctcgtgttaaatatagcttatatcgtgatgaagcctgacatgcgcttgctagcgtggctcatgccattacgcagtcagataacaatcgtgcgataatgtcgtacatatatttaacaactttctaaatataaacttatatattcgtgaatggtataaatatatacaccatatattgatctatcttaccaattatatttaaaaaaaatgataactttttagatgatagaagacgtcccctcgtaataatgcataaattcatctcccaataatgcatctcggtcgatcagcttctctcaaccctctgcaataattcccttgctcagttatgcatgcagtagaaaccagaactctctgcgtcaattaggtgcctaatcacaatacacgggccgacagcgcagcacacacacatgcaattatgcgcattattgctagctaattgacgcaagaggagactttgagaggggagtgcaataatgcaccctgagcaacaaatcgatatctctcgggtcgtcgacggtcacgtcgatcgccacatgatctgttctcgtggggggggggagtcgtcgaagatcgagtggttactaccgctttccactacgggggagattcaggcggtgggtaggtggcgttgctcctcgtcttactcttgtccacggttggctaggccataggatttgcgacttttgacgggcagccaggagaagattgacacatgtgcgaactaattggaccagcgacgagcggcgttgcttggtagttagcgagtagctgctactgagctagtcttcgggcagaatcaagaggtcgactcctatttttgttgttccagtcggtagagtactaatgtatacaattcattagcatataatcctccattctaaaatactccatgcaattaattagtacctccccatcttttacttttttaaatcatccactgtcaaaatctctaatcccattaaatgcatacatagtatttattagagtatgattcattcttagttttgatgttaatggtatttacgtctaatattttagaatagataaagtactcacatgctctttctagcataggttgttttagctgtcgcacaactactctttaaatatgagttgtatcaaggctttttttttcgtatttttagctcttttatgtttgtacataatatttgttgtgttcaagtgtcgtatatatagtaccaatggctaagtggaggtgtttttttctttctaacataggagtataaattaagggcataactttggacaaccttttagccttttttttggacaacagtcgtatttggaatcaaagtgatgtagtcttgtaagcaaaagtatgctacttttatcatacaccttccggttgtccaaaatattcgccatcaatcttcccaaaagttttggtgtcatgaaaaacgtttgtaaattaaaattttgagaatttgtcaacccttatattatattactagcaaaaatccccgtgcgttgcaccgggtgattacagagtatgtatattgaccaaaaatgttgtttggtttagcaaaagtgcccgtgcgttgcaacgggaagcgtacatatcagaaaaatatgcaattaattaaaatacaaattcgctgaaatatttggtatttttaagtaggtatgtgtataattaaataaatttacaagtaaagcaagtgtgagaaataaaatgacatggttaaatttaattttttaattaagttctccatgattagttatgctctttgaaattttattggaattttcagagcttaattgctaattttaataatacaaacatcatttaacaattatttaattaaaaaaagcaagaaactacttccttttatgtttgcttcgaattaaacatattcaataactataattgttataatgcttcggaaaaatgaagtaccaaaaatgaacttcttctatttttcttcggcccgagggacctaaaatagacttatttctgtcccttccgattggcccacggccttttgaaaaccctaaccctaatcctcccccaccccctccccctctcccccagccgagccggtcgcctcttccactcctgacgccgcctctccccctctccctctccccaccggagccgcttcctctcccctcccctccggcggcgctgctccctctccccatctcccgcctctccccctccccccagccggccgcctctcccaccaccggcaccgcttcccttcccttctccctcccttctcgccggcacggcgcagcgatggagggctgcggcggcggtggcggcgctgcccttcccccatgttagcagccgcggcttcgcccacggcgagcggcggcggctcccttcctcacgctagcggcggtgacggcggcggctctccttcccgtctcgccggcacggcgcagcgacggcggggtgcggcagagatggcggcgacggccgtccgtccctctctccctctccccgtcggcctcgacggtgacgatggcgtcggcttcgtccgagggaggatctgtcggcggtggtggccaccacaggcggatccggcagcagcgctccctccgccgcctctcttctcactctggtggcggtgttttttttttgcaatttttttccatggctattgctaaccgaatcggattgtgtatggacgaaaaacagacgaaaattagatgtgacgaccggaaaaatacgaatatttatattagttattgatatggtgtagcgcccgttccgtcatggcgcctagcgggaaaattatctcttaaaaactctatttgcgaaatctgttccttgcttgttgtctagtgtccgtgccatctcagatgtcaaatcctcgatctatcgtcaagttcaatcccgaatccaaatccttcccaaatcaaatccctccgcaaaagtctattttgcctccctcgggttcgatgggccgaatccctctcggcccatctccctctctctctctctctctctctctccctctccgccgctctgcccgtgcgttgcacacgcgtgcacgtgagccgcgccgagccgagcgccctccgccctcgctgccgcttcccgccgacgccgccgaaatcgccgcgccgcccgttgcttcccacgcgcgcgcgcgccatggtggccgactgcctggtcgctgccgcgcctgcccgcgcctgccgcccgtgtcgccgctccgctccacaccgccccgccgtcatcgccgtcgtcacgacccggcccccgacactccacgcgctagcctccaagggacggaggcagagctcctcctccctctgccgcgtcgcccccgctccctcctccttttcccaaagtggcaaggggcaagctccctttctgccttcctttttccttttcccctccccgccggcgtcatccgcctctgtcaccgttttggccgcgagcgccgagcgccagctcgcgccttgaccgcccaaggtcggtttccaaaccgacatcgtcgtcctataaaccaaggcgccctcccatcgattcctcctcccgtttcgctcgccgccaccgcgccattgccgcccctctgtctcgcctccgccgttcatcgccaagcaccgggagagccggtgcgttcgtggacgcggaaggggactccgggagctcgtcttcctcctcttccccggcccgaggccggagagatcactcccgtgccgtcggcccatcgtcactgcgccccgtccgcacggtagtgcatctccccgttctccctcctcaatccatctcttccccttagtttttggtagtagcatgtgtagcctccccgtagctagccggcgccgccccgactgctgtcgtcgctcgccgtgtgctcgccgccgtcgccgctcgagctcggaagcgcctcttgtcgccggcctccctcgatgcgtttcctcctaatccggcgcaagggatgggttcccgtatccgagtagatgctctcgccgccgggaatcggcccctcgtgacctcatcgccgtttcccccttttctctccgccggttgccgccgccgcaatccaccgccgtcgagcatcccccggtgaatccgagccgttggctcgtctcccctcgtcccgtgcaacctcccggtgtgctcgctttcgcctgtatcgccatggttcgctccactgctcgccgccgtcgtccgccgtccgttccggccggtgtcgtcgtctacctcccgccggcccgcgtggcagccatgtaggcgccacgtcggcgccacctcggccgcgaccgggtcaagcagaccccggcccgccgcttccctccgcccctcgcgggcgcggtccaccgcgagccgtgaggctgcgcgtgggcacgccgcaccgcgtcctccgtgaaccgcgcgcctgcgccgcgcctccctccccaaaccctagctcgccccgcgtgcacctcgctcacggtgagccgagtcgccgacaagcgggtcccacccgggaccacgcgggatggacccggcccaccggctctctctctctcccctccccgcccgcgcgcgcgccttgggccgccttcttgggccggccggcccattaagctcggccgagccgccccattctctcgggccgcgccctagccgcccgtggaagtctaattttcctccctccttcttttcttttcttttctttttcaaaaaggatttaaataaatcctttttcctttagaccaaaaatccaataatcttagaaattcaatatcttcccaaccgtaagtctgtttgactccgttcaacttccaaaattcctcaaatctcgagatctatctaatggcacgcttagaggtcattaatagggctttattttcgccgtttgttgagttgtcccatttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggatcgcacttaatctgcttgtcccgtctgcaaggcagattggcggacctacctaatttgttgcatttgacccttccattgtaattgttataccatgttcccttgtacccacctagttgcgcctcggtaatcgtgcactctgcacgggtatcgacgatcaccttcaaacttaaaatctgagaaacatcttgggtaaaacttgggttttacaaaagacttggaaaacccgacacctgggtcggtgcttgcgaactaaatgaatttctaaaaccgcggaccggggaatgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggcttgatgtttggaaaatcggcggctgatgggatcagccaggcccgggtggccatttgaaagctgttggccgggtgccaatcttgatcaattcaaaagactgaaacattgcacatactccgaccggacgagacgcactgtctcatccgtgtcatttgagaagcactcccttagttgtttcggaaaagagtttaaataaaatcaatcgcaaaaaaaaacaatagcctttctttgaagcatgcattaaacacttatttcccatggcttgctgagtactcctgtactcacccttgctctatataaataatcccccccagttgctgaagaagatgaagcggatcccgctgacgaggagttcttccaggagcaagccggctacgatgagttttagggtttcggcctagttcccaagtcgcgcctgtgatgtgtggtccaagtcttggcttccgtttccctttcgtaatgcagttgtgagctcgggatctgtccgcagcccaacatgactgtactcctactctataataaagagacctctgttgctgtgatattttgtcttcctgtgataccagcactgtttcctgggactggtatcgattaacaggttaatttggagcgtcacgggctagttccactcgggactagttcggggcgtgacatatggtttggtatttcatatgtcaatgacatgtgaattatggtccatttcacaaacacacagaagtggcaaatcacttttatttcaactactgctggaagggcaaatctttaaatatccctttggaaatttgtcgctgaaaggaatttttataataccaaaatttaggtattatgtaaatctacaaaaatagaaggtcaaatgtctcatggttgaaccggttgtaatttatttttaatttttttagtaaaattatataactgtgggagcttccctacaatattttccttaaaataaatatgtcaatggatcattttccagatgcgtttgtggtaggcagaaagagaagaaaagatacttgtttttcatttgcatattttctgaactattaaacggtatgttgtatattaaaaaaattatatagaaaagttgctttaagaaaatcatattaaactttttttaactttaaaacagttaataattaatcatatgctaatgacgtaccttatttcacgtatcttttcaatcttttttctactccttgacacataacaggacaaagagagtaacttttgtttcttggcttattaaaaaggatatctatatagcatactccatccatttcgtaatatttgacaatttcaactaaccgttactctaatttgaccactaataaatcatttgatcacgatgaacatacacgctttatatatatattaaatagttttctaggttggcacgtgcgaattgaaccagcaagcagcgctgctgatctagtcttctggaagaatccagcgcggtagagtacaaatgtccaaattcattactccctctattttactagttaaaacatttttggttcccataaaaatatcctaatttttcatctactttctcttctaaaaaaaaattacgaaaatcatgctataaatcatttgaaatttaacattccacctcataagtctttttctttgcaaaaatacctcagtgtgcacgtgcttaaccaaatcagccgttaacacttagagaaaatcccctatgtacccatgaaagttcacctaatcccttctatatccctgaattttgttcaattccctacatacccctgaattttagtttggatcccttccatgccctttccgctagttgaccgttagttgaccgttaaattcttttgaaaaagtccattttgccctttgctatgaagaaacataataaattaatgaagtaaattgttggaatataaaaatttatcggatgggattattatatttatgaatatgtgatgcaccatattatttgtgacaagtttatttttacatatgatataaaaagttaatacttatttattagttattaaaagttctattatgtagcatatgtgttttcatagtaatacaacaaatttgtttattactatcagaacacatatgctaaaaaaaatcttttaataacttaataaataagtattaattttttatgtcatatatacaagtatatttatcgtaaataatatggtgcataactatctcataaacataatagtctcatataacaaatttctatgctgcacaatatactctattaatttatatatatgcttctttataccaaagggcaaaatagactttttcataagaatttaacggtcaactaacggtcaactagcggaaagggcatggaagggatccaaactaaaatttaggggtatataagggattgagcaaaattcaggggtacagaagggattaggtgaactttcagaggtacacaagagattttctctaacacttatgtagagtccactgtaggctgagctagctgagtcaatcttattaaagtgctcacattagatctattcttcatgtttcattgatttttttcctgcatatagcaaaactgagtgcaacaacatttaagctctcatcagcaatctatttatgcaatctctaaaaagtgtgttaagactatactcctaaatgtatttaattttggtaaaagccacgtaaatgcctcacaatttttaaaaacatatcgattcaggtaagcacgtgtgcacaataatgatttttgcaacgaaaccgagtagggagttggcatttgcaacaaaatgatttatggagtggaatgtcagatttcaagtgacttctggggtggttttgcaattttccctcagtcaatcataatcttcttctaattattttcacatattttctcaattctcattaaagccttcataaatgcttatattttaatattgatgggagtagctacctctaccccgacctcatgttgtacagagtattactctctccgtccctaaatatttgacgccgtttaactgttgtaaacatatttgaccgttcgtcttattaaaaaacttttgtgaaatatgtaaaactatatgtatacataaaagtatatttaataatgaatcaaataataggaaaagaattaataaaagtatatttaataatgaactaaataataggaaaagaattaataattacttaaatttttttaataagacgaaccccactcccctccaaagttttgtagagtctgttacggtgattaagggagtatgttaaattaagagcaatgctacacgtactaaatttttcttactaaacttttactaacaatcatctcaaccgtttgatttaagtagatggaagttacaaaaaatctaatgcactcatagcatgacacatcagtgttagtaagaatttagtaagaaaaagttagtacgtatagccttttcattaaattaaataggatgtggttatggttatggagacgatagagcaggtgaaaaaaataaataaatgagaggggttggttgagatcagagaataactagagaagttgctattatgcgataaattttgcactaagctagctctgtgattgtcggtattagtccaagataatgtagagaggattggcttcttatttctctttgcattttctttgttttttttaaggaaccctattggctttgcttactattttgaattttataaataaaaagaaagtttttgttacaaaccagaaaagaaaagaattcaaaattttatatagccaatctatcgtttttttatcaatcgaaaaacgtgattctctttaaccttatttgcttctagattccatagctgcgtgattctccttctttgatgtaaagcagtaaaggcatacatacatacatacatacatacttacttatcagcgacacacgtgccagtttcatctttctctcatagactatggtatgtccttttctccaaccaaaattggatgaacttttagatactcgtggcacgcatttcaaattgctaaacggtacgttttgtgcgaaaactttctatatgaaagttattctaaaatataatattaatccattttttcaagtttgtaataattaaaactcaattaatcacacattattaccatctcgttttacataaaacacttaatttttatcttcatctccatcttcagaagattccaacaccacctatatatcactagtttacaccaaagttcatcgttgatgtagttactagtgtactacagtaggcgttcgactaatccatccataagttaattgattgggggaatttttttttccaattgcaatcagcttattgttgaatagtcctacattggttgtggaagggcaaaggacctaagatataactgggggagcccctcacctcaatggctagcttttggggtgggaaaggccctttacgatcctacaattggtatcagagccttgttttcctctttggatttttatcgatctagagtttttgccatggctactcccgctaggttttcaactaagcctcatgttttcgatggaacagatttttctcattggtgtagtaggatgcaatcttatattatggctgaagattatgatatttggagaaaagtttctcatccttatgtgattcctgaagctattaatactgctgctgaaaaaactgcttttgaaaaaaattgcaaagctcccaatattcttttgagtggtatttcttgttcggattatgatcgtgttgctcatcttcgaactgctcatgagatttgaactgctttgagtaatttcatcaaggaacaaataattttaaagaaattcgtcgtgatcttttcaaaaaggagtatattaaatttgagatgaaacctggagaagttttggatgactatctttctcggattaataaaattatgagtgatcttagatctgttgattcttcttatgatgctaattattcacaatatgagatttctcgccactttttgaatggtcttgacatgtctatttgggagatgaaagttatatctattcaggagtctgttaacatgtctactttgactttggattcactttatataaaattgaaaacacatgagatgaatgttctttttcgaaaagttgattctaagtcgagtgctttggtttcttcttcttcctctttggatgttgatgcttcttcatctaagtcttcttttcttgctgtttttaatgccacctccgatgatcaactcgaacaaatcgaggaggaggatttggctttggttgctaacagaatttctcgagttatgaataatgccaggaacaggaaaagaggtggtccaaatcgttgctttgaatgtggttcaattgatcattttcgtttgcattgtcctaagcttgggagaggcaaaagagaagacaaagatggtgagaagaccaacaacaacaagcccaacaacaacaagtcaaagggttcatcccaagggaggaagctggacaatctcagaaaggcttttcaacaagtttgcgccgtcttcgagccactaagtgatgtagatggtgaaagtggagatgatgataagggaaagaacatctccgatgtttgcttcatgacgcgtggtgaatctgacacagagtatgaagataatgaggtaagtgcttttgaggaagctattaatattttgagtgaaaagaataagaagtgtgagaagatgtatagaaaacaggaatttatcattgaatctcttaaatctgaaattgctagattaaaatctgttattcctaatgatgatgattgtgaaaattgtgaggttttaatgaacgagatttcaaaaattagagatgttaatgctgcacatgatttgaaaaatagatcttctcttgcttgtagttttgctttggacacacgcactttggatgagttatttttagctaaaaagttgttgcaaaaatatcaacttgcttttcatgctagtttgatgtttaacatgatttctgctaaaaagttaaaacaacctcatgatgttttggattgctcaacatgtaatttgaataagttgaaattgaaagatgctttaggtcgtgttgagtacatggaagatgttgtgaaaaacaatgaagggctttcttgccccaaatgtcgtaaaagcaaaggtatcatggtagattgtgaaaattgtgctaatttggaaaaagaggtttcttatttgaaaaattctttgctaagattttctgatggtaaaaagaatctcaacatgattttggatcaatcaaaggttagcacacgtaaccgtggtttaggttttaatcctattgctcataattctagacatcctcctgttgtgttaagtgttggtgctagaggtggtgtgattttggttaaacctgatactaacaaaactatgtttaaatctgctggtatcatgtctaccttgaatgcatcttcttcaaaatccaatgttgtgcatgcaaaatctcctgttgttgcttgtgttgctaaatcttctaatgctaccaatgtgtcgaatcatcgtgaaaaatatacttgttctttttgtggaaaagatggatatattgttggtttttgtttcagattagctcataaacagaaaaaggagagagaaattgcttttgcaaaatcaaagtggcaaaaatatggttttccctcgaggaaaccggtcagaccgcagtgggtcccgcggtcagaccggcgaccggtcagaccggcttctaagcatcggtcaaaccgggcaccggtcagaccggcggtacagaagcggtcagaccggcccccggtcagaccggccactatacctcggtaagaccggcctcggaggaatttttctgaaaattataaaattgattttgcacgtggatatatgcctattggatcttctggtcgtgtatctcagtactggattcctaaatttttattatcatctaaccccagtactgaggcttcgacttctgcttgtgtgtaggctttggtggcaaggaaggagaacgtgtggatcgtggattccggttgttcgcggcacatgaccggtgataaaaattagttctcctccctaaagaaggcatccaagactgaatcgattatctttggtgatgcttctataagtgccgttcttgctacatgtttggttaaggtaaatgaaaattttgaattgaagaatgtagctttggttgaggacttaaagtacaatttgcttccagttttacaaattgttgatgaaaattttgaggttcactttaagaaaactggaagtaaaatttttgattattgtggtgattctgtgttgaatatttctcactatggaagtgtgtttaaagctaattttgaaattcctatttcacctgtgataacatgtttggttgttaagtttgataaagatgtgatgttttggcatcgtagacttggacatgttggttttgatcatctcactaggttaagtggtttggatcttgttcgtggt

SEQ ID NO: 69374 - DNA, 741 bp, Oryza sativa
gaaatatgacatcttctaactactccatcagcttaaagaaattacgagatcagttcaaggagatgccagaaaatgcaacaaaagaacaaattgaacattacactagggcattcattttggatattcttgggtcaatgattttcccggatacatcaggagatggagtgcctgcaatgtacctgcaattccttcaggatcttgataaaccaaaggagtacaactggggggcaacaactcttgccgtgctatatagacaattaagcttcggtgcagaacgagagagattggagatggctggtccattagtgcttctgcagcattggtgttggtcgcggttgagaccaggacgaccagtggatcaagataggaaccctattagttggggagagccagaccctgagagttgtcctacatttggagcaaaatggtgtggccaggaactttatcctctgccacataactcgggtgttgcgttttatcagaacttgctggatcaagttcaagacaatgaggtctcttgggaaccatataatggactattgatgtccatgccaagaagagttagagctgaacgtgctttctggtatagtcgagtacctctcatccatttttggatcattgaatttcattatccagatagagtgatgagacaactagggagaaagcaaaccattccacctctcccccacatgatgagagcaagcttcgtcaactccataaaataaatcatacagggaaacc

SEQ ID NO: 69375 - DNA, 5788 bp, Oryza sativa
gtacatgttacgataacgtccaggatatcaatatggaggctaagttaagcagcatgctaagcgagtcaggtctacctttatgtgtagatgacattcgatctgatgatagtgcatcaccattttctacccctaaaccaattaaacctgaggagataaacatggatgtgatgaatgactggttgtactcaaacagggaatttacaagataccttagtttaggtacagattctgatgtgctggaatctcaggataaacattgagcatagatcagggcaaagagctttttgttactcctgctgttagacaatgttattatttggtttatcaaagcttgtgattttctttgataaactgtaagttctataaattagaatctatttttttacatacatatggtttaacctgtatcttgtatttcctgttcaacgtatcaaaaaaaaaaaacctcctgccatttccattcaaatcacattgagcgaaataagacaagcagtgttgtccttgtcaagatacaaaaataacaactaattgtcaatagggaactttaaaaatatcaagcttgttacatgagaatgaagtccttactcacagaaaactaaatccaaattttataatataagctagaagtagatttgctagataaatttctagggcgatgcagcggagtccatcctatggattgtatcacccttgatgttggtgagatggcacacctgcagtgttaattctatattagtaggaagcatagatatatcatacaataattaaattatgacagaccggcttgatttttatcttgggttgaacgacgtgcttgatgtcctaagcgtcgaccttgcatttcatccatatacattggaattcggttatgtcttcgtcgacccaactgtatcaacctagcatcaggctcaataattggaccattataagttggccactccgattgatttccatatgggtgaaactgaccagcccaagtgtttgcgagtgttgtagaagagtagtaaggatggataaactgattctcattaaggtttctatcttttcaaacagcaagcacatgagcacaaggaatactagtaaggttgggcttttggcactcacatgtcggaatagcattgttgcgcataactagcttatacttgaaatcccttcgaacatacacaacacgatctccttgatgcaatgcaactcgttcacggtcaaccttcacctcatattctcctctttcatcaccatatgatataacatgcatgtgatcccggccttggcccctcgtttcactaataacttctcaacccgtcgagaccacattttccctgagttcgcaagatcaaacaagatcttcttctatcaataaaccattctaagcacttgttaaatgtttcctccactattgccatgactggtaatctccttgagtacttgaacacattatttacagactcggagccattacttgtcattatcccccatcgatgtccaccatccatgcactggaaaacctttttagatttttccggctcattcttatcttcttgccgatattttcccaccttaccaagataagcaattgcatctggacaagtttttgaaatagcttccataccttcattgaatctacgtggtttcttcttcttgacaacccaattaaaagtttttaccacatcatcatctttacattgcttgtaaagattctcagcaatatgttgtgaacaaaatcgatgcacacactcaccagcactttcattccatccaatatgtggctgcttgaacacccatttgatagctttgtggcgatcagaaataacacacacaaatttaccaaaaccaataacctctttccgcaaccatctcatgaaccatccccaattgtcactgtcttccttctccactattgcaaatgcaagaggtaataatttgttttcagcatcatatccacatgctatcaacaacctacctcggtaccttccagacaaaaaagaagcatctatattaatgacaggtcgaagataaggtactgcttcaatacaaggtccaaaagcccaagccacgcacttgaatgctcgatgcccttcacgagtcatcggttgtgacaaaatttgatatcttgttccaggattagttgctttaatagcctccaataatggagtgagcaatgcatatgatccttcccaacttccaaaaagttgagcaattgctaactcccggccacgccataacttgttgtagtgtggctttacatttttataccgttgccgaactaattgccgtatgttcattatgctcaactccaagttctcttttaagtcatcacgtataacatctgcaataactgcagatgtcaattgtgcacgatcaagtcgatcagcgggagctcgacatgtgtgaggataggggcaagtttgtatcttccaacttgaaccaatttttgttggtttcccatatagcttccacaagcaagtattgtctatgcacttcatacttagtcttgacttgttacttgtggtaacctttacttcttgattggtactaatgtgaaattcattaatagcaaactgcaaatgctccttggaatcaaaagttcggcctttagctaatggactgttaaaatgtttcctcgaaccaaagaatctctcatcggccgttgtattctgtagcacagatatatcatggaaggcacttacagggtgcttgtcagacctgcccacgagtggcaacgatttgatcaatttgaccacaggctgaccataggtgttatcattcacatcctcttcggcttcgccatcgctctcatcttcctcaatcatatcaccctcacgttctgtctcttcgtccacatagccatcatcttgagaattttcttgcgcttcatttatgatattatcagaagacaagcccacaattggtgcagaattactcacatcatgaattttaggagatataccatgcttaggcgactgatgtgatgctgacacaatattctcagcaactgtagccatagttggttctaggttttctcttattatttcactaacaatgtggttttggctgaatccactatttgttggagtgaactcaacatataattccaccatacgccaactgtttagtgctaatgtcatgtcaaaaatcatttgccatgatctggtcttatataatgggatcaactggaaaaaatgtggacttggtgctcctacatcatatcggccttgtataacaagtgaatattcagtttcagaatattttagccctccataaatctcattctttacatcttcgaaagttgtagcttcggaagcaggaaaagtaatcttgggtggaatgctatactctgcaccagtcgctccatatacaatttcacctccagtgtatacaagaacaattatcatggtctgatgacctaatagtaataaagaaaagaaaaatatatatcaatttccatattcgatttattcatgatcagaatatttagtatatacatggcacagagcactactaactggagcacatagctaatgatgatataatcatttcatgcagtaatttactcatactttcgattagcagtgccgcaacctttccatgatagaagaataaaatgatacaacagatctgctagttttttttacggggaaaaaactgatatattactcagctacagcctcattcacaaaatgtgagatgagattacaagaaccatctggccagaactcggagagatatgctacttgactagtactaatgtctaatcaattccaaacaacgaaaagtaaacataccttgcaaataatcttactcgtgatctctgcttaaactctaatctcatctgatataagactagggcatgacttctgcagtaagggaaggttagggatagaaagaaagacactaaccaatgcgtagatctgtatttcttttctatgttgcgggcgtgcagttgctcggcggaggccgctgttaagttttggcgtccaagttctgtccaggaacgcagtaaaaaccttgcgtccaaattagtcgctgccaaatgacagcgtccctatcaaacagatggacgcttcttgaatcagaacgtcctgcttattaatagaattagatggctgtggtgcttacataaaaaaatatatttcttattttgctcagaattaaaaaaatcggtgaaaattctgtgtgcacttttgaatggttggaactggttgctttggcagaatcacctggctacaagtcattagtgagtagtgactcgccattttatttcgatgatccctgtgcaacctgcgtcgtcttttaaatcttcagtgagtaaagttataaacatttacggtctctgattgtatgttagtaagctctttggttgcttgccacagaatatgtttttcttatctattatcgtcgtgtgtatcttttttccggaaattttgtcatctatgtaggtcggtcaagactcaagtgggcagcaaagcactacttagaaattggaattttgtgatgcttgactattacctgtatctggagtatttttttaggcttgtgatgccggtgtccaactgtgcaagcggtgctggtagcgaactagtaccaatgtcatttggactgctggactcgtggtgatctgggctaacgcccggccgctctgtacatttggagctggaataagttcattttaaatcccttatcttgtctccgagtttgaaatgtcgtccttgaaatcgtaatactggatataacgagtctctcaacttgcaaaaccggtgtacccaatatctcaaacagcgcatattaccatctcccctctcctctctcgttcccacccaattcacccaattccgcagcttcagtcgaaccgccgtcaccatcacactaccacactataccatccaagttatgtacgccaacgccttatggtcgttcgtgccgtgccccctccaagagtagtgctccgtcgtcgccttcatcgtatcccccaagttgttgatggcagccacctccatgataccgcggatgttgagcatcaacgccatcatggtgacctccctgaatggcatgacgaagaagaacctcacgtggaataggagatggacgagggaaggttggaggaagaagaactagacatgacatatggggttcactcgtaatgtcagccaaaaccggatagtacactagttttgcaagttgagggacgtgttatatctagtattgtggttggaggacgaaatttgaacgcgacgttaagatgagggacccccaatgaacttattcgtttggagcgagacaagtttgttccgggcctggaaaatcaccttccttttgtattcggccaacaattaacatacggttcgtactggccctactatccttattttagattagtactggtcatagtttcgccttttttttcttcgtcatgtgtttacgctgctagagacaggttcctcggccccgttcctttcggggaaaaacagagcagctcaggtacagggagacattaggtcccatgcatgctcgggggagcctcggaagagaagataatcaaaagtaccaaacccatgaaacgtacgttgagatcagtttacgaatgtgtcgccttcgcccctgaaacagaagaacccaaaagataacagctgccaaccagtgaagagcagccggaaccaccgcttgaatcgttcgtcctgtcctgccgctaccgatggtgatgccgctcaacgattgggcacttctccagcaacacggctcctaacccggtctagtacgtgtaagcttagccagccaagatacgcacgcacac

SEQ ID NO: 69376 - DNA, 4331 bp, Oryza sativa
cggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaatttggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagcgccaatgttgtgcacaaggcccagaacaagagcaaggggaaatacaaagcttagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactattttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacgaatttaagatggtttttgagtctaataaagtagtcgtgtctaaacatggatattttattggtaaaggttatgagtgcggaggcatgttccgcttttccctttctgatttctgcaataaatctgtaaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtgtggagagtttttctcgaacaagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaagctgtccgtagtgaaatggattccattatcgctaacgggacttgggaggtgacagagtgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaataaggcagataaatgtgtgtactatcgccatggtaggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttctgtgagcaagttgagccgatttacctctaatccgggagatgatcctggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagcacatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactcttgacggagcgtggggctcctcaccgggagactgcgcacgcccccctttgccagttcggccgggggccctgggtgagatt

SEQ ID NO: 69377 - DNA, 11101 bp, Oryza sativa
aggcagctgcgaggggcccgagctggcctcggggactgagacgggctcgagagctggggtccattctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccaagcggcctcgcggggcgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgtttggctcgggggcctcttctccctgctctctcccgggtcgagtcggcacagggttatcctcggggtcagagggcgataggtgcggccttcccgcagtggccctctggccatcctgggggtcgggggcacctggcaccgtctgacaagcgggcagagggcctgctccggtcgtcgggggccttgggccactgttcggctcgggggcctctcctccctgctctctcccgggccaagccagcacagggtgggggtgcgcggaatgaggatcgtcctcatcgcgctccacaaccaacgccgcactaaccacttgcggggtcgccgctaagtagagtagcaagggttcatttggctccgaggcgaccagaactgggggagagctgagatacgccttcaactgagtgagggcacgttcagcttcctccgtccaagtaaatggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttcttggggttggcctcgatgcctcgggtagagaccaaaaacccgagaagcttgcccgcaggtacaccgaacacgcacttatcggggttcagttttatgcgggtggagcggagactctcaaaagtttccgctagatccgagagtaaggtctcttggttgcgcgtctttacaaccaagtcatcgacataagcttcaacattacgtcctatttggctacccaaagaaatccgagtagtacgttgaaaagtaggacctgcattatttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggcattgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttaaccgggacctcgtcgcatgtgactatccgctgcctcggggcggcgggggcggaggtgccaagcctctcgtcgcctccctcgggcttggacgcggcggtgaggtggtccgcgcgctgctccatacaagcaagcgcgactttgaggtcgccatggacagagatggggccaccggggcccggcatcttcatctggagataggcgtagtggactgccgccatgaacttcaccaacgcgggcctccctaggaccgcattgtagggcagactgaggtccgccacatcaaagttcacccgctccgtgcgaaagttggcggatccaccgaaggtgaccgggaggtcgataggacctagcggccaagtgtgacccggcgtcacaccgataatcggctgggacggccggagccccatccccggggccttgatagcgtcaaaggctgcgggggaaaggatgttgagggctgctcccccatcaatgaggacacgccccagcttcacgttgcaaacagtgggggaaaccaccatttcgatctgtcctccccgggcaacgcacggtgggtggtcggtctggtcaaaggtgagggcaacctccgaccaccgcgtccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaagttttgactgcgcggcaatccgcgaggtcgtgaagggaggtgttgtggacgatgcaccacttgccggttgggcgctccctactgggagcgccggcctccttctttttgtcgctcgcaggcctcccctttcgggtggcccgcgaaacgccctcgacggcgaggacatgaccctcgtcgtcggaatgggctgacctcttcttcctcctcctgtcacgccgccctgtccgagcagcggatccgggggcggccgaagctgccacactggaaccggaggggttccaggtccatgcctcttccttacgagccactcggtccgcgtgctgaaaaagctccgcggtagtctggggctctttggaggcgatcttttcgagcatgcggttgtgccgcacacccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgatcctgtcgtcacccccggcggcctcgatcccggtcgtgtagacctggagaaactcgacggggttgacgctcccgtcatatttttcggcgatggtgggccggaaccttgggggccaatggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggcaccccacgcagatcttcctgggtcggaggcgttgacgaaggagtggcggccgaatggcgagcaaccgccgccgctcgccgcgcccttcgccttgacgacacggagccggtggtagcagcgccagaggttttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgactctctcgagcgcctcctcccgcctaggactttggcgtggagggggcggtggagtacgagctcgacggcgtgggttcggctccccttcgtcaccgctaacactcggagagaggttgtgcgcctttgcttgttcagccattgggctgaacaggaaaagcttggcgcacacgaaagagtgcgagagcttagaagaacacacgtagaaccccctacctggcgcgccagatgacggagcgtggggctcctcaccgggagaccgcgcaggcccccctttgccagttcggccgggggccctgggtgagattctaagctccttgtctgtgtgtggaaggttcgcgagaattgaaacacacaagacacgggcgatgtatataggttcgggccgctgagaagcgtaatgccctactcctgtgttctggtggatctgtgtatgaagaagctacaaaagagctggagaaccagagagctcttactctctccctctctggtccttctggatccgaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgtcggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaaagtcttgcttgtaatggttaggatgaagcctggtatatatctgaccgggaccaacgtgccatctccaggagctaacacgccggctccggctagggacgagtgattggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccacatatacgcggcgcaaaacccacaaggggtcggggcgcctcgaccctcggggccgagacggatgcggtccgacccctcggggagacaaagagaagggcggccgtatcaccctcgggcccgacccccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtccaaaaatcgggacaagccggttcgtttttcctggagatatggtgatggcgcttcggtcggcgagcgtaattaacgcgcgcacgagatgttccatctcgactgccacggccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcatcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtccgtcttcttccttcctttcgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccacgggggccggtgctgaaccgctacattccctgcgtcctccgcaagaagtgggatgactggaagagcgactggttctacacccccctcgccgacgaagcgcgcctccgacttccgagctagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggggtcagatgggactaggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggtgtcggaggagcgggctcctcgaggccacgatggcgtgggcgggagccgcagggggaacaatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgcccggagggggccacgccgacgtcgcagcccgagggggagcggaagaagaaacggctccgcaaggtgggggggacagaaccatcccggggaaagctcatttcccctccaaggtggtcgtttaaccgaccccctcgcaggttcgtcccactcccatcgtggccgtattcattctctcaacgcgagttttcactcatccatcttgtttgtcttctggtctttcttctgtttcagcgagatcccgtcgcgtccctcccgccattccaagtccggccagcctgaggccgaggacccggcgaccatagaggcccggaggcgggaatctgaccggcgagaagccgcggatcgccttcgagaaaccgaggaggccgctcgggaggccgcccgggctcgccagaccgaggaagccgctcgggaggaggccggactccgccaggccgaggcgacgacatcctccgaggcgacccgtgaaactgacgggcaagaggccgcggatcgccttcgagaagccgaggaagctgcctaggtggccgtccgagctcgccaagctgaagaagccgctcgggaggaggccagacttcgccaggccgaggcgacgacgacttccgaggcaactcgtgacgaggccgcgggcgcatcgcttgggcccactccctcgtgcgacgctcagatcaaaccaggtccgggggacatccctgagtccggcacgtccatcggcgggccaagccgcgcggcatcctcttcgaggcggctcttccccacgccttccgttgctccactgagcgcagaaccccttctgcaggccttagccgtcgcaaacaccacagtgttggacgggttaagtgcccaggtggaggccctgcaagcagagcgggcggagctcgacgccgcatgggtgcgtgtcgatgaggggcgacgctcggtggaggccatggtggaggtgggccgcaaggcacaccgccagcacgtctcagagctcgaagtccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaaaaaactcgacgcagcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgctattcgggaggtcacactggcggtgcacgaagccgcctgtgccgaagaagagtccgcgctccgcctccgcgaggacgcgctcaccgagcgggagcgagctctcgaggaggccgaggccgcggcgcaacggctggcggacagcctgtccctccgcgaggctgcgcaagaggaacaagcgcgtcgcaatctggaaagtgcccgcgccgagagggccgcactgaaccagcggccgctgaactcgaggcgcaggcaagggagctggatgcaagggcgcgtagcggcggggcggccacgggcgacagcgacttagccgcccgcctcgcagctgccgaacacaccatcgcggatctgcagggcgcgctggattcgtccaccggggaggtcgaggcccttcgcctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggaactcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggtgacccgggtgcatcggagtgagcccccaggcccccgccaatctttaaatagtttcttcttttcttcttccgagtccttcgggcccccttcttgtatagactaatttaatctgcaatcaaataaagaggaaattttttgtgtcaattctatttgttgtgtgtatgagacgaggatgcctgtgccgcggtccttttgtgtcttggcttgaacaagggctcgtgcccaggtcctagtcctcaaatggctcgggttggggctagtgcctggggagatccacatgtcgagactggccaggccgggagcgtggtgaccgagggttatgggttacccgattgtgggtttttgccgattcccccccggagttcaccacgccctggggcacggctcggttctgggccccgtttggcgattttagccgacccgagcccccgagggcaggattgaacacgagtgacctatttcaagtcaatatccttcaaaaggaaacaatagcacagatacagcctttaggaaatcgaaaatgcttttattgaaatacagatataagagaaataagaatagacatatgtggtagcccccggccaaccctgcacgcccgaggggggtgcggggttggcccaagcccgaaacctgacacccgatccccctttaggggtagaagcgacgaaggtgttgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatgatagcgccgtaggctctgctggtagcgcgcggctcggagggccgcgcgccaccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccacgaaagtggtatgatctgcagggcctgggccggctgatggatttgcttggcgtggaattgacacgctctgcatcgccggaccaggtcgaccgcatcattgagagctgttggccaatagaaaccttgacgaaaggctttgccaaccaaggtgcgcgaggcggagtgggctccgcattcgccttcatggatatcggcaagaagctcgacgccttgttcccgagggatgcacttcaggaggattccgttagccgcgcgccgatagagggtcccttctaccagcacgtagcgtttg

SEQ ID NO: 69378 - DNA, 2628 bp, Oryza sativa
aaaattaagaaaatgaattagaagttagaagctactacctccgttttagtttataagactttctagcattgtccaccttcatatagatgttaataaatctagacacaaatatatgtctagatttattaatatatatatgaatgtgggtaatgttataaattcttataatatgaagcggagaaagtaaaaaacttagtgtattcacacctcacctccaaacaaaaccatggactcattatagagccaactttcattatcatatccatttcatacccaatgtaaccatcaccatatagcttataaattcaagtcgtaggaaaggataagtaccccatattgttgaaaggatatacaacgaagaccaaaagtgaagattggaccacgagttagtggtcaggggggcaattaccaggtcagctgagtcagctttgcacaatcggcatctcgtaatgaagcgcgataagtacacagagaatcatcctcatttaactcttttttttggagactatgtcaataatctcttcttaaattagagacagtctcatctcagctagctgcagctttctttgtgtttctttcactgtcaggagggtaacagtggtgcaaaggagtagcaagttgtttgttccacacttataatagtcgcagattaccggatctggcatattccatcatacaatgacaaatagcatgcatttttttaattatgttttgagaaaggttgcaaatgtacatttgttctttagcaaaaggggacatattttagacaaaaggaaatggatgccacatatggtctgtctttgtcctattaagcttacgtaccatcgatactactgctgttggacaactaaaggctaaagccatcttgccactttgatgcggttctaggcttctagctaaaaagtactaacataatgattaatgaacacatgccgttgctcgttgtgcgtttagctcgtttgataatcaaatttttgtaatgggctttagggcaaagctcatacacattttaagatatatcctttaaatataagagagcagtactccacaagtacgagcagtccactccactatacgagcaacagcggaagaacaagatgggaacgccacgcgcgcaaggtaaatcgaaacacacatttgtagtagtagccgcacagcccgcactatccaagtaaaatccgtagcaggtggactgcacaaacccgcgtggcgcaggcgggaattaatggcaccattgtttggtttatacatgaataaacaaaataacatactccctccgttccaaaataaatacggttttacactattcacgtttaccgtttgtcttatttaaattttttttatgattagtatttttattgctattagatgataaaatatgaatagtattttatgtttgactaaatatttttaaatttttcataaattttttaaataagacggacggtcaaatgttgggcacggatattcacggctgcacttattttgggacggaggtagtatttacaaaagaaaattaaaaataatttatgaataaacatttacgtattgttcttaagaatctaaaagcaaaaaatttagaaagtaaatttcgataaaataaccttaaattggttaaaaaaaaattttaactgataggagtactaagcattagcttaggttaaaaagatgtggctgtaaagcgtgtggccctcctccgtttcccccaatcacaagcaacgcccactcgctactactactccactccgctagcctatagcctcagccgcacgcagcagcatcgcgtcgcgtgtggcctccgatgcgcccgcgcgcgcgggaacacacgtatacgcatgtggaggccttatccactctctccccctccccccgttctccggaaaaagaaaaaaaaaacggagagcaagaattcgaacgccgaacccagcggataaaaaacccaaaagaaaagcgataacgccgaatctattttttagtttttactccttcccttccctaccgcgccgcacacgcgataaacaaataaacgaccggtgttttttttcttcttttatctcatccgctcgcctcgcgtacgctctccgctactacttcagttctcgctcgttcttatcctcctctgccagcagtgactcacctcgccaccacggccacggtctcctcctcctcctccacacctttataatttgtaccagctgccttctttccaccagtcgacgacgacacggctcggttgttgctttgatcgatctgagctgcgttcgcttgccttgatctgagatcggcgttggtcggggagagtcaagagttggggatatatacatggacgcgtacgcgtggtgccggcgcggcggcgcggcggattgcgaggagcaggaggaggatatcgggtcgccgtccacgtcggcggggagctcggcgcggtcgtcggggtcgtcctcggagctcgccgacgacgcgagctcctcctcctcctccagctcggcggagcgccgcttcgagatgtccgacctcatgacgcagctcccgttcaagtgcgtgccgtttgctctagctggtcgcgttcttcttgatctttgatgatccttgagctagctgagctgacaccggagtgtttttttttttcat

SEQ ID NO: 69379 - DNA, 3986 bp, Oryza sativa
ccgccctctcgatgctcgccgcctcgccgaggcggccgccgctggccgcgccggcgaggccggagggggtggcagctaagtttctcgtcgttaactaggtagtagaaagtttggtgatagttgcagtcgaagcaacgtgtttacccgtctgtacataagtactctgaatgaccggcattttcgctgtttggtggtccatttccactgtccgtggtaatttgttgggtgagcttgttgtaacataaatccacgattgatgaggtggatagttagaatgctcaattagaaagtacgcctcttccaggatgtgccttctgagttttgatccaagatgaaatcatgaaactgtcatagaaaaagcacaagggagttttgccaactcaaatttcaaatggctcaaagctgtaacaagtaacccaaaatgaaaatgtaagattaggcgacaacatcacgtaaatcaatgaaagcattagaatttgactagaacttcaggtgaagctgttaagtgggtaagactaacaaacaagttacattgtgagaacgaaaattccaataagcctattgagttcagcacagctctggtttccttctcccatgacaacatacagattacaactccagggtgagaaaatgaaaagtagtatacagcaggttcaccggcatagtttttcaaaaccagcgtggctttttcccagtggagaaatgtaattatcttttgaaaagctctccataggtataacaattcatgtctttcttacatcctgacgattatgagcagaaaatgccactatccaagtcgttcttgatataaaatattggccccctgaacctgaatgagagtcataatctgttcgaaagattcatagtcaaacaaactctcccatccaaatccaaaacgaaataaccttcatccaagaataatttaaatggccggtaaggatttggtacaggatgccaagttcagacagcacggtactcaataaacaggctcagcttctgaaccaacacagcctgtgaaccaaatacaggttttcttccttcactgatccagttcttctccaaacttgatgctttagcatttgcccgcatgtcatgctcaaaggctgaaaccatctgatagatcgaagttcgaataacatcggccatggaaaaagctttagtgtgaagaccacctctttgcgtgcttgcaatggcagttacattgccttttctcccggtggaaaagttagcccacttaatgcttgctggacccagtgagtgcgcaggttgtgggttagttttcttccccaaacaggcctcaacggcaactagcgcagacagcaaagtagacatcacagcagcattgcagcctgtgagttgagcaactccataccgatcttcttggcgtgaccgtgcagttaaagatgacaatgtccgagcgcaccatgtgcatatctacatgtaacaagccacacattaacttttcatcaggaattatcaaacatagaaacatttgaggaactagtctggacgtggtcaacactgttgacaattcaaccattcggaatgctaccaaaatcacaaatttgtggaaacaatactcccttcagtcagcaaaggaaaatgtttggggcttgtttgcatctaccaaggaatgattaatcagtgacttgtcataatactgtcgcaattaacttcctctagaaatttcaacttagcatgcataaagtcatttaataaggggcataggtggccaaatgaccccaaatctttccagatgtcttgcttttgtgaacaaaacgataatctccaaacggtctagtttcttgacaggagggagtttataatctgtatgaacggccatctgatgctaaactaaaaatatgggtaaagcatgacctaattgacccaacatacagaaaaagctggagcagctaacaaatggaatgctattttgcatggttccagatagcaacccaacatacctgctggcagcctccatttcagccatagtcagggtgctacgtgttctagccataacggacaaaatgttcaattatgttgtaaataccaaaaaatattccaactacagaagtagttgcaaaggtactgttatgattttgtcaaataaaacaatgtcttcctaccacaattactagcctgttttctgaagcaaaacatgcttcctaagttaatggtcacctgctaaagaccaaaaccaccaaacttaaacttgctcaattgtaaagctaaaataagaagcataaatggattattcacttccactataccaatgaaatagaatacaggacatccacgtgagaccaatgtatgacagtaataccaagacatcccacacgcccaaatgtccaaaattgctgcaggagagtgcatatgctattgtctgttgcagtgctgggcaattttttttagagaccacaatctcacatgatgatagttaacactcactaaatatccaattatcatccactagaactaaatgtgttgccacaaattagactggttataaataaagtagacatcagcactcacaagctatcaatctcaaaatgaactcctaagatgtctgaagtctgaacacttcaaactatgatactaacctttacaagcagatcttcctggatgcagatctagtcattatgtatgtgtatcactaaccaatgtggtgcagttaagattatagtacgtacatttaattcaactctagataatctgtcatgagtgacaaagcaaaaaacaaacagtaaacaccgaactgattctacagtaagatccaactgtttttggtcttaactcctaaacaaaggaaccatttcatgttctatatcaacacaaatgcaaacatgattaacaatttggaaaaaaaaacaggaaaacagccgaacacaacataagaggtaaaacagatagaagaaactgatgagtaacttacctgtgaatcattaaatgcagcagcaagtttgaactgttgtgacaacaattctggtttctcactagaaaacccttcaagagcttcagcaatttttgacgtgaactcctcaagcggcttcaaacaagctgtcacaattcttttgtaagtctcaccagattcctcaaagaaggccgctcgacgccatggttctaagttacattcagatacagcacacaaatcttggtatgcaagatactgcattagtgatcttggatcactcagttccaatgtttctaggatatactcagtaggattagtctctgcagcagcagtgctctgtggtggagcgaaactgcaccttcttgtatgcacaacctgaaatttgttgaaagcagttgaattatggttatgaactataaagtttcaggaaatgacgtcaatctccgcattccaggcaatacaacaagtacatcatataacatcttttttcctttgaagttggattgtgaagaacaaacctggacaaaatgatgacttatttcccaacagaaggcaacggcagtgctcattataaaaataccgatttgggcgataatttggcttccaatggatcctctgattctgaattgctgaggaagaacgaaaatcaagataaaggaaaggaagaaggcctgaagtgacaccttcagagccctttttccagatggcagaagccccattttcaaaccatagaacggaggtcgctggacaaaaaacaaattaagaaagcaagtaagacaattggcaaaattggtgggaagtgctgaaggattgcaagtaaacaacatgcaagcctaaaaaatcgcaagggcaaaaaaattaaccaaacagagctatagatatcagagaattgcacatataatttagatcaatataaaccatgtctccccaaaaaagatctagatggataaaaacttctctatcaataactatcaaagcaaactacagctcatgcatgtggattctgaatatcgtatattctggagaattataaaacagcgctatagtgtcttatcaaacatgataatcaaatttc

SEQ ID NO: 69380 - DNA, 6479 bp, Oryza sativa
aaactcggaacaaatcacaaagaatcttagacccaacataccaataatacaagccacagttatcaaaaacatccatgcttagattcaataacaaaaaatcaccagcaccatcaatcatacctaagtaggtaatctaaaatcgtaacaagctaactttaaacctaaaattccgatctctatagtcgcaatacctctattaggagctacagccatttggcaatttgataagattcggaacgccattctagatgagaaccctacttttccccacttcactgacctgcacaacggggaactggagcaaccacctccgacgcccgaaatagtgcgcggcgaacacggctcccaacacagcgccgcggaactccatcccagcaacagccgcccacccggagtcctcgggtaccagcgacgcggcggcgcccacgcagagcgccccggcggcggcgaggagggacgccgcgagggcgcggcgcggcacggggggagcgcgcgggtggggcgacgcggagacgaggaaggcgagcgcgaggagccccgtggcggccagggagaggaacgggtggagcgcgaggaggaggccccggggcacgccgaggcgggcgtggcggcggcgcggggacgcggcgaggtagagcgcggaggccgcggctgagagcgcggcctggaagacgaagacggcgagccaccgctggccgacggcgtcgcgcggggcgccgcgcggcggtgccctgtccatggcggcgggggcggcggcggtggggcgagggttttgggggaggttttgaatttcccctctttatttttctctctttgggtatcgacgcgtttgaagtagggggaatttgggagtttttggtgtgtttcgagtgcccgaggggagatggaggttttccatgtttgaaagcgtgttttctgtcgtataacgtgagactcttgagtgtgacttgacgaccgaagacttgaagttctcatcgccatcgatgagttcaaagctaagcttagtggttaagctaactgcttgtcttgatacatcctggtcgcatagtttaagacagggcccatcgtgtgtgcacgagtgtaccaatatgggttaatacatgttaatgatctgatccataacactagtactttgaaacttccatcatcaattcaaacgcagttacgagcggatccaagaatatctaactagatgacaccccgcgcgttgctgcggaaatacaagagtaatataaagataaaaaattaggtatgaatgattgtattgttatacactgaacacttcaccaatgttataataataagcaactgaaatttgaatcataacagaatacgctgattgtctagtgaaaggccaattccttttactagaactaaggccaattgaacacagatgcaataaattgaatggtactaacatagattgttctattattacaaaaaaaaaactaacatagattgttctatgctatgtagcaagacagaaaaatggtagacaatatacgtcatcgtgattacacaaagatgctatgtaattgcttattccaaactatagttttaatgaagtagaaactttcaaaagttcagtcgaagatgtcaataacctactgaaacaaaaaggtattcttatttattttaaccaactgaaaaaaaaattgttcttattatttcaaccggtatgtgaatatagtaatgcaccaacccttcaattctctctataagatctgcaaccttcacaaagaacagaaagttaagaaatatttgaaactactacttcttttcttctcttcagattctacaactaaacaacaaatgatattagtaagaaaaagaaaaataaatccatgagcaagcaagcaagagagagatgaccaaagcggattgtgcatgttgatctgttgaagcatcagcatgagcagaggagtgggcaaataaatcaactagatgcatggaaagactgccaagcacagatgatcaatcgagaacaaagtcccagtgaattatagagagtatataaaggcatgaagaccgactgttcatctgattcaccggttacaggagataaaataacttcaatggaagattaaagagcttataactgctgggctactacatgtgttgctgttggtattccaactgtatgtttcgaaattaagagatggctaggtgggcctctttaattagttgttgctaaatgtttattttgattgctatccccagttgattgattgattgctatccaaacgtttatgtgcaatccgatggctggaatgaatcaaggtgacgtggcttactctcagaacaaaaaattagttttaattgcacttagtggggatgacttgtataggtatataggataagacggaccgacaaactatacaaaactatagcccccttctaatagatattcccttcgttctagaatgtagcaacttaaacgatgggataagacctatcctagactacaaatcttcatgtccagattcgtatttttagaggttgctatattttataatagagatagtatatgacagaaaaaattaatggagactcaatgattgctcatatggttgcaatatcggtactagtgcttggaaccttacgatctccatggcagatcctacactgacatccgcaattgatatttttaagacatactttggtctttaaaagtttttagtcaactttggattgaaggaaattcaaatgattttaaatcttaggaacttttttctatatgttttgtttgaaacagaattttttagtatatcagtttcatatggattaccatcctatgcactaattctataggaaattttaccaagagctcaaaccttttttttcctttaagaagtccaatgcttgttcttctctctttatctatttttctctcttaattccattagatacctagcgttatattcttgtgaaccgtccaaacgtgatatgtgctagattcctatattttcaattcctgcaggatttgtccatacgtggtattctaatcctataattttcttattgctacaattttcaaatcctacgttccaaatgagcaattaagtttaaacaacagccattaatttatcataagccatgtgtgtagaaaaataaaatttgaaacttttagcttttagccaccctatagcattgccatataatataccccattataagacgttttgaatttggttaaagtcaatttcaagttaaaccaagtttatagataaatatagtaatatataacactaaattagtttcatcaaatcaataattgaatatattttcataataaatttatcttgggttgaaaatgttactacttttttctacaaacttggtcaaacttaaaacagtttgactttgattaaagtcaaaacgtcttataacctgaaacggagagaatagtaaaggtgagaggctgacattgaggacaccaaacacacacagaacgagaaaattaacggtcccatcatttcgcttattcgtagattttaagagaaacggcatatttgcaaatgaaaagtagtttgtgaataaaatttttatatatgtgttcttagtgatctaaaagtaaaagctgaaaaataaacttcgatgaaaaaaccttaaatcagcttcaattttaaagttggaaaattcaagttttggctcataagtataagcataagtgaaaagatgaggtcctaactctttgtgaaaaagtcaatgtgaagtgcaagacatatgagtgaattagggcctgtatcgtagagttccaaattcaaaaatagatctgaagctctgagttaggaaaagacaaatttatccttcctagatccacctactatgctattaaaatttgggaatatgatagtgcttggttagtctctagctctgtgttctttggtgaattccaactttagttacttgtttttcacgcgtacatttttcaaactgctacacgatgtattttttttataaaatattctatagaaatattaatttattttatagatcattagctaatatttaattaattatacgctaaacttccgcttcgttttgtgtgctgcgggagaggggttgggaaccccacaatcgaacacagcctttacatgaccttacattaggggtgaaaacggtaacggtaattcccggccgaccggcgttcgttttcgactttctaccggccgagccatatggaaatggtaatcgaccgaaacaaaaatggaaatggtaaaaaatatggaaatgaaaacagaaatggttttgctgttatactgatcatttccgtatttaccgtattcttgtggaaattatcgtttcttgtaatatggtaattaccgtattctaaatatgtcgatatttatagggcatgtctctacttgacccatagcttacatattgattgactcttcaatcaaatctctaacttttgtgcatgactaaaatggagttaatttataatttatatagtataagtttgaatttatgtatacatataacatacttatgtaaagttaaatatatgtttttataatttaatgtttctgtatttgctaccggtttccgaccctaccatcttcaactttcaaatgtgattaccatcttcaacctctcgaagataatcctgtgcacacacgtttgctagagcaaatctcccaatcaaatccagccgaatctttcttggtaaaccaaaattggtcgagggtttttaatccactcgatctactctttttacccaaaaatcaaagcgtaaaactcggataaaaatgaccaaggaagatcgccgtcatcatcggcacctgtagaacagtgattaaatccgacaattaaagccgaatcaaagggaaaatcatggagaaaatgatgagaggagtgaggaatcgatttttcaatcaaattggaggagaaaacatacaatcgatatggcggtggcgtagcgctagggttcacctcggaaggcgtgcggtgaacagatgagattataaaaccggatgagaaaaacaaaaagctagcgcatgggagaaaaaaaccggcgataaaaaagattgaccaaaaaaactaagagtacccgagaggcgcgcggtgaatagatcggattaaaaaaaggaaaaaaaaaccaaaaaccttaatgtgtgcatataaaaaactcttttgcgtgcaaagaaaaaaggaaaaaaatatcggtgccaaaaaaaccaaacgaacatttttgttttttactgggagattttttttcctttttctacatagtcaagagatgtttttttttactgacgacgacggaagctttttttttaatcgctagttaagtgacgatgtaagcttctttttaaaatcgctcgttaagttggactttcttttctttctttatttacctttttttgagtcggacttctttttctttcttttttacagaagtcggaaatttcttgtcgtagagatatagattaaaccgaaacataaaactaaaaccgttttaaacacagatgacgtaccaaaattctagtaaaaacatcttaaacttttataatagataaagaaaaacaaccctcagacgatcagttgaacaatcagtaaattgcatttcacttgttgggctcctagtaaaccaaacaccctctcaccttttcactagcgaatgcaaccgcatgcgcttctcttctcagaacgatgggtcacacactcacactgagagacggaagggtggatcgaccctacacaccccaactcaaacattaattcgcagacggaatcccaccggtcttgtgcctctacaaatcctcgacgcattgctgcagcctagaaagtagaatcagatcatcacctacacttgcaaagcttccaaccggagccagaaacgttttcgctcgccggacggacgacgacgtcgtgctggtagcgatgagctactactacgacagcgacgacgacgacgtcgtgctggtgcagcagggggcggggacgagatccgcaagggcaaaagatggcaggtacagttcgtggtcgcagagcgagttggagaagcagatgttctcttggtccctcaaagatgtgctcaacaaagacttactcaagaaaaaggtaaccaagcagtagattgttacttcctccgtttcttattataagtaaacctttttaggtttgatcaaatttatataaaaatttaacatcttttacatcaaattagtttcattaaatacaacattaaatatattttattagtatatatgttttgtgttggaggtagtataagtttgatcaaacttaaaagaataaatttcacaaaactacatgttttatggttcaagttgcagaaaaccacaaacattttgacacttggcatttaagtacatatattttggtagtttagtttcacaaaaccacactatcgatgaatggattcacccgtgagatgaaatggtcgttccatttaggatgaagacgtggcatcctattaatttcgtgcgatggctgttaataggatgacatgt

SEQ ID NO: 69381 - DNA, 7709 bp, Oryza sativa
  unsure (1)..(7709): unsure at all n locations
atgaaatggagggaataactatttatcccatgaactgcagtttgcacacaatctcttccactgtaatggtagcgtacatcgcattatccagcttgttctctcgctgtaatctgagtattatctcgcggatgatcttgccttgatgcaggttaagaaaatacccacaattttctcctcgctgaaagagtacatgggatcattcaccgtgccgctgatcgaagagactcgtgctgatctctgctctgcactggaaggcataagcatgcgccagcagctgaagtgaccaggattaagctttgctcagacgagcagctcatatacagttttttcgccaataaagctgatcccaaggacatttttcaggaagtttacgccccaaaggaggcggatacactgttgctgacggatcggaaaccgaggcacatctctgacctgggacgcggtgagaagcccttggtgattgcctcggtgctcaaagccgaggatgctgaaggcaacaccgtcgtcaggctgtcaagtaagcatgttgagcagcagtttggattggaatcgtctctcttcgcggtgttcctgatcaacatgacgacgtacaatcgcatatggagtgaactggatacggtggttgctagtgtcaggaacactgacatcattcggatgatagtaaattgcaatccaaaggtatgcattaccatgtaatatatctgctccattgcatgcaatttggtgcttatgcatgttctttaattcttacggcaggtcggccaagaatgttcatattcttcagaactgcctttacatctaccggacagagcacttggtggccttgaagatttcaagctcaacaagtcgcaaaaggtggcagtactagactgtgtgtcagcgatgcagcagcggagctcttccgtgcgcctgatctggggtcctcccgggacagggaagacgaagaccatcagcacgctcctgtgggcaatgctggtcaagaaccacaggacactgacctgcgctccgacgaacaccgccgtcgtcgaggtcgcatctcgggtcctcaatctcctcgaggatccttctgctggcagtggaaaagcctgttttttgagtgatgttgtgctgttcggaaatgaggatcggatgaacgtggacggaaacctgacaaagatcttcttggagaagcgcgctcgccgactgcagaagtgcctgagtccaggttcagggtgggtgcacagtctgagctccatgatacggattcttgagcaacctctggttcagtatgattcatatgtggagcaaattgaaagggagatagaagaggatcttgctgagaagaaaaggaacaaaaacaagaacaaggagaatgataaaaagcaggtaaaggaggatgttcctaaggtcataccaataatgccatctatctattatatactaaaagtccattaaacttcctacaaacgctcctaaaccgccatgtggctcctacgaacactcctatatcgtcatgtggcactctaacaaattatagaaattatgaggaaaaaataaaaatccaaccatcagttttcacttatgtcacgccccgaactagccccgaacggaaccagcctgtgacgctccaaattaacctgttaaccgataccaatcccaggaaatagagctggtatcacaggaagacagaatatcacagcaacagaggtctctttattatagagtaggagtacagtcatgttgggctgcggacagaccccgagctcacaactgcattacaaaagaggaaagcagaagccaagacttgaacctaacatcacaggcgcgacttgggaaccagatcgaaaccccaaaactcatcatagccgacttgctcctgaagaactcctcgtcagcggggtccatctcatcttcttcagccactggggggattatttatatagagcaagggtgaatacaggagtacttagcaagtcatgggaattatgtgtttaatgaaggcttcaaaggaaaggctgttgtttttacaattgatttttagttaaactcatttttaaaacaactaagtgagtgcttctcaaacgacacggatgagacagtacatctcgtccggtcagagtatgtgcaatgtatcagtctttgattgattcaagattggcacccggccacaactttcaaatggccacccgggcctagctgatcccgtcagctacagatgttccaaacatcgaacccaaattcccaacagcaatttcaccaagcactagtcgaacaaaactacactaaggaatcaccttacatcggcccatgaccgtgggcacggctgttcgaacagtttaataacctctgcagagggggcacactttacccacacgacattactaacccggatcacccagcccatggagaacagccacgtctggtgaccttaaggctttcatgacaaggcatttcgagagccgacacaggtttaccatatgccgacgagaggggtcccagaccaacaacaggttaggtcctagaccatactatgccaggaagcccaggggtcctccccgacaccaccctggcgaatccacttgtctcccggcatcaaggctcccctgattagctaattactcagccaggggtgtcccattccacccatgtggtcgtacttgttatatgttcagatgaaattccaaaggaatcggtccttaagtgcaagagcaggaaaccgtgctcccggcacgtcccccggtctgcgatttttggaaattcatttagttcgcaagcatcgacccaggcgtcgggtttttccaagtcttttgtaaaacccaagttttacccatcgttggatattttaaatttgaggggaggactccgacgtgcgtgcccgaaggcccgtacatcgaagtacaacagtcgacaaaggaggtttaagtgttcaataattcaaggaggctaattgcagcaattaggatgggggccggtaggctatctcgcaagccgcggccaaatttcttgtgttaatcctatccatgtattatttgcggaaaagaaatacttagatttaaattataggtgcaagatgatcaaaggtgacttgccttgctcgagatcttaagcttgatcctcgaaatccgcgcactctgggtcttcgagctcggaagctacacgcgaacgagacgactcaacaaacagcgaaattaaagccctattattgacctctaagcgtgccattgggtagatctcgagatttgaggatttttggaagttgagcggagtcaaacggatgtacggttgagaagatattgaatttctaagattattggatttttggtctaaaggaatacggatttaattaaaccctttgaaaaagaaaagaaagagggaggaggaacagacttccctcgggcggctagggtgcggcccgagagaaggggcgcggctcggccgagctaatgggccggcgggctcgagaaggcggcccaaaggcacgcacggggagagagggaggggaaccggtgggccgggtccacctcgcgtggtcccgagtgggactcgcttgtcggcggctcggctcaccgtgagtgaggtgcatgtggcgcggcgctagggttggggtgggtgcggtgcacgcgtgtggcttgcggtggacgcggcgcgcaagtggcccacgcgcagcctctcagctctccgtgggccgcgcgcacgcgagcggggacggagggagcggctgaccggggtcggcttgacccgttccggccgagctagcgccgatgtggcgccttcgtggctgccacgcgggccggcgggagaaagacgaaggcgccggccgcgaatggacggcgggaggcgacggtttctccgggacgctgtgcgacgacgagggcgacgaggtgtacactagaatgacaaggggaaaagagagggagcgagccaacggctcggattcgccggagggggctcgacggcggcggattgcggcggcagcaaccggcggcgagaaagggggaaatcagcgatggcgtgacgggagatcgattcgggcgagctagagcatctacgcgactccgggaatccgtttctagcgtcggattggacggaacatcgccgaggaaggccggcgacaggcggctactaccgagcacggcggtgacggcggtgagcctactgcgagcggcggcagcggtcggggcgacgcaggctagctacggggaggctacacaagctactgctcgagtctaaggggaggaggaagagcgaggagggagaacagggaggtgttctaccgagacgagacggggcgctgtgacgagaggccgacggcacgggagtgatctctccggcctcgggccggggaagaggaagaagacgagtgcccggagtccccttccgatcctagcgcgcaccggctcctccggcgcacgcgacagcgaagggcgacgacgaacagggcacggggcgaggcgacaatggcggaaggcgaaagcgagggagatgggtttaggggaggggctcgggtttattgggcggttatgtcggttcgaaaaccgaccttgggcggtcaagccagcgagctggcgtcccggctagcggccaaaacagcgacagggaggatgacgccggtggtggaagagaaaagggaaaaaggaaggaagaaagggggcttgccccttgcttctttgggaaaagaaggagggagagagggcgacgaggcaggaggaggagctctgcctccatcccttggaagctagcgcgcggagtagcggggccgggtcgatgacgacggcgatgacggtggggcggtttggaagggcgcggctacagggcggcagacgcgggctcaggcgcagcaggcgctgatggcggcggcgacttgccggtcggccaccttggcgcgcgcgcgcgggaagcaacgggtggcgcggcgatttgagcggcatcggcgggaagtggcaacgagagcagagagggagggagaagtgaaagagagagagagagtctctctctcgctcagcgcccgagcggcgcacgtgcctcacatgtgcgggcaaggatggaggggagaggagagttgggctgaggaggaaatgggccggggagaagagattggcccacgaactcgagggaggcaaaatagacttttcgagaggatttgatttgggacggatttgagattagggtttggatttcgacaatggattggggaattgagatctggaatggcacggacactggacaacaaacaaggagaaaattttcgcatttaggatttttaagagatagttttcccactaggcgccacgacgaaacgggcgctacaacttaacatggtggacccatcgtttcacaccattagatccatcttatatcaaggaaaaaaaatctcaaaacccattcgtatccgctccatcacgtacatacaccaaactatgtacgtacgcttgtaaaaaaaaaccacgtacgtacgtcccccaccttctctcttttttctccatttatttataggtagcaaattttttatattaaaatattaatattaaataattataatttcttataatatatttgatttcaattatgccatgtgttggtgtgtatatacatataagaaatagaccatttggatataaactcatatcctttatatgataactaaatactaatacatatcatgccattgtaaatgatctaccctctctccttactcactttattatccatattttctagctagcagcttagtatataaataattactatataatgcttattatattataaagattcattaagcagatccccataaaatatcatacagatctatccattatataataatggtccattatacatcctttatagtgtttctagctcatcacatggcacatctaataaattataaaaagtactacaaatactgcggaagaaacatttaatcaatgatttctatttaaatcgataaacctattatttttaacattaaatctatctctattaaacttttaaataaaaaaacatcttttccccttcctccccattcctctcatccacattattctagaaacattcatatgtaaattaaaactacaatgtcaaacaaaaattagaaactcgactattaaatagtgttttgtcaagagacaacatccctactttttttacatgtcatctaaattgacttaataaaatatgaaataattaaaaaaaatcacatatactcataatttatatgaaatatgccttttaccatggtctcattatttttttaccattagatttatcttaatagatagacaaaaagagaaaaggcccaatcccatccctcctgtctagctgtcctattatgttatgtccgtacatgtgcatgtctgcgccctcccccctcatgcacgagcacaacctcgcctcctcttttccttctctcccattgccctattttcatgcttattagttagatagaaaacatatttcgtgatagaaatttttaaacaactataccatctaaactatttttttattagtgcacctcattagattatttgcagtaaactttcatgagtcgaaatccaaattaactatatttaacaagtaaaagaaataaattactttagagcatattttggagactagctattggtcagccataaatatttaggaaaagccacaaagatttttaaaccatatgattaacaacatgttgcttacattacaacaatgtgaaacacttttaagttgttagataacacgtttgtggaaaataacaaataccaacgaataatatttgtggagaaaacatacttcgaagtgtgacagtgctattcggttaatattatgttcttataagtttttgaaacatgcagcccacaatacatgcccgcgcgaatgcgcgggctatcttcctagttcaaggaatacttcataagtaattacaaacggcttgagaatgatcttaatgtttgtgtcaagactttctgtgattatctccccaggtcagctacaactgcagagaatttcagttacatgacccaggccctgcacatgctaaaattttttggtaaacttgtggagcccaaatcagaacagagcctgaaaaccctgttcaaactcagccccgatggcagcatcagctcactgtttcagaacttcgtgacatatgtgcaagatagtgtgagtacagagctgaaggatgctagagctcagtgtcttcagaagctaaaacacctatctgatcactttgaacttccgaacgttttcgacaagcgttcgatagaagatttcctagtccggaacgccaaaagcatactctgcacagcttctagctcatcccgtctgcactacctgccagaagcaagcccgtttgatctccttgtcgtcgacgaggcagcacagctgaaggagtgcgagtcactgatacctctccagctccctggcgttcgtcacgccgttctcatcggctatgaatttcagctgccggcacttgtcaaaagcagggtaagctctcaccatctctattagtagaacattcacaatctctattactatgctatgtaacaattgtctgtttgtttcttcacaggtttgtgaagatgctgagtttggaaggagcctgtttgagaggctgagttcgctgggacacccgaagcacctcctggatgtgcagtacaggatgcacccagggatcagcaagttcccggtctnnnnnnnnnnnnnnnnnnnnnnnnnnnnnnnnnnnnnnnnnnnnn

SEQ ID NO: 69382 - DNA, 2689 bp, Oryza sativa
  unsure (1)..(2689): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaccacactactagaggtagcgttgcaaggcaacattgacaacagtagtgtcatgccatcgcgagtagcatggagaaatatttgccagtccatgatttttcaccgagatgataatgttttcttgccatgctaattaaattggtgttgtaaataggttcagatctagaaatgagctttcgatgggtttatttttaaaaattaaatttagaaaggttttaaaaaaatccagaatcgtgagtgttgttatggcccactaggatacctggccattcttgtaggatcgaattgaaaaaaaaaagattgcataataacgagtaaacaaaataatacactttttaagggcaataagcaaaaaagcattttcggagaggcagagacaatgaagacttgaagagccatgtttcgactcttgcactgttgtttaccaccttttggaggatcttaaggataagcatatgccttgacatggaatgattaattaatactctcttcgtactcataaaggaagtcgtttaggacaatgtttaagtcaaaccttgggaatataaatcatgaataactctcaagttgttgagtttgaaaatgtaaaaattatatgaatatatttgtcttaaaatatattttcataaaagtatacatatatttttttctcgaacgcgcaaaaggattgcacgtcaatatattagaagaatagaatgtttgtcacacgacgcaatcagtcagaccgacttatgccaagaaaggaggaaaaaagactaaaataaagaagagacgaaaaactactgtgacggttacacacaactccaaatagctggaaggggacagagccactaccttcccaggagaaccccaaaaatagctataccagctaaagaccaaaggtggccctcagagaggatggactcaaggcaaagtatacatatatcactttttaataaatatttttatagaagacaagaagtcaaagttatgttttggagatcgtgtcgctgtccaaaaaaacttcatttatgagtatggagagagtaacttgtaactgtgtttaacatcaaatgtagggagtaaggtggtgtttggatccaaggacttaactttagtccctttatttagacactaatttagagtattaaatatagactacttacaaaactaattacataaatgaaagctatttcgcgagacaaattttttaagcctaattaatccataattagagaatgtttactgtagcatcacatatgctaatcatggattaattaggctcaatagatttgtctcgcgaattagtccaagattatggatgggttttattaatagtctacgtttaatatttataattagtgtccaaacatccgatgtgatagttagtcccatctaaacaggtcctaagactatgccaaagtggaaactgatgcagaggatgagtcccgctctgaggctctatcagctcttggatccgaaagagccggtcactggcgcactcacaattccacatcccctccaagattcatgattggttgaagcggcccggcgaaacaaacgcatgtaaaatgaattgcaaataccttgatttcctaatgcacatgtcagtagtttagtcgctgaaagagcaaagtgtcccagcaagcaaaatacaaaatagccacacaatgacacaaactcaagcacttgcagcagtagtttggtcaaccaatatctgagcaccttctcctgatcgtaagtcaaatcagtaatattgtttaatgcaaaagataagatgagaatgtgcaccttctgtattatggattggatagatttcccgttcacgaattagtggcgttggttaggctgcaggtgaggtgggcttccctggcaccatggccaaccacaagctcacaaatcaagctctttcctttgcaataaaatagttgaaatctctttgtttgatcgtctcttcattgcacgctgttcttggcgctttttccagccgacctcttatctgatagtataaccataaaatacatctcagagaattctagtctctgtctgatggcattaagaatgaaatcttgttgcctcccccaatacggtcggatgcttcctcgcacaaggggtaaagtacatcctgataacgatcgaaatggacaggtggaaaacgaaagcaaaggtaagatcacacgtggaaaatttactttcaagaagatgacaccggaaatcggaatggaagcttcactgtcagagatgattcgtgcaaatgcttgctgggattcttcctccggcttagtgctgtggcgcatcaagtcaagctagctacactaggaagcaagtagcaagccctgaaccactcactcaaccgactgagcgactgaaggctttgacgtgagcactaccgatcgagaaatttgttaacgatatctcatatctccctccctgatcctgatggagatggaacgcgcgtattattgaggtcacggagggagacaagtgcagatgttgccgcgctggccccggttaactataagctgcgctgcatgtggagtggagtcaaccggggggggggggggggggggg

SEQ ID NO: 69383 - DNA, 3959 bp, Oryza sativa
aaggcattcaggcacgcgtccgttggcgttgatagctagctccagcatccccacgtctcgacgtcgacgagattgggggacagcggcggcgcgcgtgcggtacatattggtagtacatcaccgtgcactgatccatctctcatctgcctcggccggccggccgactgaccaccacgtcgtaatccggtaatcccttctttctcatctcttcctcaagtcgagccgttgcacgctaattaaagaagcttcgatgggcctgcgtggagcaatctgaattctgaaagcacgcaggccggcatcgtgcacagcaacaactcagcaacagggcaacagcaagtccctccgggatcccgagttttcgtctcttaagggcccctttgatttgtaggaaaaatgtaggaattttggaggatttcaatcctatggaaaaaaatcctatgaaggcctttgagacaaaggattgaatcctatccaatcctttaaaattcctatggaatgagtaatcctatgcacattttggaggaaagttagcaagaggtctaacctcttggaacatttcctctgagtctatctctctcatctgattcctgcgtttttcctgtggtccaatcaaacggccattcctgtgtttttcctgtgttttgcaatcctctgttttacaattgtattcctgtcagaatcctgtgtttttcctattcctctgttttttcattcctacgattcaaaggggccctaaacgtttatttaagggtttaggctgtgtttagttcaacacaaagtttagattttggttgaaattgaagatgatgtgactgaaaagttgtgtgtgtatgacatgttgatgtgatgaaaaagtactgaagtttggatccaaactttgagtctaaacacagccttagagcattaccaacgattccactgaatcttaaatctaaaaaatatttttaaggaacttttgctaatgctcacagtcgtaggcgtaattaatgtatagatgttacatgtctaattcatacaccacaccacaagcatttcgttgttgatgagtatgttacctatcactaaaaaaattagtcataaatacgaatacccatgttaagtttaaaacttgaactcgcatagataaggatcctgattagttaaagcgacactcactttctgatacgatccttccttacgtaccgtgaggccaccgttccttcgaccggtactgcctctcgggccgatgtcatgccaggctgccttggtctgggcctctcggcccataacatgtgtacatgtgccgtgttgtgcgttttatcgtgtaggaaagaagaggaaactcaggtgttcttcatgtaataagaaaaacacagaggaaactcaggtgtgacgaactgcagaaattaggccctgtggcaacgtatatgaacattgtagcctagtttgcgcatggcatgggcactttcccaccccgtgcatttcgtagaaataacaggagcagttgaattagatgaacaattagaattccctgaacctgaaacacataccgactgttgaattagatgaacaattagaatcccctgaacctgaaacacatacccacacctacaaggctacaactgacagcgtacaaaaattgcaggcagtgtccgtatagagcatggagattgaagaagtttcaaagctgcactgtggacgttcagacttcatagtgcaccaggtgcgtctcatctcatgcttatattcaagctgtttctcattgttctcctcccaacacccatattgccctttgtcatcatggcaacgaattccccgtagtcaatgcgaccatcctgatgaaaaggagtgaaataagtgcaattagatcactgctacataaaagatattttcttctaagcgcagtaactagtaaaccatatcaatagacattcaaccacgaacatttggacgatatgtattgaagaaacaacacaaacagcaatgggttcagcaattcacatgttctacaaaatgaatgttcaagtttcgtacaccacagtatatcactaggaaagcataacctgacatgtcatgtcctgcagatatatccctagtgattcccatgaaattattactacctccatttcaccacatatatccaatctgttaggaaaatcaagaccatatgtattttctatatttccactatctaccccaactttaatgttgtggaagaggtcaattggttgtaatattcagttgatatgtgaggtatggctatatctcgttaatttttcttagatttagtgctgcttttgtttttatgtatggttaaattgttttttttttgtgaaacagtactaatgcagttttgttccatgacaagctttgacaagtgaaatcttttaaagttccttaaacagattattaataaagagtaaagtgcataggcggtccttaaacttgtaaggttgtgtcatctaggtccccaaactctcaaaatgcacatctaggtcccagaacttgtcaaagtgtatcatttaggtcccaaatcgacatagcccctatagaatcctatgtgacgctgatatggcatgccatatggacgtgatatgtccttttcttctttctcccttcttttttcttcgttttcttctcattcttcttttttttcctttcttctactcgggaaaagaaaaaaaaaggagaagaaagaaaaaaaagaggaggaaaagataagaaaagaagaaaaagataaatgggtttcatttgttagtcaaaatgatgccacgtcttgtccgtgtggcatgccacatcagtgccacgtaagatcctataggggctagggcgatttgggacctaaatgacacactatgacaagttcttggacttgtatgtattttgagagtttagggacctagatgacacacccctgcaagtttaaggaccgcccgtgcactttactcattaataaatatttgtatatccttcctgcatgtgttagctataacaaactaatggggcaacatgcttacattatcctgatcagcttctttaatgacgtcatcgagaaaagcatctggcatgttatgctctttgcaagcttgctgaagctcatccaccgtaatataaccactgccatctttgtcgaaataagaaaaggctgccactagatgttcctctcgctctagtttattgagatgcagagtagcagcaatgaattctatataatcaatggttccactgttgtccacatccgcctaaagttattcaaacaaaaataaatatgtaagcccacagttcagttttccaaggaataataaactctacaccataaaacatacacccgttacataagggagactgtaaattaaaacaacaggggcacacaaaaataaaaaaccgagatgaagttataagcatttactgccacataagcatatgctcactgaaataaaaataacctttctgtgtttgtcctgtttttgttcgcccctagttagttgagtgaaagctttctttgtaaaccttgtttacttcttcttaatgcacagtacagatatgtaaaccttttgagtattcacaaaaattgaaaataagttctagctgaagaaagcctaaaaaaaaatgttttcttgtggtttggaaatgaaatcacatggcaatcagagaagacaaaaatatgactcaacttcaaataatcggtgaaatacagtagattagtttaatagagatagtttgtctaatttcactcacacggtcacacagacaacagttctgcctaagatgcaaaccatatactagacactaaggagacacatccatggcattcagtttctgcaatcaatgatgttttaattcaatgaagaaaaagcatgggtcactgatcataaaacttggcttttgtgtacatgtgcaacagtgcaaggaaccaggtggcagactttcagtgctctttctgttcagaaagaagcaatctggatcataaaatatctaaa

SEQ ID NO: 69384 - DNA, 2938 bp, Oryza sativa
ataagatcacgaatctcagtatcctttagtgttgagccatattttctcatgccatatttgagttcatcatatgtaattgcaccactattatctgtgtccattgccttgaacatttccttcaatcctgcaatctcctcctctgaaaggctttcagcaattacctggcaggacaaaccgtcagtcagcataaaacttagcaaatgtgcccccataagtactggtcatgtaatagagtataaaaactagcccacaaaagaaaattcagataataaagacaggaagcaattctgaaaaaaaaaacaatcaaaaggaacaagacaaggtaacggacactctagccagcaaacaacaatggaggatgacttcaaattgcttgtgaaaggtgaagtactatgatagctaccacagtaactttagaattgccaaaaggaaaagaatgtactcactcgcaaagccatcttctttaacttattcattgctgaaaactgcttaatgcgagaaagtacagcaggatcaagaggtcgatcaggagcgactccatggtcacaaatccacggatgacctggtcaggtatgaaaataattctttaacatctttgtccaacagctgtgcataagtagttaccatatactgttacaaaactaaatatttgcaccatagagggcacatttcagaacaatacacacaccaaaacatactgagttattgaagaaaagaactagagtaatggtgaaaataactaacataaaacttcatgagctgttaggcgctccttggggcgaggattcaacattcttcttataagatcctttgcactatcagaaatcacaggccagggatcggaatcaaaatcaattacaccttttaacactgcatcaaatatcccttgctgcgtctctgcattaaatatagtacaggtcagcttagacgagtgaaaacacaaggtttgaatttccaagtcaatttatgataataaaggagtaaatatatacctgcccaaaatggcggtacaccacttaatagtatgtaaagaatcacaccagctgtccaaacatcagcttctggtccgtagcatttacgcaacacttctggggccacgtagtatgggcttccaacaacatcagtaaaaacttgacctaagaatagtaaacaacaaacggaatttctttataagataactaattacactgaaaaattaatacagtaaatgctgcataagatgcacataaatggtaaatagatttatagaagagagattcataggaagtggatttcgcgatagatggtacttttagctatatgtaaagtagcttctattagttgcaatgaaacagttagttttagcccttttagaagtggtcaaatcagtatatcggtgaataacatatatttagattcaaataagtgtacaaagacaggttcgattttgattgttcctattgctgtagtctgtacagcaaagcaccaaacaatcaatttcttcttcttttctttttattattcatccaccagcagcaggaaacaattcagaaatcgatcttcacatatttgtcccataattaatttatcttttttgaaaaactgtaagtttaactatttttctttagtattcataaactttttaaatgaatgcaaaaacccatattttgctagcaatctcatttacgaacaacaattgtacccaaaaaagagagaaccccagaccaagagcagccttcaccatctgatgcgtaaatgttaacatctaattatcagattggatcagtatatgttgagtcccaatgaatgaatgaaatgattttaaacgactaaactatattcctattctctattctcaaatcttaatttccatacattctctagtcagatgagctaaagcaactatgtatcattaattccaccaaccaaaccattccatctattggactattaccatcaacgattgctcagaaagtgatggagcaagcgcaacagtcacagaaataaataattgagtttctaacagcaggggtgactcaccaggcttgaagaacacagacaagccgaaatcgatggccttgagcgacaaatcgtcgtctttattcgccagcaagaagttctcgggcttgagatccctatggataaccccgagcgagtggcacgcctcgatgacaccaacgatgattcgcgtgagctcggccgctttgcgctcgctgaattgcccgcgctcgatgatgcggtcgaacagctcgcccccggcgcagagctccatcacaatgtgaacgtactgcgggtcctcgtaggcgcccttgatggcgacgacgttccggtggcccgcgaggtggtgcatgatctggatctcgcggcggacgtcctcgacgtcctccttggtgatgagcttccgcttggctatggacttgcaggcgtagtccaccccggtggcgaggtcggtgcagaggtaggtggtgccgaactgcccctgcccgagcttgcgcccgagcgcgtagtgctcgctcaggctcggggtcgggtgcccgagcacgttggccgtcagctccgcgggcgcgggcgccccgcgcttcatggacgcggcgtgcggcgcgtccgccgccgccgcagaaccgcgcggggccttcttcccggccggctcatcggcggcggcggcggcggcggcgctggtggcgacgggcgcgtaccccgcctcatcatgccgctgcgacgcgccgcggaagctggcgaagtacttggatctaagcgtgacgccgcacgtgttccccatcacgcgctgatgatgcgcgccgccgtccacgcggcctcctctcgcatctaccctaaagcctcgccgcggggtttaggtagcgcgcggcgcggcgaggcgagcaatggagggagttggaaacttggaatcggaagcggacggaagcagcagtggggattgggaaagagaggggggaggtgg

SEQ ID NO: 69385 - DNA, 1895 bp, Oryza sativa
tgctgattcttcggatcctgccttttccttccttcattattcgtttggttaatgcttgatagttttattagtagtagtacagttctccagtattttgctgcctgcgtgcattgcatacattaacattcacatcctgaatactgtacgtacgtactctatcagataagggtctatggaagctggtacactgacgagtcacgacagaagaagacgttgaaaatacatgccagcgcgtcgtcggtgagaacaagacgggttcgtgcaaggggagagaaagggaccaccgaatggtccgcgggcaacgtgcggcggcgggggatcaggggcgttcgtgtgggtggtggcaccccaagttgcagtagaaacgcttgatgcttcccttcccccaaggcggtctcttttctgtaaccaatcgttcgaaggtctcggcaggttacagctagatagccgtgcctacccgcaaagcggagtgcagatgactgcacgggtagagttgagagcaagtttaatagtatagcccactactagctccaattcatctctagccaatttaatagttaattcatacaatagttgcttactatactattaatactcggtcccacctgtcatacacacattacgtcttagagtccgtgctgcagctggctacatatttgtagcccgctgctcttctctctcatcctttatctcattaaaatatgtttacagctggctaatagcttgctattgtacctgctctgagtcggataaaagagggctacacaagctgccttatcaaatttgtacttgtgtggaagatagacaagagaagagagataaaaaaaccggttacagatttgtaaaaaaaccggctacagatttgtagtcagttacagcacgagctctaataaactatttgagagagatgggtggagcattaatgatacaatatatttctacagctaactattatatgagtgagttattagattgacggtagatgatggtttaaattttggagctggtagggtcctatattattaaactttctctaatcggatgagatctaatcggatgagatgaatgaaaagaagaagaaaatgcgtttgggtaggattggtgccatatcgtctgattcacaatcattacgactacaaaagcaaatcgggactattcgtgcgcgaaatcatgtgatgaggaccgaatcatccggttgaaaggatctggaataagttcatctaaggtcccttaacttgtcaacgaattcgattttcggccttcaactgcaaaaccagatacaacgggtccctcaactattaaaaccggtgcagattaggtccctggcggtttcgatggtggttttggcctacgtggctaattttgacttggtctcaatctgacgtggcactgatgtggcgcttacgtggcaattcgatctgagaaaataataaaccccataggacccacatgtcagtttcacaaaaaaaatagcaataatagtgggaccaacgcgggcccgccatgtcagtctaactcaccccctcctcttctgcttcctctctctccttctcccctctcttcatctctctcttgcggccggcgacgacgacggcggcggaaatggagaagagtggccgccggccatctctctcttgtgcgcgctcgccggtaggccagggagctcgcctagctccttcccaccggcgggagaggagggagcagcgcgccggggcataggcgtgacgcgccgggcggcgctttgaggcggaagtatacgctgatgacgtggccgtcggaggtgaaaaaggtcgtcatagactcacggtattggcggtgtcctcggcagcggcggagcaggagttgtagttggagtcctcatcgtcgacctcgagttcgtcaatgtgctcgagcat

SEQ ID NO: 69386 - DNA, 5566 bp, Oryza sativa
ccgagcgcgagccgacggaagagaggagcggaagagaaagaagtcgaagcgggagaacgcggagcggaggtcatcggctctggcgccccagccgagccgtggatgaagagcttcctgctcgcgggatcggcctccgccgcgcgctgcacggtcgtaatcgtcgctggggtcgtcttcgcggctggtcgcctctcccctctcccgccggcgaggtggccccctcacccacccgcgcggacggccgcctccgaggatgcgcgcgtgtgtcggccggtcggcgagacacgttcatcccgccgccgaggatgctgaggtcgacgtcgacgtcgtccgcagccacggccgcggcggcgccgccgggctggttcccttctccccgctagtttccctcccgccagccgccgcgtcgcgccccttctccccgccggcacccgccctctccccgccgcctgtcaaccgaagagaagagagagaggagaggggagagagatgaagacagagaagatgaggaagaggagaatcagaatgacccagcgcaagagagagatgaagagaggggagaaggagagagatgaagcagaagaggaggggatgagttagactgacatctggggcccatgtgggtcccaccattattattattattattgtgtgtgaaactgaaatatggatcccacggggttattattttccgaattgaattgccacgtaagcgccacgtcagatcaagaccaagtcaaaattagccacgtagacgccacatcagccaaaaccaccatcgaaaccgctgaaggacctaatttgcaccggttttgatagttgagggaccccttgtatctggttttgcggttgaaggacgaaaatcggattcgttatcaaagttaaggcaccttagatgaacttattccaaaggatcccctctccccgttgcaaggcaagaaaagggttcatagggcacaatctgctcatgttctccctgggcctcgcgctatggcccatacggcatgattgcccatcttaagctgataagctctcacccaaactgtgagagcttagttgaccctaatccattttactagcaaacctacattcattggcttgaagcgcaaccacgtgatcatgcgatgagtcctagcgcgacttcgtctgttcacgagaaggattaattcctaattcaaacacaatcgtgcggtaaacgtagataagtactcaaaaaccatgtcccacaaagaggaggtcgagtcgacgttcacagaaaggagtactccaatcgcctagcacagtgcgaagtgatctcggaaatcgacctgtgactgttcacccgtggtttccacgactcgcacgagctaaaagctcacagtaatcaccgttgcagataagcttcagattaagagcaggtataatagcaggctataagctagctacaaacatattttaaaaagataaataaggagagagaagagtagcgggctacagatttgtagccagctgtagcacggactctaagacgcagtgtgtatatgacaggtgggaccagatattaatagtgtagtatataactattgtatgaataagctattagattggctatagatgaattgaagttagtagtcggctgtattattgaacttgctgtcgcgcgatagtgcgatctgactcggctcgcggatcccatccgcctcccgacacaccactagctccaccacccaccgttccgtatcacgcgaacgcgaagtaatcagcgagaggctgccgctgaagcgagcggtggtcggtggacatcagcggccgcgcttttttggtcgcgcgtggccgtggacggatgaggtttattatgccatcgcgtcgcggcgtatacgtgtagcttgtcgcggcgagcgtttggccgacgcgcaacgcaacaatcctgtgctgcttgttccggttccttcccaacccttttgcaagaacacatcccggtcgtggtcacggtctcacggaccttttcctgggaccttttttgcacttttcttcggttgccatcttcgtaaataacctcaacgacaggggtatcactcaaaactatagtacgggtcccccgctttctcttcgtcttccccgcgctgaccgagcttcgcgatctaaaagtcaaaaaccaatttagccgataattcggctagtcattccataataagcccaattcttgcactaaattggggcaatctgctctttgttttcggctggtctcgggggatgtgtggtggtgattaaccccggaacccccccccaattcccagatttaatttcacttgcaatctgtgattcttctggtgaggtgcaagtgcaacgacaggtataattgaactacaaatcgttctatttttcgatttctagaaattaaatttgggatagtcctccagaaacctaatcctttttgtcacttagggtgttcaagtttgttcttgggcgttcttggtcctttggggttccaaaggcgacttctttcgagaggagggaaagaagggaaatgagggatgttctcgtggttgttgaggattgcgtccgcgtgcttgggcccggcccggaggtacgcgcgtacgaggaaggatgaagatggcggcgataatggcggcggcgtcgccgacggcctgctgtggtcgcgggacctggggcgtcacgcggcgggtgagttctcctttgccgtcgtgcaggccaacgaggcgttggaagaccatagccaggtcgagacgggctccgccgccaccttcgtcggcgtctacgacggccacggcggtgccgatgctgctcgcttcatatctgatcacctcttcgcacacctgatacgtaagtagtcgcttccttatactgttcttcttgcaatagaatccactccagttcattaatcgcaactcttcatggcttagtttagtttcaacttgtaggtggtgatgaatgaattttgtgtggttttactctttagttgcttcatgatgcacctgttggctatgcactgagcagtagcatttcctttattagttttttggttctgtaattattctgaatcattggagttacctttgttgattgctctttgctggatgcaattcttgttggtatacattccactcatcgagtatgctgttgtttcatgagcagtgcaatggacaacgcaatgctcttaccagtgactgagtggaatctgatcattggacaagctatcaatattcttggtcctttgcaataacagattactagtaggtactgtagtttcttgtcgtgttcaacatcttaatgttgtcttttacttacagactgacttgatttacgtgagatgctactgagtaagtgtatccactgactgcatgatgtgaccttatccttgtcgttaataaatggcaagcatatctcaaccgaaattgttcagtgcaccaaaatgactgctcaacctttcctatctttctaggacttgcccgagaaagtgaaacagtatcggaggaagttgttcgaggggcattttctgctaccgaagaaggtttcttgacacttgttcggagaacgcagtttttaaagcctatgatagctgcagttggatcttgttgtcttgttggtatcatatggagaggggtactatatgtggctaatttaggtgattctagggcagttgttggctatttgggtagaacaaacaagattactgctgagcaaattacaagggatcataatgcttgtaaggaggaagtgaggcaggaacttatttctcgtcatcccgatgattcacaaattgttgttctgaagcatggcgtttggcgcataaaaggcataatccaggttggtaagcaacagttattgagtaactattacaactataatatggtttcaaggatggttgtgattgtatattaatttggtaatgattggaccatattcacttgttacacaacaacccattagaggagccaagtaaaggggtagagggcaacaaatcatagaaattaaagtttgtgctttagaaggattttgtgtttcttgtagtttacaagagattatgaaggtgatcatgttatttattttggtagtaagagaacaagaaatactgccgtgtcatttagattccccaatgatggcccaaacatgttgagcagtacattatcaagattttccgcatatgcaaactaggtacttgatgtaaaactattgtcacattttgtgattacttaccaggtttcaaggactataggtgatgcatatttaaagaggcgtgaatttgctcttgatccatccataactcgcttccgcctttctgagcctcttcgccgacctgttctaacagcagagccatctatctgcacaagagttctttctctgcaagatcaatttgttatttttgcatccgatggtctttgggagcacttaacaaaccaacaagctgttgacatcgtctacaaaaatccacgagcagtatgtcttcagacctttacttacatgtgtcgttgcttgtttttctttgtttgtgggactatcccgcaatgcctaggctgattacttggaaaggtgctaaatctaatttccataattttggtagggaattgcaaagaggctagtaaacacagctttgaaagaagctgcacggaagcgagaaatgaggtttgttgatcttaagaaagtcgaaaaaggggtgcggcgcttcttccatgacgacattacagtcgtcgttgtttacatcgaccatgagttacttcaggagaaaaatgtttctgttcctgaactttcagtccgtgggtttgtcgactcagtaggtccctcgagaatttcaggattcgatgctatttcatgatatggtgacctagcagctcaggttttgtgccctgcattgcagtagcatcagagttttacgctagagcaagcattgctttcaacttggtttttgttttgtacatttacctatttcaggtactaaaaagttggtttcatgcttgcaatatgctcggaataatcacaacatgctgtttttcttctacgtactacatcacaacagatggatactgatgtgaaaattcccaatttttggtaatctgagcaaaacaaaaaatatatttttttatgtaaacactgaggtattggatttttattcgtaagcaggacaacgtaattccgcagcgtcccattaaaacaattggacgccaccgatctagagcgtccggccttctcacggacgcgatgttctcattgcgtccatagcccacgggccaaagggctctgaaaacagtatccctgttcttctgcatcctatcaccgtaaaatccccaatctgaaaacccacgagtaaaccagcggccacaaaccttaacggcgtggcgacggcggtacccatcccgttatttctcttgatcgagccttaaggtatcaagcttgccgtcgtcgtcagttctaagtacgcacccacgcgactagctctcagccatcaggttagtcgtcttacacatgatgagctcttttggttttttcgttggagactaaatcgttgtgcggcattctctttctttagtgatacattatagtgctgctgcattaagcattagttgttaat

SEQ ID NO: 69387 - DNA, 4589 bp, Oryza sativa
ttaattgaaatgccaccacagtgccacgtcagcacacagactaggtcaacaccgccacgtcagcgccacgtcagcgaaaccaccctccaaagccaccaagggagtcaaattgcaccggtttcaatagtttgtgggtgaagatatccggttttgcggtttaagatcatggattagattcgggtctcttttgagggtcatgaagtgaacttattctattttggaatggagggagtaggactacagcaaaagtgcatccagattaactgcatcccaacaaatctgatgacgtggaccgaattatgtccccgtctgaggactgagagcccacgaagcaccgagtgcacgacgctattctttactccccgccacgtcatccccctcccccaccccacggcccacccctgtgcccctgtaccaagacaaccactgccacatgttgcgcctcggacgagtcccgccatggccccacgcgtcatccaccgggagaaaagaaagcaacaaaaacacatggccagcgatttttcgtgaattttctggcgcgcgccccacacctttgtggccaggaggcgcccatttgtagcaacccgggaaaggcggccttggtttttactatcgttctatccgctccccgctcgcgcggcttccggaggcgcgacgcgcgtcggccccggacaccaccagttcggtggtggattgcggctcccctctcgggtcggtcgctagcagcggcgtggcctgacgtgtcaaaaaagcgcagcgaaagtcccaaagtcctcgcccccacccggcgatctttgcgaccggacccgtccacacgagcgcggtcggtcgttgcggccgcatgccgctccaaatctagaggctgagatatttcctcggattttcaaaaggatttttactaggaaaatactccaattcctcgatgatctgtatctgtactccgtgcaggataaggtaggagtagctagctagcaatcccgtattctgtgaggctcgataaaagagagtactgctgctcctgcttgtgttgccatacatgttgacgtggcatcacgataaggtggccctttttaatcttggggagataagatttagcccttggtgatttaggaatgttcacatgatgctcgtcatcgaaaacgaatactctttttcgtcgctactactactctactctgcaagttatcttcgcgtgtcaagtttagtgagcgggggcaattactaatggcgcattagcaacacatgacagcgaggttgccggaggagcatccccagccacaagaacgagcggcttcccgaattcccccaccggattatttatttttcttttcgcgcgaggaaggtatagggggaaaaaaataaagaaaaaggagaaaaagagacggggaaaaaacgcagccaaaagaaaagagaagagggaaaaaaaacgagggaaaaagtttggcggaaaaaatcgagtcctacgtggcgcgtctcgccatgctctttttctcccgtcccctcctccctcctcctagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccggtaaattgagtttgatctttccgtttcttttcttggcgagatcgtttttgaatgaactttgtttttcggattaaatgatgttactgggaactgaccgtgtgctgttttttcccctctttttgtggccgttctgtgctattcagggaaacgccatggcaaccgacgaaaacggtgccgacgatcgcgccggcggcgagagcaccgtggatcatctcaggagccatatgaactacggcgacatggatttgtcaggggaagagcacgtgccaaaggtaaattactcctccccccgaatcgcggcttctccgctgcaaaatcccgtgcggttcttgtgtgcttgagttcgttggctgctcgattccctcttaaaagattgtgttccttccttgcacgcttgcccccgaccaggcgcgaaagccgtacacgatcacgaagcagcgcgagaagtggacggacgaggagcacaggctgttcttggaagccctgcagctgcacggccgcgcatggcgccgtatacaaggtatgtctcatcgaacagatcgaattttcatggcgatcgatcgcaattgtccgtattcgcctgtgtgccgtaacgtttgtgttcgtctgtgtgtggatgcagagcacataggtaccaagactgccgtgcaaatccgtagccacgcgcagaagttcttctctaaggtcgtacagcctttcgttctcatgtaaacaacaacaaaaaatctctgatctctgccatgaaaaaacaaacaaacgaaaaaaaaaaaaccattggttgtgttacttgattgcccaaagtaagtcgccaatttttcaattttttttcatgggagagaagaacagatgatgtcatgtttttactgcgggttgtttcacagagtttcctgacgctgtgattgcgcggtgctctgcaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcagataggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaaggtatattctttcgtgggcagcacatgttggacaactttgtaaggcattagttcttccaattttgcaagaatacaagatattccccatcagaaaagcaatatttaggaccaataatttcagtcgagaatttctgacatcactttcagagaaacacaggtttttttagccttttaggtaggagtatctctgaatcaaattgtgatatgcaatctgatcatctgcagttttacatggtattaatttgatctattgtcgccaatggaaaaataaccatacccttttagtgttattggcacccttaataaattctgtttttgtttttcgaatgtgaatttcagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggctgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtactactattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgcaatgtagtctgtacttgtgtgcatcgaatcagcatagatat

SEQ ID NO: 69388 - DNA, 5470 bp, Oryza sativa
atcaaactgaagattgtgtgggcttgtggcaatttatttgccttcagctaacagtagcaacaccaaccaagcatggtaaatacgtacgttttgactgccatttcccacaaacaaatcagcacgaaatcacattagcattcaagaaccaatcgccaattcgaaactttgttgtgttttttttctgcagcatagttcgaacttcgtatacagagatactaccactattctgttgcttttagatgattctctcaactactgtacgtgcttcaacaacagcttaccccttgttgcaaattcagatcagcattcacatctcaaatcacagcagcaacgggatcagaaatgcaggaaacaaataattttgctacgattgaaatcgtaatgtcattacatctatggaaatgagcaaatcacaaccaggagttgggatactactaatcctactactaaaaacccacccgtggcacatccgggtctctctacaccagcaaagcaaaaggacacaacaagagctaaaacaccagcaacagccagtccaggaggcggcggcggcagaggcggccagcgcgagggcgagggaggaccggagggctcagccgccgaagccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatgagcccggagatgcgcttcacgccccccctcctcgccagcctccggatcgccggcttggtgatcccctggatgttgtcgcggagcaccttgcggtggcgcttcgccccgcccttgcccagccccttgcctcccttgccgcgcccagacatcgccggagaccgagacgagaccgagacgaatccgagatggaagaagagagaagtctactacttggggagatctgaaatcgctgtggctcttggtgagatggatttggatttgggggtggttttatagaattttggggggattttgagtttgtgtttgggcgggagaatttttggggatagatttgcgcttttggtgggtgggtttgggacgttggattggtggtggacgggcgcgatgggttggggtgtgtttccgtggattgatgacgtggtgggaggcgcggggatggatccgtgggtggggggaggattgccgttggattgaatcggatggtggggaagctcgtcgttgcgagtggagcggatcggtgacgtggcaatggttctgtggccaggcgaggaacgtgggctgggccgggccgccggttttagctcggtctcctgatcagtcacgaggcccgtagcgtcaagtcaccggcccaccaccaccgtccggcgaataaacccgccgcctctcgtttcgccgccgccgccgtcgtcgccgtcgccgtcgccatctccaggtgggtgctatagcgataggctatggctttcgcgccgtccgcgcggagggtctcggccgtgctgtaccactacccgtgcccggacggcgcgttcgcggcgctcgccgcgcacctctacttctccgccgccgcgctccccgtctgcttcttccccaacaccgtctacgaccccatcaggtaaatcttctgtaacttaagagatcgacctttgggccttcgaactactagtttctgcttccaatgttcttctcctccataggttcgtttgaagagatgtgaaatcggcaggaagctgcaagcgagtacaactcttcctttacaatgtctaactgtagtttcagttcgtttagaccgaccaacatctgtggagctgctcaatgttcactttggcattgctttgcgcttattaagctttccctttgtattttagtgggagaaaattgcatctagttggcattctgacaagtccctttttggaggggaaagattatgctttggggtttctattctgtagtgacgtttggtatagtcaggcctaggtgaaatatacatttttttcccggatttcaatatttcatgaattatgaaaatgatgaatgggaggtcaaaattgaacaaagctgtttgatgattttgtcatgatatgagcctctgcacagcagatacagtgatgctcaagtgtttctctttactatagcattattcttactgttaccctctctgtaggagtgatgctcttccatttgatgaaatcaaagatgtttatctcctagactttgtcgggcctcctggttttgtcactgatattgccccaaaagtcgagaggtttgtaagcatttatctactgctatttgctttaagttttgttctgtgtgtgttagtttcatgtgcattatgctgttaatcttggattcttagaaataagattcagcctatgttcattctgtcattcatttaatatacagattcgatttccgtacacttcatgagtagattcagtatattctgtaaaatattttggggaaacacattgtggccatcaactgttctgaatattgctgaactgtagattgtagaagttatgcatcaatatttctatacattctgaattgttttgtagaatattctatccctaatgctaggacaattctaatgtttttatcttgttcagtgtcacaatcttggatcatcataaaactgcctttgaaagtttatgcgggaaccccacactcggagaaaatgtcaataaggtgattgacatgcaacgcagtggagcaacaatcgcatttgatttctttagcaacaaactcttgacaataggtagtagtttatggaatcatagaagtggcaattcttttaatggggtgaaatatctacctgataacaagcttgaaaccgtacacaagcttttcaagtttatagaggatggggatctgtggagatggaccattccgaatagcaaggccttcagcagtggcctgaaagatttggacattgagtttgatgtcaatatcaacagaaagttgtttgatcaggcaagtaacttggtactagtgttctgctacagtagcatatcctcattaaaaattcatggtacaaatctagcaccaccacttttgcatcactaaacctatatattgctagcctaattgttggttaaaaacaaagtctagatcttaaaatacattagtgccttctatacttggacagaatgattattgatgttgtcctactatacgagagctgttacaaaacattgaaatcaccgagctagccatcataccaaaatgctttttcatccaaagcttgtattgttttggtccaataacttcctgtgaagtggtattgttgcagttactggaactggatcctgaggaagtcatttctcgtggacaagcaacattgtcacacaagcaaaaattaattgatgaatgtctggagaaatcctatgaaattgcattaggatgtggcaggttcggtaattgtctggtaaatacctgcaggttttccttttctcttgattattttgtatgttcattaatattctattcatgttttgtcaacattctattatgtgaaggtgaatcgtccctacattcgtctataaattctgttatactacttgtttgatggggctgttgttgcaatttatgatggtccatgagctatatgtttgatccaaattagcacatttccagtaaactggatcagtagctatatttcgtgaccagggattaaaatttgacatattacaagaaaaaatcctgtggtcttttttggtacacgtagctttccagttccaggttctggaaccatctggtgtgcaactccactatccttacataaccaggacgtatcttttttccattagttctgcatgttttttttatttgtgcaatcattcccacctgaatttcaagatagcttacttatggtagctttatggttcgccgccatcgaatttgaggttctcttattatagcttaatactttactgatgcagaggcatgcaaccattcctacagcctaatgtctcagtatccgtaatactttttactctctttgtttgcattttaccaacattacaggctctgctgaattatatttttattgacccttaggctgtcaacgctgatgcaatttcaaatttgagaagcgaacttggaaatcagctagctgacaagagtcgtaatttaaatctgaggcaagttttctgttcaacctctccatgttgatgaacaatccatattgtttcttcaaagcgctatgttgttctaacacgaaccaatggtaccttctccagaagtattggcgctgtagtgtacaaagtacctgagttgaataatgacaatatgctgaaaataagtcttagaagtttgaacgaggaagacactacttctatctctaaggtacttcatcctccgatcaaatctataaggctgtaaagtagcatctgaaaatgatctattttaaggctgttgatttgttggcgtttgactctttttgtaggaatacggtggtggggggcatcggaatgcaagctcatttttgttgagcgttactgagttcgacaggtggaaggttggagctgaaccttgcaacactaaaatgtaagaacttcatcaacaaattgaatggttcataaagaaggaaatgcaggatgttacacaaaagcacaaaatggaaaaaacatcaagtcctaggccctgttcttttgttttcttagctaggaccagccgtgtctagctatctaggcacatgcacatccggtcagtggcgtgcctgtggttcatgaacatgagcccccagtatcattgtaagaaaaaaaaaactgtcagggtcgttttgaacatttttgttggagaagccaattgttagggactgactaggcgttgatcggctgatcgctattaaaggtgttttgaacgattagttgtcacaagcaagtactccctctatcaaaaaaaaattaagctaggagatcctagtagaacgaatttgtattaggagaaatctcctaggttgagttttttttaagacggagggagtagaccggatgcgacggtatgattcatgacatgaactgagcagaagggaacaggcttggggcatgatcggatggctcatagggcgttcaaagtgcaaggacgtggccttcagccccatagaaaaaaacgaatattcagcgccacatcagcggtacgcgaagccaaacgaggttctcgtagccaaacatggatgctcgttcttcgttcgtcgaacgacttgcggagggcgaagaaagggtgcactgccgcgttgtggagggcggagcctcgcgggcgtggcttcgcatcagcgagggaaataacccccctttcccgcgctcacctcaccagagagaggagcggcgccgccaacggggagagaggagagcgtcgcggggctcatcgcggcccccgcctttgcgacggcctccgctggctacccctcgatctgcgcccactggagtttgtcggccacg

SEQ ID NO: 69389 - DNA, 2306 bp, Oryza sativa
gcctgcaaatgggcggcgagggggcatggaattttgcaggcggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggaaacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaagtgacgagcctcccatacctcttggtgcattacatgatgacccaccaacaatgaga

SEQ ID NO: 69390 - DNA, 2414 bp, Oryza sativa
tcataccagttgctaccccttgtgtcatcttcttctttatttgcttgctcgatctaccattatttctattcattctttttggaacctttaaaaattggattttatagtttttagagtttattgtcaagttggatttcatttttataatttctaaatgtcccgtcaaacgttgccattatactcctctacggcccgtccactgtctcttctctttattgtcattgagattttaaaaatcgaacataattatcgtttgggttcattttttactttctagaagtccagccaaaccgtcagcagctttgccattgtactcctctacggctcgcccgctgcctcccttctttattgtcattgagattttaaaatcaaacattattatcattgttttttttttatttttttagaagttccaaacctttaaaaatggacttgtagtttcactttttataacttttagaagtcccatcaaacgatgccactatgcccctctatagcccgtccgccgccaactctttattgttattatgattctaaaaatcgaacataactattgttggaattcatttttttattttctagaagtcccgtcaaccttcggcggctctgcaactatactcttatacacccccgctgcttctcctttttattgtcattgagattttaaaaattgaatatgattatcaatgagttttttttttactttctagaattcccggcaaccgcattactaatttgcttcacggcctgcctaacgtccctccttttaattgtcattaggattctatttggtgttttattaacaatttttatatctcgtatcaaccgccaccactctactcctttataggcatgttacttaatttatctcgtcatatgttttagatggtcttttctttcaataatctttattttatcacaaattttagttatttaaaaattgtattcctaattgatatcttatttttctttttttaatttcagaatttttttaaaaaaattttagttaatatcatattgtattctttgaatgtttttattttttattttcaatttcagttgttttaaaattgtattcctacatgaacttttgtcatgtgttttagatggtcttttctttcaataatctttattttatcacaaattttagttatttataaattgtattcctaattgatatcttatttttcttttttaaatttcagaatttttttaaaaaaattagttaatatcatattgtattctttgaatgtttttgttttttattttcaatttcagttgttttaaaattgtatttctacatgaactttcttttaatttttctaattttaggtattattttatttttattctcaattttaattaatatcgtattaggttcttatatggattcttctttcaatattgcatatttttaatttcgaatttcagcaaattttaaattttattcctacatgaactcttcttttattttcttttgctaatttcagatttatttatttttatttcgaattttagttaatctcgtattgggttcttatatggactcttcttttattattccttatttttaattccgaatttcaactatttttaaattgtatttctacttggactctcattttcttttttaattttggattttattttatttttgttttgaattttgattaattccttattaggttcttatatggaaacttatttcaatattccttatttttaattccgaatttcagctatttttaaattgtatttctatttggactctcctttccttttctaattttagattttattttatttttatttcaaattttgattaatctcgtattgggttcttatatggaaaattattcaatattgcttatttttaattccgaattttagctatttttaaattgtacttctacttggactcttcttttttttctttttcttttatttttatttcgaattttgattaatctcgtattgggttcttatatggaaacctctttcaatattgcttatttttaattccaaatttcagctatttttaaattgtacttatacttggactctccttttctttttttttctttttcttcgattaatgtgggaatttcttttaatttttctaattttggatattatttttttaattctgaattttaattaatcacgtattgggttcttatatggagtcttctctcaatattgcttttttttaattccgaatttcagctaattttaaattgtactccgatttgaactattctttttttttgctaatttaggattttatttttatttttactcccaattttaattaatctcgcattgtgttcttatatggactcttcttttaatattccctatttttaattccgaattttagctattttaaaattgtattccgacttgcgactatc

SEQ ID NO: 69391 - DNA, 14566 bp, Oryza sativa
ttttctaattttggattttattttatttttatttggaattttgattaatccctcgtattgggttcttatatggaaacttctttcaatattgcttatttttaattccaaatttcagctatttttaaattgtatttctacttggactctccttttcttttctaattttggattttgttttatttcatttcgaattttgattaatctcgtattggggtcttatatagaaactattttcaatattgcttatttttaattccgaatttcaattatttttagattgtacttctacttggactctcattttattttattttctttttctccgattaatgtgaaaatttttagcccccagagcgaacgtggtgcctcctttcaaagctgttttaataatataaatagctgggtggcccgcgcaattgcgcggctagcaaaaaaatcatatatttttttaagtatgatttccttgaaatttattaaatagctatctcattgttaacactttgaaagaccaaaccttatcatcctcatcctcatgtttctaattatatagttttaaaaatcacaccagttgctaccccttatgtcatctcattctttatttgtttgctcgatctatcactttttctattcattcttggacctttaaaaattggattttatagtttttagagtttattgtcacgttgggtttcgtttttataatttctagatgtcccgtcaaacgttgtcgttatactcatatacatctcgtccactatctcttctttttattgtcattgagattttaaaaatcgaacataattatagtttgggttcatttttactttccagaagtcccgccaaaccatcagcggttttgccattgtactcctctacggctcgcccgatgcctcccttctttattgtcattgagatttcaaaattgaacatgattatcattggtattttttactttttagaagttccgaacctttaaaaattagacttgtagtttcattttttataatttttaaaagtctcatcaaacgatgccactatgcccctctgcagcccgtccgccgcctactctttattgccattgtaattttaaaaatcgaacataactatcgttgcaattcattttttattttctagaagtcccgtcaaccgtcggaggctctgcaactatactcttatacaccccgctcgctgcttctcctttttattgtcattgagattttaaaaatcgaaaatgattatcaatgtggattttttttctttatactttctagaagtcccggcaaccgctttacttgtttgctttatggcctgcttgacgtccctccttttaatcgtcattaggattctatttggtgttttattaacaatttttatatgccgtatttgttagggttacgggttaggcttaccctttactgtcacgtcccaaaacgaccctaaaatacattctctaaattatgcctagaataattaaaatccgtgtgaaagcctccaaaaattaaaatgtgcaaagtaaaagtcaaataaggcttagaggatttttgtatatttcctaaaagcctaaaatatgtaaataaattttagtggaattttcatagcacaaataataattgttaagaaataaacaaagttaaaaaggttttataaaaaaaaaccctaaaaatcccccttccctctcttgggccggctcggcccacttccctccccctctctcctcttccctcgcggcccacacggcccctccccgcgtgcgctgctgacgggcgggtccgcctgccaccctcgctgacgggtggggcccacccgtcatctccttcctcccgccgctcccgccgcctcgcccgcgcctagcgccgccgccgccgcgaatcccgccgcctccggccgttcccgcgtgcaataaagtggggggaaatattccccgtgatcccctccccctttccccccatttttccctctctctctctcgcatacaaacgggcggatttgctcccgcaaatctcgccggcgccattgatggcggccggacctcccggccggtttccttcctctcccggccgccctctcccccttccaaccctatttaaaccctccccgcgcctccctcgcctgtttctgccccttgccgcaccgtctccctgccggaatcgagctcgcgccatcgccctctctctcctccgtcgcagacgacctccggccggccctctccgctcgccgggaccgtctaccgactttgtcgccttctccggcttcgccgcaccgtcaccgtccccgtccaccccctcgtcaggctcgccgaccgccggagcgccgccgtccccgtcgacccaagccgcgccgccgccttcctccgctccggccgcctttttcgtcgtcgccgtcgacctagggtgagccgtggaccgccgcctcttttcccccttcccttcccctctctcggccgctgctccgccgtgcctatggccgccgccggcgaccataggggcgcaggtgccgcctcccgccgaccgcgccggcatggccgccttcgggcgcgccgagtggccgccgcgtggggcccggccgtcagccgcctacgccctcgggtgcggctgacgcgtggggcccacggcgcaggccggtgtgagcccgggagcgcccggtccaccgtggaccgtgaggctgccgcgtgggccccactcccatggacccggtccgcgcgccctctcccctcggctgacgcaataaaccatttttaaattaaaatttaaatgaagaaattcgcaaatattcacttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcctttttcctttccattggtcgtgtagacgctgcagcttcggaagatccgctcttcgtgaaggttgaagccgacgtttgggaaagtgatcaaggcaagtcacatcatccttgaacatattgaatcccagtttataaaattattttgatttaaattaatgcattatcgctttatttaaattcccgcgttatcactgttttatttagccatgcctatttacctttgttatgacctaattattattgctattgttattattaccttgttcaccctagactaaacaaaacccccaactagtaggtaccctatgcatggtaccactagtatgaatttaggtagatgcttcgctgcttaattaagcaacattaggtggttttacaactctagactttgggaatgttcatatcacctagacactatggaatggttggattattgtggaattggattcacacctccccctctattcaaaatcctcaaaatggttttaggctgggctcggggtgcatggttttgattgtagcacctcggccacataaggaccggtcttcgggcctatgttgcaaagcactaccgtacttccacatgtctagtgggtaaggcttagtttgtggctcagtctggttataaacaaaagtacacggatggagatggacgaagtcaggggtcgatggacatctctagggcaaatgaaggctacacgagctgcggcccggtagtcgagatgtcatggcacagggctggtgtcctgctgctaggggctcagtcctgcctacctgtcccagaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgattagagtataacctattcgaatagccgcgccctcggttataggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggtcttgggttaaggcaggttcgtgtgggttcacggccttgattaataatattgcatagctctaggatcgtatttacaaaatagctttgagcaactaagtgtcttttaatgctgtttactgcaaaccctaaccccctatgttataactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttttttcgtttgtcttcctgtgtgctgggccttcgccgcccatgtaataaattatctatttacacttccgcttgttaaactctgtattgtatcaacttttggtgtaccttgcctcctgggacaaggaataatacacgcacgtaaggaacgcccgttgggttatttccggtcgtgacatttacccttcgatatacgttacatatcgatatggcatacccacgcgcatgcggatatttcctgtatatcctaaggaaacttttcacggaatctacagatgggaagaatcctactcgggcagaactgggtcgttggcgtatcgtatagggtctgatacctccgagttctatgaggagacctccacatctgcgatataaaaggggccccccggggagggtttaggatcgaatctcagacccaacacaacctccacagcctacgaagccggagcttgcgaggagccaagtcatcgagagctagtcgaatcaactcgactacaatctcgccggatccgacaagttcccttgttctctttgtaacctgtgttttttaccatataatcccacatcaactggattagggctattacctgtcaaggggcctgaaccagtataattcttgtcttttgtttgcttgatgtcatactacgtagatccttgtatcaacgtaccccaataccctctatatccagtctacgggtatcacccgtcgacagtggcgcgctaggtagggggccttggtacttaaggttctactactatgtcatccagcttcgtcgacaacaacgtcagcaccagcctcagccaagtactccctgcttcaacaatgctggtatggactcaagtcggcgaaatcgtcttcccggtttacaccacgacaccgatctcaaccggtcctccaatgaccggagacgagaacgcagtggctacgaaccaaggcgattccatgtcaaaaaatcctctcgtcgagacggagaacggaatatcgacgacatccaagctcaagagggattctgatacggccaaaccttgtccttccgacatgaaccacgagccgacaaagatgacttccgaagccacaaggtcttggtgtcctatccacaaaaccaagaaacacaccttgcaagattgctgggttttcctcaacgtccgtgctgaaattcgcgcctgcaaagaacgtggaattcagcgtacttctccaactcgggatgtctattgtcctattcacaagacaaagaatcaggacctctcgagctgcaaagtctttctcggcgccatgaaagctcagtctcctaagtcatatgtccccatcagggataatgacaaggaacaaggagtgactccaacttcagatcgattcgttggagtaatcgatatcgatcctcacgaaccatcggtcttacatctcctcgaggactatgggtcatcgacaacgagcacgccgcgggaggtattggctatcgatgatgttggcacgtcagcgcacgccaacgcagaagcggggaaacaatcgactactcaagcccagcacatcaggcccgttcaagcgatactgagggaaactccttacgatcccgttctgaacgttgacctcgagcgttggatagaacgactatgggaatcggtgactaacctcagcaacgcgtttgaagaagccgctaccgcagcacaccaggagcagccaccaactggcgaggccaatagtgaagatccggaacggagggaatcacctcaacgagctaccccttcacctcgcggcactggcgatcttcgagatcaaatcaacggccgccgggaagcacgacgcacacgagacaacgtgaatcgctcttgacgtcatgtctcttcacggcgccatgataacggaaatcgaggagactgctcaaacgaggaccgggaccacgacaaccaccacgatcacaacgatcgcgaacgacgggtgccagacaatactggtcatggccgccaccgtatcgacgacgacgatggagatcggcgccgagacaacagtggaagacgacgacaggattctcgagatccaggccgtcatcctcgtaatcgtacgccggaaccaagtgacccatcgtcatcgtcatcatccgcgtcctcctcatcgtcagacagatatccacgaaggacacacgatcgccaacaacccaccgccccaacgctgggtgtagggctttcggtcgttccctacgtgatgtctgatggtctgagagattccgacccggagcaatagaaaagtatgatgggagcaccgacccagaggagttccttcaagtctactccacagtactctatgctgccggagcagacgacaacgcgatagcgaactatttaccaaccgcgttgaagggttctgcacgttcatggctgatgcatcttcctccctactcaatctctttgtgggcagacctgtggcaacaattcatcgccaatttccaaggaacatacaagcgccacgcgattgaagacgacctacacgcgttgacacagaactcgggtgaatcattgagggaatatgtttgacgtttcaatgagtgcagaaacacaattcctgaaatcaccgacgcttttgtaattcgcgccttcaaatccggtgtcagagatcgctacactacccaggagttggcgacaagacgcatcacaatcactcggagattattcgagatcgttgagcgatgtgcccacgctaatgttgtgctaagacgcaagaacgataggccgaagaccgggggagagaagaaaccagccacggacacatctgagtcaagcaagaagaaaaatcgcaaaaacgggaaaatgaaagctcaagcggaagtcctcgcagcagaatacgcaaaccctcccaaacacccagacccacaaagcagcgacacaaagaaatcatggtgccccatacacaagacggacagacattctctggaagattgccttgttttcaaaaagtcgctcgagaagcacatggcatttgaaaaaggcaagcgagtacgcgttgttgagacgaacgaagagacggctcctcacgaaccggactcagcgtatctagactccaacctccacgtctcacacatcttcggcggttccacaacgtactcctctaagcgagaatacaagaaagtggaacgtgaagtctgctcgacatggcagggggctgcccccaagatgaagtggtctgagcagaagatagagttctcggaagaagaccaccccaagaccgccgttatcccaggatgatatccgatcatggtcgaacccactattcggaacatcaaggtagcgcgagttctcattgacggtggcagctcaatcaatcttctttttgccagcactttggacgcgatgggaattccgcaaaacgagttgacaccaactgatcaacccttccacggaattactccccaatcatcgtccagacctttgggcaagattacatttcccgtgactttcggccaagccaacaacttccgaacagaacagatcacctttgatgttgctgaattcgatacagcttacaacgccatcatcgggagaactgcacttgcgaagttcatggccgcatctcactacgcatatcaagtgcttaagatgccgggaccaaagggaacaatcactatttaggggaacgcaaagctggcggtgcaatgcgacaagcggagcctcgacatggtcgagcaaacgcccagcccacccgccacgactgagccacccaagaaagtgaccaagacaaataagacgccgaaaccagacggcgccatcaagattgttccactctccagttccaaccccgacaagaccgtcaagatcggggcaacactaaacgagaaatagaaactcgcgctcatcaccttcctccgcgacaatgccgacgtgttcgcttggcagccgtccgatatgccgggggtccccaggaaggtgattgagcacaaactcatggtgcgacccgatgccaagccagtaaagcaaagactgcggagatttgcaccagaccgaaaacaagccatacgagaagagctcgacaaacttctcaaagctggcattattagagaagtacttcatccagagtggctagccaatccagtcatggtgcggaaggccaacggaaaatggaggatgtgtgtcgacttcaccgacctcaacaaggcgtgccccaaggatcactttccacttcctcgaatagaccaactggtagattcaacagccggttgcgagttattgagcttcctcgacgcttactctggctaccaccaaatcagcatggcaaaagaggacgaagagaagacagcattcatcacgccgtttggggtattttgctatgttaagatgccattcggactgataacagctgggaatactttccagcgcacggtccagggcgcacttagcaaccagcttggcaacaatgtcgaggcttacgtcgacgacatcgttgtcaaaaccaagacaggcgactcattgattgacgatctgcgggaaacgttcgacaacctccgacgatatcgcctcatgctcaatcctgagaagtgcacgttcggagtaccgtcgggcaagctgctcggattccttgtctctggcagaggaatagaagcaaaccccgagaagatcaaggcaatcgagaacatgaagtcgcctacaagactcaaggaggtacaaaaactaaccggatgcatggcagcactaagtagattcgtcgctaggatgggagaacgaggacaacctttcttcgctctgttgaagaaacaagacaaatttgtatggacataggaagccgaagaggcattcattgcactcaagtgctacctatcaaacccccctgtacttgttgctccccaacctaatgaagaattattcctctatattgccgccacgccacactccgttagcactgtcattgttgtcgagagagagaaagtacagcgactagtttattacgtcagtgaagctctccacgacgcaaagacaagatacccacagatccaaaagttgctttacgctgtcatcatgacatcaaggaagctacaccactattttcaagcccacagagtcacagttgtctcctctttccctcttggtgaagttgtgagaaacaaagacgttgtcggccgcattgcgaaatgggtagtcgagctgagccagtttgatgtccactttgtgccacgaacagccatcaagtcccaggtactcgccgacttcgttgccgattggactatgccagataacaaattagacaaccaaggcgacaatgaaacatggacaatggcgttcgatggcgcactcaacagccaaggagcaggggcatgatttatcttgacgtctccctccggagatcaattcaagcacgcaatccacctcaacttcagggcaaccaataacactgcagaatacgaaggactactcgccgggatacgagctgcagctacacttggggccaagcgactaatcgtcaaaggggactccgaactagtcgcgaaccaggtacacaaagattataaatgctctaactccgagttatccaagtatcacgcagaagtcaggaaactagagaaaaagttcgatgggatcgaggtccgacacgtctaccacaaggacaacgtcgagccagacgacctagcatgacgtgcgtccagacgagaatcgctcgagcccggcacttttctcgacatcctgacgaagccatcggtgaaagaggttagcggcaaagtcagcccgaacacccccgacattagctcggaggtcaccgaggcagaacgcgccattgccgacatcgaaaccacagacgactggcgcatcccactaatcaaattcatcagcagcgaggagttgcccgaggacgatacagaggccgagaaaataacccgtaaagcaaagatctactgtacggtcggcaatgatctatataagaaagcgccaaacggggtacttctcaaatgcgtctcgaccgacgacagcagacacctcctcctcgacatacatgaaggcatatgtgggtcacacgccgccggtcggacattggtcggcaaagcttttcgacaaggctttttttggccaaccgcccttaaagatgcatgcgacatggtccagcgatgtgaagcctgtcaattccacagtaaacacacaaagctacccgcgcaagcgctccagactatccctctgacttggccattctcgtgctgggggctagatatacttgggccattcccacgaggacagggcggctacagattcctattcgtggcgatcgacaaattcaccaaatggatcgaagcagtacccacgggggaaatcaaggccgacaacgccatcaaattcatcaaagggatattttgcagatacggacaaccacaccgcatcataactgacaacggctcctagttcatcagcgccgatttccaggactactgcatcgggttgggggtcaaaatatgcttcgcctcggtctctcaccctcaaagcaatggacaagtcgagagggcaaacggcatagtattacaaggaatgaaaacccgcgtctacgacaggctcatgtcacacgacaaaaggtgggttgaagaactcccatcagtactatgggccgtacgcaccacaccgacaacgtctaataaggaaacacccttcttcctcgtgtacggctctgagaccatgctcccaggcgagctacaacatcagagtacacgagtacagaagtactccgacaagaaccaggaggagtagagagatatcgatgtaaatcttctcgaggagcatcgggaacgagttgccgtccgagcagccagctatcaacagaccctccgccgttatcacaagaagcacatccgtgcacgcatactttcgatcggcgactatgtcctccgacgagttcaaagccaagcagggcgaaacaaactctcacctaaatgggaaggaccttacacgatcacacaagtcttgcagccaggcgcattcaaaatcgtagacggcgacggtcgtgaattagcaaattcttagaacattgaccaactacgtaaattctatgtatgagtcaataccatccatacctgtaagcacccttacagtattaataaaggctatttctaggcccatattacaatcaacgtgtttcccccgatgatccctcactctgatgacacctagtgttgaaacctgtccttatgtccctttacgccgtctcgacaaggcctctgaggaacctaagggatcttcggctggggacgcccagagccgataaggccttgtcagatcctgtagagacgaaagaccatataagatctggtcgtgtaagagttctcgccgtgcgtattaaccaagccgtgaaatcggaaattaactttccaacttcacggctgggggctaggatcaaagcttattcaaccaaggcaggtcaaaggtccaagagccttatcctccgagaaaattcctccgacgacaaggctgggggctagggagagtgtacgactcaaacggctgactaaagtcgttaactgagaacgcactcttacacatgacatccagagtaagagacatttgtcaaagatagatttctttattcacaaaatactccttacagttttttcacaaatctttcgctacattacatcttttcctaagatatttgtcatagggtacgagtactaccaagaaggccaacgccagtccatagactagaagatcttctcggccaacgacgacattgaccttgccagatggtctatctccgccggagtccttcgagaacgagcaaaaccctcacgaagatattcgaggtccaggcgcgggcgatgatctcgtaggcaagccaacacgtgccccccagcatatcggctcgatcgatgacactcctgcttcaaggcctcgtcgatacgctttccgattccatcgagttgggcacaggccccattaagccacgagatgtacccggccgccgactcctcgggatctccgcggactactcgaagctccctgcatactctggccatggatgtgcagcaactcttcaagtacgagttaaaccacacctcacgacctcggagcgtttccacagtctgctctttcttcatggccagcatggttctctcgagctctgccacttcaaacttcgtcttccagtattggatacaacgatcttggctagcaaggacaccctcgagatctgctaaacgtgataaccactaagtcaagctatacatctctttcgggatatggctgacctagtcaggtgggcattaaggggtgaagggactactaacctgaggaagtcgtcgccgtccttccctctatatcaaggggttgatccacatggtcaggcgagacgtgtggttcaaactcgagtaccggaattactgccagtgactcgagctgcccgcgctgctggacatcctcgtgatcagtatctctacagaggacaaaagttcccgaggtcagcataccaaagtaagccgggatagtaatcgcacgcacgaaggcggtcagagttcgagttttacacattatctaggaaatacaagaagtcctactcttcaaaaagggggagaacagactcccccagatcaccgacttcttccatcacctccttacgcgtgtcgctggccgccccctggtccaagatctcacgcagatcgagttcaagacgcgacagccttacacacgcgaggacatgacacgccccggtgtagattccgtttgacgtctcctccgcaatcctagccgcatgcttggaggggatttcccccatcgccgtcaccaattctgcgagagaggaggtcagcgaaaactcatcgggattcaccgggatcgtggacgtgacgccgcattccccgacgagctggtgaaggctagtgtaggtgaccctcaacgagccccggatctcagataggttgttcccgagttccgacattcggtcctcgagccccttccgttgtcgctcgttgccggctgccaactccctcatcttcgtgaggtcttcacgggcttcaaccaactcgcacaccagtctgtcagcacgcgcgttcgccgtcgccgcttccgacctcgcctccgcaatctcgcggtcgatgccgcgagcaccggcttcgaggaggcgccccatctcgacttggagctcctcccaggtgaggactgcagctggcagatcacgacctaccgcggggtcgctgactgggccactaggcatcgcctcccggctctcggctacgggcacgacatccgttgaggccacgacgggcgacgcactggaagctcctctagacttggctcgtgcagcctttgtccgcgcctccctacaggacgaccatgagtcagacaataatcgaataagaagcgcggggattcaagaattcatctacttacttctcgccgatcgtcacaatgcgttgtcgtcgtggaggtgggggagacgcgtccgaggcctgaaagacaatcaacgcaaagtaaggaaaaatccttcttgctgcatgatttaacgacaaaataaattaccgagggggtcgacgccttgcgacgatgtccgcttacagacgagaatttcctcggctttgtcggaacattgccaccgctagtggtggcagcatcagacacctccttgacgaccttcacttttagagatgacgccacctgatggtccgcgagcggtccgatgacatcagtcaaaggaagagcctacgctcaatcaagtcataaagtgatttcgaaaggagaatgcaggatgtttatcgaatatacttacgttgatggctttatcacgttccgccgcccccttttcacaaaggggcacagggatgtcactcaccgtggtcgggccactgatcatcacttggccgacgcggcgctccacggttttgccgctcagacctgttaatcgagaaccaaccttcgataagtcaagaggaatgcaaacacaagtatgtcaagataaatgcgagaaagataccccgaggagaaacccgggtcgcgtcctctgacccggaatagttataagctggatgggcccgagcctgaagcggctggatccacctaccaacgaagtctgcaacgacttcatatcccgacaaaccccgtactcggagatcgtcgatgatgtcgataaacgactgaagagagggggtcaaggggggctttgcggtccaagacggaatcttatccggttgatcttcgggaaccacaaagacagggttcgagttcttgatctcaagataa

SEQ ID NO: 69392 - DNA, 9052 bp, Oryza sativa
acataatcttcgatcacaaccatgcgacccaagatgggctgaggattagtacctcatgcttccctctccatggttccacagccaggaagagtgccatcctcctggagtttcttcaacgttgcactggtggaagccgatttgccgaggtccattgctgatcgaaggtcgccggaaaacgagcctaggttgacgaactagggtttcttgcggcggctgagaaggcaaagagttcttggaggtggtgcgtgtataacaggtttggcggacttcaaaatggactcccaaaattcctttaaataggcgcactaccgacggtgcgaattccagggaacagagagagatgcccaccggaaatttctggtcccgttacgcgcggcggttttttggacttcagtttaaaattcgctcgtgaccgttgggcttcaaatggcgtgctcgactacggtctatctccacggtcctcgcaccgggaatgacaacagtctcgacacccgaagtcgcaaatggttgcacgagttcattttaagcagaagtcggggactactgtcagggttacgggttaggcataccctttacccttcgatatacgttacatatcgatatggcatacccacgcgcatgcggatatttcctgtatatcctaaggaaacttttcacggaatctacagatgggaagaatcctactcgggcagaactgggtcgttggcgtatcgtatagggtctgatacctccgagttctatgaggagacctccacatctgcgatataaaaggggctcccggggagggtttaggatcgaatcttagacccaacacaacctccacagcctacgaagccgaagcttgcaaggagccaagtcatcgagagctagtcgaatcaactcgactacaatctcgccggatccgacaagttcccttgttctctttgtaacctatgttttttaccatataatcccacatcaactggattagggctattacctgtcaaggggcctgaaccagtataattcttgtcttttgtttgcttgatgtcgtactacgtagatccttgtaccaacgtaccccaataccctctatatccggtctacgggtatcacccgtcgacagtattaaccgccaccaactctactactttataggcatgttacttaatttatctcgtcatgtgttttagatggtcttttctttcaatagtctttatttttatcacaaattttagttgtttataaattttattcctaattaaaatattttttttctaatttcagaatttatttttttctaaaaaaattagttaataacgtattgtgttcttttaatgtttttattttttattttgaattttagttgtttcaaagttgtattcctacttgaactctgttttaatttttctatttttggatattattataattttatttgaaattttaattaatctcgtgttgggttcttatatggtttttctttaaatattgcttctttttaattccgaatttcagctaattttaaattgtaatcctacttgaactcttctttattttcttttgctaatttcagatttatttttatttttattctgaattttaattaatctcgtattgggttcttatatggaatcttcttttaatattacttatttttaattccgaatttcagctatttttaaattgtattcctaattggactctcttttccttttctaattttagattttattttatttttatttcaaattttaattaatatcgtattgggttcttatatggaaacttcttccaatattgcttatttttaattctgaatttcagctatttttaaattgtatttctacttggactctcctttccttttctaattttagattttattttatttttatttcgaattttgattaatctcgtattgggttcttatatggaaacttctttcaatattgcttatttttaaatccgaatttcagctatttttagattgtgcttctacttggactcttcttttctttttttttctttttctccgattaatgtgggaatttctagcccccacagcgaatgtggtgactcctttcaaagctgttttaataatataatagatagatagattttttgctgtgaatctggacaactgtttatccagatttatagctaaaaatgcttatattttgggacagatgtagtaattatatatgtattacatattaaataaattgattataaatgatttagaggtatttcctgctatacttgctctaaagataacaactcagataatgatgagctagtggcaagcgcaaaatggaagttaggaggacgaaaatatggttccaaacagaaaagccaaaggctaggatttattctaatagcgctttaagatacgtgcaggccgcaacaccggatcgaccaaaatccgcaacatgatatcggaatccgcctttgcgaagcgcggcggcggtgaggtggtgtgggcacgccaccgtcggcaacgacgaggcgagtagccgaaacggggaggaggaggaggaaacggaggcggagggaggcgcgcaggcgtctgcgccgatcaggtcacggcgccgctctggaccctccggtacgtctcgtctcctctgtcctttgcttttaatctctccgatcagggaaggccaacgcgtccacgctacatactaaccctcgcgtaatcgaaatcagtccaaagaggcgtcaattcctaatccaattcaaacgggtggagaggttaaacctagatcctactccaaattccgcaagccacagccgcacaatccagatgcagtttactgttcagagctggtctctcaaagtctcaacccctttttctgatttttctccatgatccccatcctatccacgccagttcatcgagcagtagcatatttctatctacttctactgtgtcctattaacaatttggcggcagagctgactattcctttatgttcttcatttgggttgcttggagttggagaagagattaccccaccgtttgttccatgctgctgtattttccaaaaatcatgctctcattggcttcccaccatttctgcgcctgatcctctccaaagtgcttccgactgcgagattgaaagagttagttattgcaaaggtaagacatgatgccatcgttgacaactgattgattataatctaggttcttgggggatctcacctgaaccggatgcgcttgatgcacttcttcccaccgggggatgtaaccactgtcgcgtaaaccccgcgctcgatctgctcgatcacaccgttggaatcggtaggagcagtggtggcatctgttccctcggtgcatctggtgctgccgttggaagttcttctgcaattctgatgcgtaaccgagtaattcgccatggaagcaattgaaggttgtgtgcattccctatccacctgcctgctgttgtggtgatctctgttgctcttcgactgttgaaattcgctggtgaatacatttttgtcaggtgggtctggtaattctgcttttagtgattttgcactggcgatgtggctaggcatgattctggagttgtctaatttctcaccagccaaaaggttctttgataaaaaatcatgctgcacaattgggcaccccacacaacttatttagaaaaaaaagccggtaaatctgtcaaatggagataggtcatcggttttatacctgatcgatcaaaaccttaattatgtctttagcagctttgcacttcgcagcctcatccttggcaattaaccaagtctcctcgacttttcgtttgtacagctgaactttcaggctcctttggcggcactgttttgcaagagtagttacctgcttatataaaacataatttccatctttatcactaaattatacgttgcataccagaacaaacattcagtgaaaacaaataatttaaacagatccacgaaacatgtttattacagagaatatggtatgtcagttacctgctcttgaagctgtttcacttcttccaataatatattttccatcaagtctaattccgcttttgaatcattagcagatttgagcaaagagctggcaggtttaggtgccattgtctcattcattacccgtacaatagaaccagagactgtctgtttattcaatgttgaacaataaggaatgctctctctcacacatctgaattgactggggcactctactaggccccatcttaatgtcctcacatgatctggcacagccaaattctgacttctctgatgggggctttgtgctgatgccattttctccataattgcatttgcttccttgaatatgcgcgccaattttggcgtatatgatcttatttctattggacatacctcatccttttggatcttctgttgtggatctaattttctatgctcctcaactttctgcatttgactgaaacatgcatcacaaacacggtaccttttgctcctatctggtgcaagagctgctctggaaaccttgttattgctgcaggaattgcagaacatggaaccacagttgtaacagttgtgcttcttcctcgtaaagccaaatgttagctggcagttgctgcacacagattggtccttgcttgagagtggcctatgtaaacaaattgccatagtgaagttgaaaccacaagctatactatgcacctgcttgtcttccaaggcctcgaccagagtcgggtagctcctgtcaacatagtcacctaaaccaagttgcccttctgttcctttgccccatgtaaacacctttccattcattgtcaaaactgctatatgtgaagagcctgatgatatctctctgacaaactctgtcttaagtggcccctcaattaaacaaatagatgtgtcctcagacagagggttccctaatcgtccgtgttccttgcttccaatggtaaaaacaacaccggttattgtaagcacaatggtttgtgcttttgcacaggatacctgagcaaaatcaaaatcattgagtggctcaacacaagttggtacaagtttcatctttttgtcagcatgacccagcttccctctatccgcatcaccccatgtgaacagcttcccactaggagcattgctcttgacagtgcccattctttctacaatagcagctgtgtgccatggtccacacgcaatggccttggctcgtacccctttcagggactccacttgtttgggccgagcaacggtcagcgtgtcaccatgtccaagaacaccaaaggttccatctccatatgcgaagagctggccagcagaggatatgatagccgtgtgccaatgaccacatgcaatcttcaagattgagatgccatccaaaggaccaaacaatttatgtgggaaccattggcttctttgatactgatcaccccacaaacccaagcagtgagtcccttcaccccattcataaagttctcctgaaattgaaactgcacaggtgtgctttgctccaaatgcaatagccttcactcgtgtagaggcaagagactcgataattttaggatctgatacactgacactcactttgtgccccaatctcccaccattatccacaccccaggagaagacctctccctgcttagtaactatcgctgcgtgtttctctccacaagcaacgctctgcacatcaataatatgtgtcgtgtttaataaccttggaagtgaaacattggcttttgatacatctccatgatctaaaacattgccaggaacttctccccagacaaagatgtccttcagagaagttgctccatatgcaacatgtaacccctcagatgatttttgtttaggcagttgggtaattatttgctcgttaagtttgtcagcaacttttatatccctgcaactgtgttttaccctattaaccacatcgggagtgaccttttccatgtagtagtctaggtctgaccatgtcctctgccttggagagaagaatggttctgagaaatccagattgctttgcaaaacatttttctgcatcagcctaggactgccatatattgagtgtaccttgatggagaaatcatgtagaaaaacatgtcatttcaactaaaaaggtgaaacacactttgtaactgagaacatagggcaacttatgaccaatcgtaggtcgtatcgctctacttagtttcatgatttgcaagaaaaaaaaagaggtgtcgcttatcatttatgcaaaagtctgtcaatgtggttgtcatttagctgtatcattattgttatatttggataagaactaattagttgaaatgaataatatttcaacacaactagcatgaccatcatttgaaatattacatatttacaatttcctgagcctatggatcaaatcgtgttacttagcataacttaggaaaaatcaaaacacacttgtagttgtggtaagttgcaaaattatcacatagaaatcacagcatgcacaagttatagaatgaacctgtttaaactttcttgtgtcatgcacagcaaatagcctactcctttgctgaatatagctaggagggctatttgtacagctgtttatccgacggctacttgttgagtcaatcaaaagtactggactgcatggaactgatagtaaggttgttaggcctatataccaacattcagcttgatccctatctttgcaaatctgcgaaatgtgatttagaaaaatgttacggaaggtaataatgtgaaggataaaatttacaaagtctaaacaacaggcctagtgagtaaaaataccaagtcaagtgaacattcaccattcttgtagaagactgacaatgagtgggattccttttctggccaatgcagacgtaaaagttttgtctgtaaaatactagaatcctcagaaaatgaacgtgttctatccttaatgatgtactatggacaaagaatagcaatgtgcttgagaaatgaaaaccacatactgtcttatgtccaagaactacacttgagacagagctcaagttcaaacgcttttccctgtctttggaataccacatgagcattttctcatcctgcaaaagaagcatgttaatgttatttagaggcacagcatcttgaattctaatgttttaaaaagataagacgttaatgtgcagtttactcaatctacttatctgaactggatacgttccatgggaactgggaagaagtagatattgcagacctaattttagaatatttaatattcaaacatcataccttgttgtgttcatagtgttacaatcttctctacattacggaaattgaattgctaatttcagaataaaggatggatggtgggagtgcagagagctagatttggagtaatctactgacgtagctgtatgtatggccataaatgttaatctcattgtgacatgtcatctgtttatcagcggtgggaaaacaaggaacatctttgaaaggttgcggaggaacatcgtgagatcttgatatgcagatagatgaaggagaagtggataactgggcggaattcatctaagagttctggtcatggctctgctcaacggaacatggtgaagaacttggaagccaaaacaaactaagtagcatcagttaatttacttggcatgagcttcatgcggacttaatttttatttgtttaattcaagtggctgaatagttattatacttcttccatcaaagttccgtgcattaagtaaataagcctgtaatggagtcattcatgttaaatgttcagaacattcagattaacacaactaaataaatatctcataggcactgaacatatgttttgctacatgtctctagtcgtcactaggttgcatgcgtaatccatgaaagttaatgaataaaatcgatctttagcatgctgctaagcataattacagtaacgaagctactcactgaagatagcctgaatgggcataacttgggcttccctctcttcccacatttcaggagatgtgcacccttcttcagagcaacaagcgcctgaaggaaagaaccagaaaattaaatcgcgtaatggaggaagatgtccttttcaggtttgatgtcttctgttataagtgaaccccaaaaggatacagacaagaaaatgaaatgacattatattaagcgcatttggaactttgggcggccacagaagcaaatgtcatgctcactcaacatcttggaaaaaaaatgacgtgcatatagcttactatatcctgaaaatgaaataatggtgtctaatactttctcaataagaatgcagtgtttattggctccttgaagacaaacaagaagagcaaatccatccaacttagcaaagatgcattgttggaattgtaggagagcaaaagaagaatcattggcataagcatgaatataccacaatgctttaaaagaagatgcaaaagaaaaacgcttcatgttgcatacctgctcgactcctctagctgcagggctcctcccctcaaagctcccagccattgcagccaggaaagacgcagcaaaagaaacggagagcgatgccttgcccctgagctgagctcaagttcaaacctcctttgatcaacagtgggagaaagcaaaagatggcagcaaagtgacagaaagaaagaaccacgcaaggaaagaagcaaagcaagagagaggacggacggacgggggcagagcttgaggacggacggaggagggagaagaagcagcaccgtcactgaaggcgacctgcgcaattcaggggccccggaaaaggaaacggtggcaattttattaactgctgggtttaaagatgagagaggcaggcagtcagtcttcgttcgacacaacctgcagaggtaaatcctgttctcccttttgattctgcgcccctcgctttccgtatattttctcttgggtagtgctagtgcggcatctctctgtagtttgtgacttcgagtgtaccgaacagcagtggcatttagctttcctctgttagcgtgagtaggcgcttcagaaatcttggatttcatgtcaaatctcaggatttgccacaactgcatgccacaagccccggaaaacctggtcactgccttccttttccctagcatctcttcatcagtcggtacattaaact

SEQ ID NO: 69393 - DNA, 10066 bp, Oryza sativa
aattggatcatccgatcgctgattaccatgatcagcatttctcaaagaatgcatcgaataacagaattactccactaccgtaacaaccttacattgtttaaaattcacgggcatccgatctgtctagggtggccagttaaccatccttggctccttgcccagctgtggtccagaaacgtggtactagtatcgtgatcatgagtttggacgttttagatagtaatgaggttggatttgcagaggcaagcatccacgcactgctgttaggattttgggacagcacatgatggtccgaaagaagagacgatggaggggggtagtgatgcagcacgtgtgcagcgtaggcaggcgctgcccccgttctggcctgcacaactgtttggtcactcctgtctgcaaatgatgccgtctcggtcgcttttgctgacttgatcttgctggggtacgttttttctctccctttttctccaacgagcagcgatcgtgacgtcttcgtagctcataatttcgtattctacctttcgtctccccagtactgtatgtatcagtatcactgcctacaaatgtactatgtctaccggtgctacgtgcatttatgcgctcacctttgctcacgacatgtctattcattgcgcatttatcctattgcagtcgtactgtgatcagttgtactgctggtgctgctttggtcgtgtgcatccccaaggattttctgcggtgtccactgatcaggtaggagttgaattcgtcaccttgttctcgcaaaggttagtgttagtgtttttgcaagggtagattgcttattaacaccagtggtcatggagccatggagatgcttaaggtgacgatgttgttacagctggaagtgaaaagatggatggtggggaagaaaaggtagagaaggcaagtaggcatgtgaaagcaccaacgagacaagcatgacgggccaagggaaaagataaaacttgtcctgcctcctcaacagcagtaaatgtgttgatttgttccccttgcatttcccgtgtagcgtcatggcattggcagtaactcgtggacgatttctctagcgattgttacccgctgttcatgctcaaaatggcaccataatcttatacacagccctactcttgttctgcagctatttgcacttgttctgcacctacggtctcaaaaaaggcatatttgtatgcctcctacacgggtaaaaacaggtgcagcaaatagtaccagtaagtccaaattaacccttttattactgtggatgagacaaaatgtaggagctagctgtctgctggcatgtggagtgactggaaggcatggcatgtgaaacttgtgaagccatacagtacgaagtaggtgaaaaacatacacatcccctcactgggtataaagtttgatttggcctaaattgaggccggtggttgcgctactcgtaggcacgtactacatacatcgggcacggtcccgaataattgcgtcaaatcggtcgctggtgattggcacaatggcacgtactaggagtacgtcttgctgagttcctgtcatgtgacagggttctgtgcaactcggtgttgttgtgatgccattagatggagaatttaggacgtaatgcctacgtgcattgcaccatttactttctgtaagtgcatgcacctcggcggaacctttatgagaggttctctctttggaacatgcaagagtgaattagtggacaataatgccaacattggttaatttagttagtccatgtagctcggacacatgccgcatccatggctgatggctccaccgctccatgtatcaaattggcttttcgtgcatgcgatgagttgctagtctcctcaactctctcgctcttagaaggattatattgcaattgtacgtttgtatccattggatgcatacacgcgcaggtgaaactttttttttttgaaattttgagcagatgaaagtgaagaacagcatgcaatgcaggggctgatccgtgatctttgtacggagttgtcaaaatgcgcctcaaagctgtccttggattatacacagatacacttactagctgtgtccacgcataaatacatacgatggcctacgcggctgtccatgtcctaccatcttaggttcacaatattgatctgttagccatgtaggagtaagactctgtttggtttccaggacttattccaagtctctgtcacatcggatgtttggatactaatttagagtattaaacatatactaattacaaaatccattccataagcttggactaattcgcgagacgaatcttttaagtctaattacgccatgattttgacaatgtgatgctacagtaaacttttgataattatggattaattaggcttaaaaaatcgtctcgcggattagctctcatttatgaaattagtttttttattagtctatgtttaatactctaaattagcgttcaaacatccgatgtgacatgggctaaaaagttttagtcccatctaaacacttcccgaggagtagggacctctcccagctcatgacatgcgtccttgcttggagtgtgtcctagcggtaataattctatgtcaaaagaagcaccgctggagtgatcagagaactgcacgctctcgctctttgaagcactgcatgcgtgatgcgtatgcgttcgtgttgggtcccttctaatgagtagtgatccatggtctaccggcaaagcctagtactaactcgcaccagcataatcttgatggtcttttattagataacaagctactaggatacatctttgatctctgcatcatcagtaattcatataaccataatctcgatctgtgcctagcatcatctttgattctttacatagaatccacattttaacgaatggcattcgagttattaaggcctacaagttcagatgggttgcatgctgggtttacaaaaccgcacgattatcatgcggttactatgcatggtaacattttcagtttttaaaaccatgatatgtctcgcggttaccacacagttttcacggtaaccgcgcagttaccacggtacgtaaccaccttaccatgggggtgtgataaccgcgccaataacaataagggaaaccctggttgcatgcagagtacagtagtttgagcagcagcatgcatgggaaaggaggcaaacaatgaggtggaaaaggagggacacggatgatggccgcggtttcccgggcacgggcacggccacgcgtgccggacggggcgtgaacagaagccgcgcccgtggtgccgggaaggaacagcaacagcctggcccggcatcgcccgtaaatggagagtttgggtacttgggtgggtcaccggcggctggaccctcgcatgtgcatgtggtgaagaaaatggagtttgtttgtgtggtctctgtacttgcttgtatggttcgtgcgtgtacatgccgagcaccctggttgctcggtgaaagctttaattggatcacgcgataattctcactttacggattgatttgtatataactactccatccgatttcttaattcttgattgatatttatcatgttttagacctgggttaggaggagaggagaaaaggcatcgggtgcatgagaaggaggcggagttctgattgccgtgaaaaaaaagacatacgtattagggaatgacctaatatcaaataattagaaggagtgaggctttaaactcagatcgtatagcccaccaccttgtgaagctagccggaaaacccctgggcgtttctcatttagatcaccaggataccagccaccttcatccacctagcagaaatgaatgcctggtacgagttagggaatccgctgttgtcttcttcctgatgcttcgccttctcaattgaccttctctatgtatgttttggcacgcgctggtgatggtgcatgtgggtagtgggcggcggtggtatcgggagaggaagactgcgacacctgatcttgaacaagctgtcgcctatcactgttcatggcactggcatgcatatcctccaatcctcgacccgtggaaaggtggtgcacgaccagtgtggcacacaggctgtgcacatccaactgtcgtcccacccaatagaccctgacgtcagtctccgtggctccctttgcaccgagctcctgccgtcagtcgttttcattgtcccaccgctaggtcttgcatcaacttaccgctccatccccatggcgcaagaagacctccttatggcccctggtcacctacaccaccatcgcttgtgctattcctcggctcgttatcgaggaggagcgacggcggtgcgcacctcgtgcgagaagcacactactaggaaaaccattttcgcaaaacgagacccttccatttttctaggcgggtatcattttcggaactaaatgtcctcctgtgaaaacggcaacgggggatgggatgctcgtccgcctgtgaagatgcattttggtagacagacgaaaatgcatcttcgcaggcttttgcttacaggtggaccggacggccggtccacttaggaaaaccgttttcatccgctggaaaaaatagttttcctagtagtggcagatacaaggatgggatcccgtacttttgcatttcctataggctaacacctttatcatctctaatcctagcttatagcaacacaattagtagatatgggatggatagctaggtagagagtctccacacaaacaaattttggttgcttgtgggggtgttcccgaggcttagagggataaccgaagtagtggcgaccggcggtggtgatggtgaggccagtgacaactttgtagattgggagagggcaggggatgagtttggtggcaggagaaaagggcgccaaccagttagggctggacgtggtagatgatggcaacgctcgttgctggaggctcggagcgatgattaaccttcttaatcacttcggtcattaatcatccaatatatgtcagatggcgactacaatgcagtgtaacgtaggaagactaattcattaacaaatattgtgtgttcatgtatcaccttatctgacgtgtcttgagtgatcaatgactaaagcgattgacaaggttagtcgtcattcgctatatcagctgtggtgcgggggaaaatctggttgcccaaacaaagctcgtcagagggaggctgtggttggcatccgaaggtccaagaggaattttgattgaaaaaaaaaaaaagagaagtgcacaggtccgagtgaagtccgagtcagacacctcacagtagggcagacgaacgtgggctgttttagacgcatttgtgcgtgtggcccggacacgcgaacattcgtgcattagcccccaacccgtgcatcctgcctgcctgcctgtgcacgttctcactaaagccatgggaccggcaagcgtcgcatcctctttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatatagttgtacacactggtacagtggtacgtgcctacactgcctgtgctacgtactggctgccgggggtcggtgcaaccgtgggcggcgcgccaacctgtttcgaaaaagtcaccactagctcgaagcagagggaatcgatcagggtgttttttttttttgaaccatcagggtgtatcacttgcacatactccatcgtttcttcttatattaaaaaatttaccctggctatgaatataaacaaattagttttttctgataatactccactcagaattattcatccagaaactcaagcacgaaaaagacaacatacataccggacattagctctttctaaaacatatataataaacttgccaaataaaaatcaatagtttgactatgtcgagtatgagtacagattaccccctctgtctaaaaaaaataaatcaaactctaaattaggtatgattacatattacccctccgtctaaaaaaatcggtttgatttattttttttagccggagggggtaatctgtactcatacctcgacatagtcaaacttagggtttgatttttttttgacaggcagtagatgataaaacgaagaggaaagggaaggcagaagcagagcatagaggactccaggttcactgtggcactgtgccatactgtacaactgttatgcatggatcatatagttgaagttcagaacaacacgtcaagcaagtactgtaaaggcgttcacagtgcaacaccaaattttggtgagcctcacgtgtcacctagactaagaacaatattagctacttgttttcacagtgcaagttgtctatagtgggtcctactagtactaactttatcactttaccaccttttcctctccccctctctctcctcttctcctttccccacagcaagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcgggggcccgcctgcaaatgggcggcgagggggcatggaattttgcaggcggcccccttgccgccctgggggagggcgattttgtactgtgctctatatttttttatataaatatcaatagttatcaaatctttttatattgaaaactatacaagattaaaatctccaagattggtaaaatacaattttattattttttaggccatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtaagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctgacgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacacgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacacc

SEQ ID NO: 69394 - DNA, 6214 bp, Oryza sativa
cagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacataatatttgtacggtaacattccaaatatgccctaaaaaataataaaattgtattttaccagtcttggagattttaatcttgtatagttttcaatataaaaagatttgataactattgatatttatataaaaaaaatatagagcacagtacaaaatcgccctcccccagggcggcaagggggccgcctgcaaaattccatgccccctcgccgcccatttgcaggcggccccccgcacagtgcaaaatcgccctagcggagggcggcaagggggccgcctgcaaatttcgttgacggccgtcgcccgagagcgaacggccgtctgccacgtcagtttcgccgccctctgggagggcgatttttaaaaatcgccctcccagagggcggtaggcgactatttccgttaattttcaaaatggaaaattatttttgtaaaacttttaataaaaaaaattataaataaaaaaaattccaccggttcgcaggctccggctagcgcctcactcccggcagggcgcaggcaatgagacatactagcaatctactccctcagtcccataatattgcaatctatgaccggataagacatttcatagtacaacgaatctggacagatgcatgtccagattcattgtactatgaaacatcccatccagttctagattgttatattatgggacagagggagtagcatgcaagctgcacagcacaagaaggaaatcgaagattgccaacatgtcacacgaggaacccatgctagcattttgactaaactttaattggctttgaagaacgacccaacaacacaaaaatgtattttatacatagcatataagaaataaagcatattttaataaaaattaaagatgcaaaaaaacttgaaacttatacacaaacttccacgttttaagagctaaaaaatcatatttctttgaaacttctaataggataaaacaattattaacttgtatgtccaaaaggatattttgggtattttgaaataatggcctaacacaataacgtattaaaacaattgatgaaatcattgttatattatagaaatagataatattaatggcaatcccctgtttcgaaatttccaaacccctagcgctggggtggcgacgatggcggcggagccgcgtgggtcacttcgccggcggcgggggagtgcagcaagggtggccagcccgagtggcggctcaccctcacctcacggcgaggagctcgcggccgccgccaccgagcgcgacaacctcgcgacctctgtcaaggtccaagcacgagttctggctctctccccgtcagggtttcccaaaccgccggggccggggttaccgtgccccggcggtaagcacggttatcgcgcggtaaccgcggtaaccgtgaaaaaccgtgcaaaatttatcaaaaattcaaattatttttaaaatttatttgaatttaaggaggttaccacggtatttatatcaccatactccgcggtaagcccggtaaccgcggtaaccccgcggttaccggcggtaaggtaaaccctgctcccggccacgtccaactccccaccaccagcagcaggaatccgaaacgctctcgcatttgggatttgggagtccgtcgcagactgcgcgacacgatggatccactgcctactactatacggtgtgtgtggttcgacacacacatagcacatagcagcagcttgtctctacaatcatgtcgtcgcttgcgcatctcgccaagatagtctctctcgatgctgtcttgcgttcagattgcgtcgtgctattcgtgctattagaaacagactcgatgacaaggacgtattcaatgtgagcaaaaatattgggtgccgaatctctgaaaacagtcttgacgataaggacgtactcggaataattaaaaaaaaagagttcaaataaatgttgaaaattctcttggttatgtttgtgatggatctaatttgagaaagagtaatattgcaataggtttatatataggggctattctttcaacctatgtgcttgtgaatatgttgcattataaatcgtttgaaatcatgaatctttattgctaatttgagcttaattgtaatatatttgattcatgtttatactacgatgcatgcttgttaactagctaatgaatttatctctcttgtattccaaaacatgaccttgaattgctttaggtacacttcaaagctctcggaaaaaaaatagaaaatagaaaataaaaaaaattggttattacaagtggcaatcatgacatcattgcatttattcttggtgaaattattgtcaaagggagtgaaatatacaaaatgtatgcttcttgaaaggggagaattgaattgttttgattttaaaaatagccgattttgtactttgattgcaaaattgatgggagaaattctttcttttaaaaagggggagagtttttctttttcacttttgtgatttttgtttttatttttcaagaacacaaaattatattttggtgccaatgtgttcatcaagggggagattgtgaaatcattgtcatgattaatattttgtgatgaacaattggctatgcaaatgatttaatcaatgaagtggtttgaaaagatgtgtggatgttggtgtgagtgcgtgtgactaatgtggatcaggttgtgatatctgtgctcagaaatggttgttttgtctgattgtgtgcaggtgacttgaggtcagccttggtcaatggtgaggaccaggactatgctcagagtagtgcagaggtctagtgcagtcgggataccacgtgagaaggtgactagagttaggattcttggggtcaacttcggtcaacggtgggatcgagactagactcagggaggaattgagatgcagacggtcaaggatactggatgacgaagttggatacgagatggcacatggtggatgaatatcatgtgggagagattttcgtaacgggcttcacgaggtatgcgtgcaagcgtcggttttcgtgaaggagattcgaagaaactggagaggagtactccctccgtcccaaaaaaagacaaaccctgctttccgtgtccaacgtttgaccgtttgtcttatttgaaaaaattatgaaaaaaatttaaaagataagtcacgcataaagtattaatcatgttttatcatctaacaacaatgaaaatactaattataaaaaaatttcatataaaacggacagtcaaacgttgacacagaaatcagggtttgccttttttttcgacggagggagtatatatggtgctacagtgcttcgggtactgtagcatgcacatgtatgcgtactatacagctagcttgcttttggttgtgttggcgttggctggttggtccaggagcgagcttggcgtgtgcatggaggcaggccgacagacagcaggttgttcgggtggcaagcggcagtccgagtccgactcggttggatggcaggccgagtcggcccaggtggcccacgcggcaggaggcaagaacgatttgcagtccgactcggttggagttggctgcggtttttatttagagattgaagattgagttctagaggaactaggaggttcacttctactttgtctaggaggattttgagtataaaactacatcaacttgaaaagaacaccaacaaataaggtggaagaatgacaagacaaggcagcacatcggtgacaatactaccagtaacgatgagccccgccatggccgctagaagcgagcttctccggccggcatttggtgaagcatctccttcgctaggacggtttgtcattaaccctcacagctgcagctacaggtggtggcacatgttcctgatcatgctggtgttgtactcggcatgggcatcgccgttcgagctgtccatggagaaggcagcctccattgctcttgttgtcacagacctggtggtcgatgtcttcttcgccattgacattgccttatccttcttcgtcgcataccgtgacacctccaccggcctcctcataactgaccgcaggaagatcacaatgaggtacctgaaacggccgtgtttcgctctggatgtggcctcgacgattcctttacaaataatctaccagcttgtgactggcaaaagacaaggactgtgggggctcctcaatcttctccgtctttggcgactacggcgcgtcagcaagctctttgcgagggtggagaaggacatcagattcaactatttgtggaccaggcttatcaagctcctttgtgtgacactgtttgcgctgcattttgccgcttgcatctacctgtggatggcattcaactacaagatcaaggagcttacatggataggcagccagatccatagctttgaggaccgaagcgtgtggttttgctacacctgtgcagtgtactggtccatcaccacgcttgccacggtcggctacggtgacctacatgccaccaacattggcgagatgcttttcagcatagccttcatgcttttcaacatgggcctcacatcctacatcatcggcaacatcaccaacctcgttgtccgtgaaacctccaacaccttcaagatgagggacatggtgcagcgggtgtcggagttcgggagaatgaaccggctgccagaggcgatgagggagcagatgttggccagcgtgcagctcaggttcaggacagatgagcagctgcagcaggagatgttgtcagagctgcccaaggctgtgcggtcgggcgtcatgaagcacatgttcaagagtgctatcgagagctgctacctattccagggagtctccgacagcctcattgtgcagctggtcgcggagatgaaagcagaattctttccccccaaggctaatgttatcctagagaatgagacctcgacggactgttatatcatcatctctggcgaagtggaggcattgacaacccttgcagatgggacagagaagcatgtgaagagaataggacctcggggcatggcaggggaaatcggggtgatgttcagcattccgcaaccattcaccatccggagcaggagactcacccaggttgtccgcataagccatatccatctgcttcaggctgtccggcctaacaccgcagatgggtacatcgtgttctccaattttattcagtaccttgagtctctgaaggtgcaaacaaaggatgtggcttttgtcagcgatcatctttggaatggaaactcaatggttttgagaagggcaaccgaggttgctgtagatgaatcaaaagaggccgctcacaaaatgttaccatgcaaagaacccaaacgggttgttattcatgagcaacttcccaacgcgactagcacagcactgcatccttcgccggggaagctcgtcttactcccagattcgatgcaagaactgatgaaactttcagaaaagaaatttgggaaggccgtgagagggatcctcactgtggaaggagccgaggttgaggacattgaagtgataagagatggcgatcacctgttatttagttagtaggatatgccatatgctgtggcagattgtaaatgtatatgatatgagcatttatatatgttcaaaaagataatattaatggca

SEQ ID NO: 69395 - DNA, 1970 bp, Oryza sativa
  unsure (1)..(1970): unsure at all n locations
taaactaggtctcacgtgtcattgactcaaagaagtgtggcgatgctcccttagatttgataaggtgtgccaataatgtgatcgcctcaacttaggcaagtggtaatatttgttagcaaattagtcccgttcttttcttcaacaagagttggatgaaaattaagatttttgtggcacacttttcaaactgctaaacggtgcgtttcgtgcgaaaactttctatatgaaagttattctaaaatatcgtattaatctagttttcaagtttgtaataattaaaactcaatcaatcatacgttaataccacctcgttttgcgtaaaaaacttaatcttcatcttcatattcatctttaggagaaatgaacaccatctaagtgtcattcactttcctacttttggcagcatatacctatgttggtgttggtgtagaggccaggttttacctattattttaaaaaataaatccactttcctactaggaaaccacatcattgaaaatcaccactatgacaaccaaaacatggtgattgaaagtttaaggtaaaaagatatactttgaatacagttcaatggtcaaaaatgaacttatagttgccccaagaacgtaattgacagtttttttttcttttgtgtggggagcaattgatagtaactgaccaaacatattaagaaaattaccatgattgtgggtcatctggatctcgatttgctagaatcatctctttgacctccaaggatgttaatgcatctggtctattttttgcgtgtttcgagaaaatttcctcaaactttgcaggaacaaacctgaaaatcatcatgtttaatatatatatagatccaaacaaagtgtagaaatcttcaaaaagagcatgcaattaattctaaagaccaggcctaaataggcctcgcgcatactgaatatgtgcaaataagatgcaatataattattaaaattaaaacaaattgatacttatggaatttgagtccaaaaataattgagttttgcatggtttcatgacaagaaagaagtgataatttgaaccataaatatattattcaaaggctagaaataattgaggtgatgtggcttaatgagagaagagaaaaataacattaattacacttagtggggatgaactatataagtatataggattacactcgaataaatgtaggatgatgccatgaccattttgatttaaggaaaaaattagtgtgttactattatgacctctgaattaattgcaacacataccgtacgagaaaagagtgtgtgggaggaatttttgccaaggcataacttaattaatcatgtatagtattactaatgtatgtaaagtggaataaaatatgcatctaaaagttgtatttcctattaaacaaaagatagagtatatcaagcaaatgttcaaaactcactaaagttcttttgtatgtactcctaaagcatttaaactaataatatgtaattatcttgctatttagatacatatgcatcacatattattgttaatatgcttgacattaattatatgatatcatgtgatatcttctaacacttatgtaagatatgtatatataggcatgtggttggtgttaccttcctttagcatctagtgcacctgtgtcactcccgtgcattcctttatagatgttctttatgtatatcgacaagtgaggtaatggtgcgtccttctgcacatttgaatacggaaacaatatctggtcaattatttccttgtgtgtacaataaattaaatagcatatctagttagtctattttggaccaaattcataataaacatgtcattatttttatatgatttgtttagaattagggttatgagagggattgagagagtacggggcttgttttaggaccaagaccannnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69396 - DNA, 19500 bp, Oryza sativa
tttaggcgactatttccgtcaattttcaaaatggaaaattatttttgtaaaacttttaataaaaaaaattataaataaaaaaaattcgcgtcgcgcgggactccaaatttgccgtggcccaacaaggcccatggggcatcaccagtaagcccatgatgccgcgccacgacgcgacgcagtgcgctggccttgcggacaaaacgcaccggcggctttgcgcccgtcttcacgggaaatcgaggagccgagcgagacgctgctaggagagagcgacgtgccgtgttttgtcgcccaaaaacgtgtgggacggtgatggatcgaatcaaatgatagcctgtctggtttgcaggtgagacgtgagaccgcgcgttgtgtaatgctggaattaagtatattttgccttttttttaaaattttttctacaaaatagataattgaaaaaattattctaggaatagactttttttcaatgccaggaccctagcgccgaggcccatcatcaaggcgccaacgacactggcgctcataccctcgccccctgcggaagctaagtgactaatgtaaagagagttggtattgaggacttacagatagatccccgatgctagtgttattgatgccaaggacatatttataagaaaaaaaatatttatattttaacccattttggatttgttttttttacaaataggtcttcaccactagtgttattggcgctgacctcttttacatcaatgacttagcatttgcaacgggtgagggtgtcaactcggtgccgcaccaaggcattgaacctcagcgccaatgacgttaacgtcaaaaaaaatgcatttttttcagaggtatatttgtgttgacggaaaacatggcgtcctgggagctctacttaatttcaatgcaagtctaaggttagcctcgagtgtgtcaagggcgtgccagctggtttgatcctgcaaccagcaagaaaataataaatagagtgagtcagccgatagttgatcggtcgagataggccgacgacgtatcactggtgatcctagccgatgtaattgaaccagaccggctgtggattggtatataaattaagcacaaaaccctaaatatacctcatcggctgtaatagcatctactcagttgtcaaatatattttggatgataccatagaaatataaaataggtttttagaaaggactacaaatataaaaaatccaggtgtgtgatgcacgtggtatgaatctcggcacctatttcgttgctggcattaaatttcgtcaaatatctccttttttttttttcagatttggacatggactggcctggctgctaatctgagagattgatgctacgtttacaagggacaggactcgcgaaatgttcaacgagatcacacaaatggtcaaaaaaaaaatgggagcaatttgagctgcggtagtggactatgaccgataacaggagaaaccacagctgttcagtttgattctaggggaaacacactcaagaagaggacattagatagctgcaaattccatgtgcgatattgggaaagagagaataaataatgaagctgttgccctgattggagttttggaccaggaccaattgtgcgaccaaggacctgtttggaagattagcccagggctaattttgagagttaatgtttagtcctgaatttgtaggctaaacattagcctagggtggcatgtttggatcgatgggctaattcaaggctaaaaggtggagagagagtagaaagagagaggagagagagctgtttttttatggtccccacacaaaattagccccattagcatcccttggaggggctaatgttttgagggaggctaattcatattagcccaaaattagcccacctgtttggatccttgagagctaaattgaggctaaaaggtgatagctaaacattagcccatggaaccaaacagggcccaagttttggaccagtattaacttccacatttgcctttaaatttaaaaggcctcttttcagcacgcatgaacttttcaatgtgaagtgaactaagagaaaaaattgtactgaaattcatgtgagcatttctacgtttaaccgaatgaagttgtgaaattgcccaaacgggaattaatagggaaatctaatgaaatgtttgcaacctcccaagattttagaaaagaatatctctgttcaaaaaaaaaacaaattacgtccaaatttacaatgtttctatgagcgaacatgtttcgattttttgcatgcgatctccggaatggacggagaatgcgccgtcgtcgacgctcgtcgtcgtcaccgtcgacgacgacgggcacgaagcggcgccggagtcgtcgccgtcggcgttctgcactatggccagcgtgatgaagctccggtacgtgggcgctagctccggcagcggcgcgtcgccatcgaggacctgcaccaccagccgcatcggcggcctcgcggcgggcgccgggtgggtgcagaggaggcctagcttgagcaccagcgccgcctcctcgtggtcgtagtctccgcggagccgcgcgtccgccgcgccggcgatgtcccccttgtgccaccggtcgagcacccagtcggcaagcacgaactcgccgtcgtcgccgtcgtcgccggtggcgccgccgtgctcgatgggccgccgcccgcacgccacctccaggacgaacgacccgaacgcgaacacgtcggtcgccggcgtcacccgccgcgtgtgcgcgagctccggcgcgaggtaacccagggtgcccaccacccgcgtcgtgcgcgggtcggcggcgccgcggccgtacagccgcgccagcccgaagtcgccgagccgcgcgtccatctcgccgtcgaggagcacgttgctcgccttgacgtcgcggtggacgaccacctgctcccagccctcgtggaggtagagcaggccggcggcgacgcccctgatggcgcgaacgcgctgcgcccagcccagcggcggcgcgctctggccgtgcagccaccggtccaggctgccgttcggcatgtagtcgtagacgagcaggagctcgcctctccggcggcagtagccgagcagcggcacgacgttgcggtggcggaggcggccgacgctggcgacctcggcgacgaactgcctcatcccctgctccgcgtcgtgcgacagcgacacgaccttcacggcgacctccgtcccggacgccgggaggacgcccctgtacacgcggccaaagccgccgacgccgagcagccgcttgccgtcgaagccgcgggtggcgcggacaaggtccttgtacgcaaaccggtgcgggccgaactccacctcccagtcctcccggacctcggcgtgccgccgccgccgccgccgccataggaggacggaggcgacggcgacgaccaccgcgagcgcaaggagcggcgcggccaccggcacgaggaccttgagcaccatggaccgccgcttggtgctggcgcgcggaagcttggggagcttcgcgtagtctagcggcggcgccggtccgtccatggcgaagctccagccgagcacgtagtggcgcgtcttgtgcggccccgtcgacgacgagaggccgacgtacgccgccgcgtccgccgccgccacaaccggcgagaggtcgacggcgacggagaggaggggcctcctcggcctgggcacctcgacgggggccagcgtcacgtcgatcgccgcggcggcgccgtcgtagtccacccagacctgcatggcggcgccgctgaagagcgtcaggttctcgaactcgccggtgtcgtcggcgtagtagccggcgggcatggaggcgacggacgccagcccgttcacgtcgacgccgacgtggttgccgttgatgtccccgaactcctggttgcggatggtgtcgagctcgacggcgaacacgcggttgctcgcgttgccgttgttctcgctgttgaagaggcccaggaactggctcggcagcgccgcggacaggttcttgctcggcgcgacgaagaaggcgagcccgttgccgctcaccgtgacgtactcggcggcgatggcgaacacgaaggtggtcgagaaggaccgggcggcggcgggggcagtggcgttcggcttcggcggcggcgcgacgaagcggagcggcgccgggtggaacgcgtggcccttcatctgggacgtgacgttggtcagcatgagcttgccgtccggctcgaccatggccatgccatcgaggtcgagcggcgcgccggcgaagccgtcgtacctgaaatggtcgctatcaccaccggccgccgccgccgccgccgacgactcatggctaaggataaggacgtggaagagtagtaacacaaggaaggagacgatggagttaggcttgggatgcatggatggatcaatgggattttgccgtgcaaagctgaataactcatgtgtcctaactcctaagtcgtaattaaccaattctagttaggtaggatactatcaggtctgtttatttttgcaaaaaacaggaatttggttaagcaagcaatcatagtaaatcaatagggaatcgctaaatggcatttgacattaaactgatgaggccaaaatcttgcaaattttcgactttaagattgcttcacgattcgtgttctgaaatcccagtttttctcctctaactccagcgaccggctgcaatctaacaagttacggtttagtgtcccgggttagagtggcagtgggaggtgggaagggaagaggaggaagatctttgggctttaagggatggtcatggaagacggcgagatgccggtggccgggctaatgacaaggcactggcatggaagccacgaggatggaggatagcggtgggccgacggcagggtaaagtaaagtttatggttaggaggcgactgccgatggtggcaaacctggtggcagtgagttgtcggagacgaggaaaataacagggatgggacaccttgtagctatcagcttaaggagagaaggaatggggcgacagccacagtgttctcgccagtaccattggcgtcctcccgccagacgacaagactgaacggctgcggagcatcaagcactctcctctcgtggcgacactaggagtgaggggggacgagaggagggatggagttaacgttaggttttcttgcatgaatcttaaagcaatctaacggtcaagaattatagatagacagtccatctatattactttctttttagttttttacactattaaagtattgaacttgcaacaccacactcaaaacattttaataaatacacctacacctatatatttactgtacattactatagcttagggagtttgatatttcacatatgtggaacaggtttccaaaagaggataaggagggagaacatggtaagttttgtttttttttcataaaaaaatctccctcctatggaaaaagtacgaattaccctcccgaactatcgcggtcgtccgaattacccacctaaaccaaaaaccggacattcttcaccccaactatgcaaaaaagacgaattatccctctcaacccaatccgcggtggttttggtctacgtggcgtacgcgtggcagtccagtcagcattctatttataaaaaaaatatgggacccacctgttatatcctctctcactcttcatctcactcttctctctcttctctgtcgcactctgcggcaggcgggggacacaaagtggcggcggcggcgcgcacgcacacggacggggccggaggcggcggcgtggccgagacgcgcatggcggcgaggacgacggcacgcacggcgcggcggcgcgcacgctcgcggatagggggacctccggcgtgtcgccgtcgacgcgttcgcgtggctcaaggcgcggtgggcgtgcctccagaagcaggggcggatctacagtactagggccggtgtcaggtgacaccaacgactttcggtaaaacctatagcaaaactgattatccatatgttatagcaccatgatctaagcataattagtatattatgacaccgatagacacgttatgataccaacgaatcgattttctagatctgccactgtccagaagcgcacggaggtgaagctccaggacctccccgtcgtgctcggcgcctgctgcgtcctccacaacatctgcgagacgcgcggcgaggagctcgagccggagcttcggtacgagctcgtcgacgaatagacctcaccggagacccccgtccgctccgaggccgccaagcgcgacagggacaacatcacccacaacctcctccaccgcggcttggccggaaccaccttcttctgacgatcgattcgatcacaccgccgccgcttcttgatttcccccttggtccacttgcagcatctccattactattgtgatttgtcaatgtcctgcagacctgcagtttgattgctttgctttgtcgtcggcgtgaactcttcattgtttgattgcctcaaaggctggttgattgtttaccagtactccttgattgcatcttcgttctgccgcgacaatgaagccggcgctggcaaccgcgggggcaccctcctcgagatcctccgcgggatcgacgagccgccgagcaagctcgagctccagcacgcgggatcaacgagccaccacctcgagttgggctcgctggagacgccgacgacgacgcggaactcggcgtggatggggcggcgcatcgaggaggtcaaggcctcgagcctgcggccgggtgcttgccgcagagccgtgcatgccgccgtcctcgccgccgcctccggcccctgtccgcgtgcgtgcgcgccgccgcgccgtgcgtgccgctgtcctcgccgccgcctccggcccccgtccgtgtgcgtgcgcgccgccgccgccacttcgtgtcccccacctgccgccgtgcgcgtgagagagagagaggggaagagtgagacagagaagagagagaagagagaggaagagtgagagagaggatatgacaggtgggtcccacattttttataaataaaatgctgactgggctgccacgtgtacgccacatagaccaaaaccaccgtggattgggtcgagggggttaattcgtccggtttgtatagttgggggtgaagaatgtccggttttatggttcaggggggtcattcggacgaccaccatagttcggggggtaattcgtacttttcctcgtcctaaataggttctagtggaaattaattttggacgaaaaattatatataccagtaataatatttttaagaaatctcacctttacattgggattttttgcgactcctcttctttctaatggtctttttactactcaacgttctttgtgatggcagcgctcaaatttgttctcgcttttgtgatatcatagcagtgtgctgtacgctactattaaaagtttgattgaaattgaaacgatgtgacggaaaaattgaaaatttatgtgtgtagaaaagttttgatacgatgaaaaagttgaaagtttgtgtactaaacaaggcctaatactcgagctaggcagccggtcaactgagtcaccattaggaccaccaaagctaggaagaacacaggaaagttcctggttgattgttacgctcgccatcagatttgtgctgctcaaccatagcccgccataggattttttctgcggaatctatggcttcttgtttgtctgtgtttgacaaacttgtttccacggttttatctctataccgttcatgatggaggatttggagctattttgaagaacaaataattataagatagaattaaataattatgataaggcgaaaaaagagtcacgatattcatttaatcattccaaaggtttaaaaacagccacgcttaataggagaaacgaaatatatatatatatacaccgtttatatcgtgattagtctaaattaaaatgtaaaaatgtgtaaattgaacaatagtcatatacaaaacacatttgtatttatgaaagaagaggggaccattgtatatcaaatccaattctattttgaatcttgatcctcacaaaattacacattaaagacctctatttataatgttatctatctatacttaggcttcgatcgttcccgggtgttctggaagattgagagagaaaacatctcgttttccgcgcgcacgcttcccaaactactaaacggtgtgttttttgtaaaaaaaatctataggaaagttgctttaaaaaatcatattaatccatttttaaaatttaaaatagttaatactcaactaatcatacgctaatagctcacctcgttttgcgtatcttcccaatctcctcaatccccttctcctcaaacacacccttagtataaaaaagcaacacttcacttcttttctaggtataacccagaaaacatacacaaaaattggtttttctttcctcattcatccgatctactcatccaacgacaaaagagggaagtatatggctgtcgtttgtgatcttttttttttagggggtaaaagcaggagctctgcctatttcatataaggagaagagagagaaaccaaagtttttacaaacaaggttacaaaaggatcccaagcggaccctcctccgataaagacaggttggagacaagaatttttaggaaatggaaagcaactaatgtgaggatacgagaactactcatctaagttgtgagctccatcataggctttgcacatatcgattatggactcaacgacttgcatcactgtgctgtatgccccattgaaaatcctagcatttctttgaagccaaatgccccaaactgtgtagatgaagaggccatcaaagtttcttctttgttccttcgccatctctctcctgcaggccgtccaccatccaagcatgtctccattgtaagcggcggctggtggcatatgaaggcccgctttctgccaaatgtatctccagacttgctttgcgaaggatcattccatgaggaggtgggtggctgtctccggttccacaccacaaagtgggcagatgtggttgttgtcccagccgcggaggctgagtttgtcagctgtgaggatcttcttatgtatcataagccaaccgaagaatttgcatttgttttctacttttgccttccaaaagaaatctgacatgttatcttgtacgcctccaacgaattgtatcatgtaagcggattttgccgagtaggttccgtttggggaccatcgccacataatcgtgtcctccgttccttcttgcagaacgacctgctggatttggtgccataggtggatgaattctctgacttgggctgtggtgttcattcttcgcatctgtctcaaccagcggttgtcctgtaactcctgcgccaccgttctgttctttcttgttgcaatctggtagagtgaaggagatagctctttaggggataacccatcgagccatctgtcatgctagaattttgtcttttggccatttcctagtgtttgtgatcatacggtgaattcactaattctcaatccttcccactgagaacgcgtgactccatctccatggccctaaacaacgcatgattaatcatcgccactcccttgcacgccatccccgctaccgtgccagggccatccatgcggctgtgccattcgcctgctatccgcctccacctaggatgacgtgtcctcgcattacggacgtcgctgcgcctcccgctgcaaatctcatcctcccgcattgccggcacttcgcgaggaggcgaggccgctgtcgcaaaacccctcgccggtctccagccattgccacttcgccatctccgttatcctcccaaatgttgcgcacctcttgccgcaaatagcttcctcccgccgcaaatcgcagcctccccaatccccccgctggcaccacggtagtccgcccttacccggctgggttgctccgtcttggtcgccactgcaatcgccctggtgttccatcctttcctcgtgcagccatcgccatcacaatcctctcttcccttggcatcgccaccctgctgtgtccccggtggtcctgccatccgtcagcgtcgccgtcctctcttccaccagcattgccactctgccatgcccccgaaggcaaggccatgccgttgccatcctctcttccaccggcatcgccacttcaccactcccacagtggtcctgccttgcactgccattgcaaggggctctcacaatcagggaggaaactgagctaattagtaagtcaatcgtttcccatagcttcaatcttcactaaaccttataatatagctaggttcaaggtcatgcctcatactgtctattggtgttcttgttcccattggcaacgttgcacggtaggtgctcaacggaatgtttattcactgcaaaattatgcattgcagtggagcaaagaacacaatccaaaatatgaactgacatcaacaaggttgttgtcgtccaatctatagtcttttcacattgatcatctaaaaacctcaacaatcaattcacagcgttagaatgctgaaccatccaccacataggtctcacgtttatttttaatcttcctattgaatgagctaccacgtggacactatataccttgtttcgcggttgaatgatatgaatcgattctacctatatttaagggagtcaaattagacttttaccgacccaagtgcaggggtcacggcgcatggggcttccttgttgccacggcacaacgcccatggacatctcggcgaccaggccaccacctgctagcctgtgctgctgaccatgcgctccacctatagatggccaaatgggcagctcgggctgaggtcagtcgggctaggccatgcccacccacgggctgcactaatatctcaagcacggcccaataatactcaggctgtgttgggccagtccgaagacacgagagcccatcgtgcttctccatggaataagtctatttgtcatccctcatctctttgaaccttgtcttatttgactgtaataagtctattgtgtgtccctcttctctttggttgtgccttatatagctaattaaagtctttggatccctcaactatctttcttcctgctcattggaccgtgtcgtgccgggccagcccaccataccaaggcatggcccaactatcagatcgggccggcaccagtcgtgctatgtcatgcttggaccggcatcagtcgtgctgtgtcatgcttggacccggccgaatagccgtgccatgggccggccgtcgtgcctccggccttatagccatctttagctccttcacgctcacgcgttcgcgggcacgcgggatttctcgtcacttcctcctcgacaccggaagccccgcgcgcgacgcgacgcgcaaagccaaactacgcaacgcacgcaaaaaagggggcctgcctttgtaccagcggccagtgcgctgccgactcgtcgacacttgcacgctttatcaaaggcaaagaggcctctcccctgctcctcacgccccctacatctttcagcttcttttgagcctgagcttatttcgaccaaaccaactctgattttggaaagagagggaaaaaaaaaacgagtaccgaagtgatttcaaggcgagatttatgaccttgctgatacatacattcgtgcatataccgtatatattaactactatacgtccatgatgttggtccatgcattgtacaaaggatgagtcttctctgcaatactaatatttagcgtaggttagtttatatgtcaaccactcatagttaaagggcaatactgcgtttctgtcaagtacgtatggagcaatgccgtcatctcacgaaacttcagttcatttcgttcccattgttcactccttagcagaggtgtaaacaaatacacttttccatcatcttaaaaaaattaatcactcatgacgacgttctaatgatgatttgaacgtacagtagtactaccaaagagagggagcactaagatggatcatgatggccgccttgtcgttctcataaaagctggaattattcagctcctcaaccgccttactcaccaaagtattatatgccatggcagtacaacaaggtcgtagtaattaatttacccatcaagaaatcaacaatgatgatatacatgagtacattggcaccactcaccagtcaccaaccatgcattgtatatatataattatatatatgagataagaccaattaacaactgcttggacatgatgaatcatatatattaatatatatataagtttcataaacaaattatctaacaagtagacaccacactttaattaactccttgattatttttttgagtaatttttccttagtggctagttgcaggtagcagctggaatcttcacctcacacttcagcacagtggctccctttcagcgtaggtcatttcggcatggcttcctctttgttttggcccataatgagacgacaaaagagaccctaaaagataaaagagatgtgtaggagagataccaaagcaatgcccaagaaaaagccacaccgaccgatccaatctgagctaagtggtgaccatcctgctcacccttagcttttgcctgcagatgattcaggtaaaaaaaaaaaaaaaggtatatacatcaatgaatataccatgaacaatggctatatatgatgaactgaatcaagattcaacaaattctgaacccaaaattcttaccaccgacaccgccggctcttctgacgaaggagaggaagacgatgacgagggcgacagccgcgacgaggccgatgatgattgcaagtgttttcccagattcatctgatgaacaattggaacagatcacccacagaagaacagtcaaaagccgaactaaatctactccttgtatgtgatgtgagtgagtgagtgtatatacagagtgtagtagctttgtgcaaagcagactagttaaaggtttaaagctacacgaaaagggcagaaaaaaggctgagcggtacactacccacaatgggataccagagatatcctacccctgttttcaaattccaatgatacaaagctggatcattttgaatccactttgtgatattcacagcaaccttattgacaccaagaaagcgaatccacatcaaagttcttgctaaaagttcagagcaaaagtgaagggaagaaaagttcttttgggggttcttttgtttgctatacacctttgtggcttgcaccaaattaaccacaatttgcttctagctaggctgtactatctgtcatcacattggcacaccatatacaaaaactaatatactatgcccatgcaaaatatacagttatacacaacacaggttagatttgaattgtaatgtctgactagtacacattcagatttctgtattattgcagtgtgtgtaattgaagaaggccaagcagatcagaacgttctatctggtggatcaatcattgacactctctaagagagaaatgtgggggctactcatgcagtgtcatgcctaatttcagatgtacatttgcacaacactacatggaaacccctgatttcaggaagctctgcttactttcttgtgttggtcaagaactggatcactcacatccaactgtgatgtcgatccctaatcatgtagcacacaatgtgtaaatttctgcacctctgactacaaggtctatctctaccaacatcagaatttcttcacttgaactagcagctaacttcagatagttcagctaacctgaacagaagagactgggtgtaccgtgcttaacattaactactgcaagtctaggaaggctaaaaattattagtgtcatgcaatgatgttcgtgcactcatcatggcagagacgtaggaagtacccttgggaatatataaagtctaatttcagtaaatgactaatgttaatgattcaatagtacgtgtagtttaatgttgcactgatgatcccagctatggttgcaggatccaacaaatattcagaattccgtaaaaagtagtgacccagatgtgcaggctctcgcatcaacgccatttctttaacgcccgtttcgatgcaatgtaatgtactctacggttatcaagataacggtgagcccagtaagatccacaatgtacaatcatcaacagctagattatacaactggatcggccaatgtgcaaaggaaagcaacctaaacacttcagttggaaactgggaaatccccaataactaatacttataccttaaaatccatatatcactcaagaagaaaatcaagaatgtgtcatgtgtatcactatacgaactgcatatcatttggctttatgtattttttattaaaaaataaagatcaagatatttttaatttgtcccgcaaacaattaaaattgttttatccccaagtgtctcctttggagttttcacaataattagtctaattatcgcggttcgaaagatttctcatgttttactacttgtaaaaaaaaattagtgatgtgatggtaaagtcgtgggtgcataacaaatcctgttgtccacagatttttatacatacgcagttgcattttcaatagaaatttagttagaccaagattcacctcttgccactagtctccatctctttgagcgtgtgttaacgggagcgatttagtaggtgttgagtgtggcatgcttgtgtgcaaatagccattttccatgaattaaaaaaaaacagcagcatccaaattttttactactagttactgtagggaaaaggccatgaaaaatggaacggccagaagaatggaaaaaaatggttttattgtttgccttatgcttatatttataagtcaaaatttaaatttttgaacttaagtttttttatttttttcatcgtaatttattctacaacatttgattttaattaagtcactgagaacacatatataaaaattttatttacaaatgcatttttatttgccaaatattagtaataagccattaggataagcatacgaataagggaaataatgggctgtttagatgcttaccgtggtcactgtacgtgtgcggcacaaatccatatgcgtatccattgcctccgcccacagcgccgccgccgccactgatgccattcccgccgccgccaatgccgccgccgccgccgctgatgccgcctccgttgttgtccccggttccggcattggaccagaagcgcgcgtagcacttgccgaggtacacctcgccggcagaggcgtacccgcagccggccttgagctgcgacgacgcggcggagacgcagtcggtgcaggccttggcgccgaggtcgcccacgcactgcgacatggcctgcacgtacccggccgcgccggcgcggtacgagccgtcgccggcgggcgccgcggcggccacgagcgcgccgagcgccgcgtcgcgcatggcgacgacgcccgtgtcgctgccgccctcgccgccgcacttcttgaacagcaccgtggtgtcctgcctcccgaggaacgagtcgttcccgtagcggacgaagcacgcgcgcagctgcaccccggcgccggccgcggagttgcagagcgacgcgagcttggtggcggccgacctgacgcagccgccgcagatcgcggcggggaggtcggagcggcactggtagacgccgacgaggccggtgccggaggcggccgacggcgaggtgtagttggcgtaggcggtgtagcccgcgctgttggtgagcgccgagagcgcggtgtcgacgtccgccgcgtactgcgtcccggcgtcgtagcgcgcctgcgagcacccggcgtacacgaacgccgtgtagtcgtcggcgccccgcgcgcgcgtggcgcaggcgcacagcacgagcagcgccgccgcgagacgcttcgacatggctgggcttttcttggctccggcgagatccgcggcggtggttggcgttggaagccgagacgaggcgaggcgacgccggtggaggaggcaagagggcagtggagtttgtggtcactgtggtttgcttagttcgaagtgatgatctgatggttttttaagggtttttataactggaccactgcagcagggcaacacaagtccgtgtcaaaggtgagttttttttttctccactgcaaaagtagggtgcatggctgtattcatgtcaagaaagcacttttgtagtatcacaagtatggtaaaaatgcaaaaacttttgccaaataatcaaagcgcatatatataattttttttccgaggaacatatatgtttttcatgtattgaataccgtcgagacttcattgtaaatattcaattactgtctaagatatactactactcacaaaatcagaaatgtatacccctaagctcatttaaaccgttcaaaggaggtcccatagtagtatttttgcttaattttgctgacgtggcgtcttagtcagaaaaaaaattaaaaaaattacgtggggcctatatgtcagttgcaatttttttcttctcttttctctcttctctctttgccggcggcgggcggcaatgggcgagcggcttcaccgtgacgagcgcatggccggaggcaggaggagcggcggtggacgggcgtggcggcaagcggcggctccgggcacagctgcagagcgttggcggcagcaggcggcgggcgagaacgaccgcagaggactagcgacagtgggcggcggtgcgcggccagagtcggcggagcggcggcgggcgagcgggggacgcggcgtcagcgcgtggccagagtaggcggagcggcgactgcggcaacggcaagcgatcggcgagcggcagctccaggcgcgaatggagcagaggggcgggggacgcggggggcacggcgggcgagtggcggcaaggcgccgcctttttccccctctccggccggcctcatctcctcccggtccgcccggcctcctctcccgtctccagcggtcgtgggaagaagggcggtcgcccgcaggctacgtgggcaggggcgtgccgacggtgacgagcaggcagcggccactgtcgcacaaagatgatgaggaagtacaaccgtcgccgtgaagccgttccggctgcgcgccgcttgcctccgccgctgacgctctgcagtcgtgcccgcccgctaacgccgccgctccgcttgcctccgtccacgtgccgctactgctccccctctaaaaccgaaacagaagaagataaaaaggaaaagagaagaagattgctgagtaggatggttgatcccacactttttctcacttacatgtgggtcccacgtatttatctttttattttttgctgactaggatgctacgtcagcaaaacctggaaaaaatactgctataggacctcctttgtacgatttaagtgagtttagggtacacatttctgattttgtggttaagggactaaaaaaattctcgctgttaagttaagggaccttcggtgaacttattcgaaaaatatatagcgtgtgtacagtacggttgcaaggatcgcccttggcgtatgggccggataatagctgccgggacgtggccgtctagaggaaaaagtacaccgaaggtccctcaacttgtcatcgagttacaaaatcgtccccaaaccgcaaaaccggatgcaacacatcccctaacttacaaaatcagtgcaaactagatccctcggcggttttgactccggttttgaccgacgtggcagctgactcagcgtgggacccacatgggtcccacgtgtcagcctctacttcccctcccatctccacctctcttcctctctctcctcccacgaaagcagctgggtacggttcggctggcgcggcggatggctggtgcggaaaaactgggcggcgccagcgggggaggagctgggcggcgccggcgacaggtgacgcctgacgcggggactcgggagaaggggcgacacgggagaacgggccacgcggcggcgatggactcggcgggtgccccgaccgcggagctgttcgccgccttcgcaggagaaccgcggagcaggcgagcgaggcgggcggcgacctcgctttcgttcgtgtgcggcgtcggcgtcgtcttcatcctctgcagcgagctcccggcgagttggtgaaaactgcaaaaccaggcaggggctagcaggcagtctcggtcgcgtgtgcgtcgggcggcgttatcgtcggcgaaggaggcggacgaggggctgagggccgggttgctacgggcggttcacggtcgtgggcggcggcatgtcggaggcgtcgggcgccgcgcgcggggtgtgtgggggagtgcggcgtgcggccgtcgtcgtcgccgcgggctggaagctaaccggcggagagtcgccgctgccggtggcatctcctccctcatcggcagccgcccgcgtccgccgtgcccatatactctttgccatccgtcttgtcacgccgttcctcccaccccgcatgcgcgcacgacgtgcccaccgtcagaggagagggacacgtttggtgggtggaagcggacagcgacagcgacgatgacaacacgggtccggcgagcggcgagcggcggtgcacctcgatccagacggcatggaggccacctataggctacagcgcacggtcagcggcggcagaggcctgccgaggcagcgcgacaagcgttgtgggggcgaaagtcggtggcagctgcacgccgtccttgctgccccacagcgcacgcttatcttctgtgtattcaactcttcatctccacaagacttcagtgatgaaaagacacacgatgcaccgccgcctactgctagcccgatgtccttggtgaccggtgctccttgtctctgtcttgatgcagcaacgtgcctcgtcgtctccctctcccatctcccatcaatagattcatccccaaatttgcgattggttgcatatggacgacgatggtggcagcccaggccgctcgaccgccacggcgccacgccgctgtcccgggccgctcaacgttgcgccaccacgtggaccgctcgacctccgcggcggtgggcgcgaaggtagaagcgggcgccaccgcggtggtgggtgcggaggcacggctgctgctctggaccgccgccggcatcggtctgttgttcggcgaagtgagagagagggacagaggaggaagggagagaatacggggaagagaggaggctgaggtggccacgctgacatgtggggcctcacgtgggtcccacgctgagtcagctgccacgtcggtcaaaaccggagtcaaaaccgccgagggatctagtttgcactgattttataagttagaggatgtgttgtatccggttttgtgattgggggacgattttgtaactcgatgacaagttaagggaccttcagcgtactttttccccgtctagagcatcaactactggggttgcctcttgcccacgccacgggcctgaggccgtcacgcagcctcggtgctggagcggttgatgggctttctgcccccaccggttcggaattttttttatttataattttttttattaaaagttttacaaaaataattttccattttgaaaattgacggaaatagtcgcctaccgccctctgggagggcgatt

SEQ ID NO: 69397 - DNA, 25988 bp, Oryza sativa
cgccctccgctagggcgattttgctctgtgcggggggccgcctgcaaatgggcggcgagggggcatggaattttgcaggcggcccccttgccgccctgggggagggcgatttttgcctcccccctataaagcccagcccctcccctgtcaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgttcaatagaaggttatttttgggaactaatgccaatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaacaaagggaggagcaggccatgggcatggcggatgagggggagagagtcggtataattgttgatgaaatggagagggaagattcggataatgagcaagcggaggacgacacatcatccgatgaggaaggtgatgtaatggccactgattgggcaaatgaggacttctctggtcttgttatatcagagggtgatcatgtaccctgggagtataaggagaacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagaatgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatcgaacaaagagtgtgctgcaaagagcctttttctcattgggtgctttcatcaatgcttttgtgcattgtcgacctgttctatgcatagatggaacttttatgacaggtaaataccgaggtcagatattgacagcaattgggtgtgatgggaacaaccaggttctacctatggctttcgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggatctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccactggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcctacacaacgctgagtgcccaagttttttatattccagatccatctaagttaagggtgaaaaagggtcgacgccaaactagacgcatcagaaatgatatggatgagtcagaagcaggtgggaggaatttacgctgcagcaagtgtgatctgcgcggccatacttacaagaaatgcccgaagaatgcagaagttccaagcggcgctgatgctagtccatctggacaggcaagtgatggtaggcgaccaactggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtactgagtacctccgactattgttgtactagtactattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactgaactttgctttgttttgcacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagatgttattatcatacatgattatttgcgaccggatgagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacgggccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggacgaccagtggtggacagcgcaccctacggggttggtcgcagcgcgcagtggccagaggacggtcccacgatggggacttactggtgtcgacgtggggttagtgcaacttcgctgcgttataagtttatcagtcatcttctttttttttccttcacataacatgtctaattccgatcatgtttattgcagcgtcgttacgctcacatccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagcagaggtttgcacttgactgacgttgagcagaggtcgaccttcgaccggatgcaggagaagatgcgtgcggtcctgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcccttccgcgagctccgcaggggcgttcgccacctcttcgggcgcgttcgccagctcttcctctcacggagcgtcgatccctcacccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtattgtgctcgaacaacttatgctcacaacaacacactttcggcgcttcacggtagtgccatatccagtagcgcgcacagtccacaacagcacacatgaaaatggaagcctattaattggtaatacgtaatctacaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccagtcttggagattttaatcttgtatagttttcaatataaaaagatttgataactattgatatttatataaaaaaaatatagagcacagtgcaaaatcgccctagcggagggcggcaagggggccgcctgcaaaattccatgccccctcgccgcccatttgcaggcggccccccgcacagtgcaaaatcgccctagcggagggcggcaagggggccgcctgcaaaattccctgccccccctcgccgcccatttgcaggcggccccccgcacagtagaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcgcgcgacgcgaggtgctctccttcttgctcctgccggtctgcctgagtgagattctttggggagctttctgtggatccaccactttctcaggtgtgctgatttttcatccatgttcagttcgttgtcatttttaattttaccaaatctggataaggcaatatactaaacacatttcaatcattactatcttactaaattttagcagttatgtggtatacgttttcttttatttttcctgattatgacattccagagttataatcttgtaatttttctcctgttttatcaatagaacttcgcatcgtcttgtgcgagtcgtcaaaaaaaattagagttatataagcttatttgtttaaaactttatcagaatttggtgaaaacatcaaagcaaacaaagacaacactatcgaaatttggtaatgccaaaataccaaaatgtgttagggttgatttgggcaacaaactgaacaagccattcgtatcttttgtggggaaacttcacgaaattttattcgatgctttaggatttaagcaagtcgatcaaactttatagattttggtcaataaccagccaaagtacaaatacacatctaagggtataaaagttgtaccagtagattcgtagattcatatttcacggtcctttcacaaagtttatggttttccatatgtacttcttccgtttcatattaccattttaacttttttcctagccatcttatagaggaaaatagcaacatatgtaacaccaaattagtttcattaaatctaacactaaatatattttgataatatgtttattttatgctaaaaactctactatttttttttataaacttggtcaaacttaaacaagtttgattaaaaaaaagtaaaatgacttataatacgaaacgaaacggatgaagtatcctacaaataaattttatgagtagactttcaaaaaataaaaaatatgcaccgtaaaattccaaagaggcgctcctttttagcaaattcaaaaaaaaattccagaagagttcgtttctttttttttcatggatatatgtttttattgcagaaaatgatatgctctattttaaatgaccttttgagatatgccactcaattttgtagaagtaaagaaaatagcatatcaatttcttgttgctctaatatgccatcctatcattttcaatattatcctttcctgttctctgaaagaaaaaacgaaaaagaaaaaggccaactctaccctttgtcccagttgaaatggaaaaagtacactgaaggttgctcaacttgtcatcgagttacaaatcgtcccccaaccataaaatcatatatataatatctctaaacttacaaaacccattcactttaggtccttgagtgattgtggccccagtttgtttgacgtggtggttgggtcagtgtgggtcccacatatcaggatgccacatcatcaccctctctctttctcatcctctctctcacttttctcctctctgcacggtgctgacaggtagggaggaggttgccggggcaaggtgagcgaggagatccggcagcctgcgacgcggcggtggcggttgcgattcgcgagcaggccgcgcgtgccgggtcggatacctccaatctcaccgagttcatattcgaggaagaagattatgctagatatcgactacaaagactagattatatcatcccaaatattatactcgtgtgatgataatatataaaggcaacattggcttcacccaacatgagtagggctattacctgtcaattaaggaaccgaacttgtatgattttttttctctcgtctcttttacctcaatctcacgtatatcttggcattgacgatcctcatactctacaaatatcgtagtcgcggtatagcccatcgacaatagtatgatgtatggcatgttctagactgtgccaccgtttggagctacagcgccatccaacttaattatggtcgcagtcaggatggagctacgtgtaaaaggaggtgcttaagaacttgatcaagaaaatattttaagcaatagtttatcaatttttatcatagatgcacccactaaatataaactcagatacctgatttaaaacagagtaaaccaagtggatgacaccactctccaattcaatctagcttcgtctaggatcctagtgtacttagccaaaaattattgatttaattcttttattaacgaaaaacattattgtacgtttttttgtttttcactgtaactttattcaacggaatactattactgtacggagtattatccatgacgagtataggtacagacgcaacaaaatcaccattcgagaagcttctcctctcctctactgctcctccatttctcgaacctcgctcgtcagtctctcgatttctcgaaccttcttatctgacgttgacgcccctcagaaaaatccactcccattttaaatccccaccaccatatatccctcgaattcatcgtcttcctcagctcaccaaaatccccagtcccgcgcaaccttcagctctcggtctgcgttagctcctgaagaatcgaagcaatggcggacctcttcttcggtggccccttccggcgaatcctctacgggcggcccttcccgccggattgggcgtcggcgtcggcgacggcggcgatggactgggtcgagacgccgacctcccacgtgctcaggatcaacgtcccgggactgggcaaggacgacgtcaaggtgcaggtggaggacggcaacgtgctcaccgtgaggggcgcggcgccgcacgcggcggcggagaaggagagggagagggagaaggatgtggtgtggcacgtggcggagcgcgggcggccggagttcgcgagggaggtggcgctgccggcggaggtgagggtggagcagatcagggccagcgtcgacaacggcgtgctcaccgtcgtcgtgcccaaggagcccgcgccggcccggcccaggaccaggcccatcgccgtctccagcaagctctgatcctgatcaagcccgaccctttgtgcattgtgcgcaagtgtttctgtgtttgtgaactgtagtcgattatagcaaccatcagtcgaatgttgtgaagggcgaatgtgtattggaagtccaaatcttaatgttgaaaattttgaaaaattttagaggtttgaattactagtatatctatgtaataatctaattaataaaggtgggtcttctgcaagcttactagcgcacttggcatggttaaagtttcacatcttaactcttgaaaagacaaatccaaaacagaacaagaatgcaccacattatccaataaataatagccattagatcaactagcaaacaaaacaggtagaataaatcttagccatttgataaaagaggatgttcaagaactttccggtgtatcctttatggcttcatatatgtgctgttgggatacgcgtaggctacaatagcataaatcaaaattttctatcgcgtaaaccaggaaccatgcaagtattagatcataaatcgttaccactcgacgcgctgcgcagcggaagaaggcgctaagaagtcgaaggaattctcgcgaagtagcgcgcgtcgatgtagaggaagtagtcgatcgcaccgactcgaccttctcctcctcgtgcgttctcctcaaccgtattcccacgccgatcaacaccgcaaaccagcggcgcctctaccggtatccacacgtacagggacggaacaccacgcgcagatgtgctagcacccgcgcgcggctagggttttgctcggggaggggagtgacggctagggtttctcacgtgaagcaatacctccgccggtcacacccctcacgaatatataggatccatcactcgggcctccaaggcccgtaggactcctattcagatccctatccgaattaagcttattttggatctccatccaatccccttattccggcccattaagcgtgcgaccctgtaggttcatgtacactcagctgtaacctgaaaactccttttcgatccacgcatcaacagcggcccctagcagaacgcattgacccaccgggcatacataaagatcatatcggctgaacctctagtgtatatttgtataaacccctttgcctcacgatatcaattaagctcaaggctagatatgtgccatcctctaatagctcaatcattcattcgaatatgttgatagattatataacttgtgattgactcctcaatcacctttggcatggctatgcacttccataatctacaacattgaggggcccaaagatatctctccataggaggggcaaatcccatcttaattattcatatctcactacatgtttcatagcatacccgaaaactacttttataactacccaattacggagtagcgtttagcagtccctaagtaagctactacacatgttggaaaccatgataatctcaggtctaaggattcaacaccaacactaaatgagatcactgatgacacaacacatatggctcttacagtatctcatgttgggtctatccaacaacatgttcactaacatgtgtccacattattaatttggtatctctataccatgatccatgagacatgatcgtcaattaatacatatgctgatcatctaaacatatttgttccacatatgatatttgatcagtgatcctttagaaatagcaacacacaacataaagagtctcatgaaagaatcacatattcattaaccaataattagttatctatttcaaggaacaaagtcggataaatatgtaaacatagtatgtgatacaatcatctctatgattgcctctagggcatatcactagcaggagagatatagagtaagaagacacacataagaaataaaaaaaacaggcgccgtcagatatcctctttagacaatttgaaccgatggatcattgaattggagaaatctctttaagatcctttaggaaactttattttacgagaaggtccttccacgtccctgctgtaaaagaaatccctcgattcccctcgactcctcttgtaaatttgaatttatctatagcatcgggaatcgtttccataacccgcgggtaggggtggcaattttccccatggggccggggacccgcccctatggggacgggggcgggtgctaatttcaacccgcggggagtcggggccggggtcccagccatgggcgggggcgggggaggacagccacccacgaggccccggggtatgtgtattagactattcacagtaacatattataccaaaacgcccagctagcccaccttatataaggcaaaaccctaaattccccatcaattctaccctatgttcaattcctcacctacctaggaactcagccaccactagggatgaaaacggtcggaaacggtcggaaaaaccctctaccatttccatttttattttattttctcgaaaatggaattggaacgttatactcgaaaacggtaacgatatcggtaaagtcggtatatcggaaacggaaccgtcggaacgggaatctatcgatatcggtcggaagtcgaaaattcatgtcggaagcagagaactgtggtatcaatccacatttaactatgtatgaagatgaccttataatttcacccttgcatcatcacgctgccacacaacaccgttatatgatgattaataagttgacaataagatcgacaaacaatataaataaagttcaacaatacttcaacatcaatgtggctaaagcatacaatgtagcttacatgataggattacatcataactaatattgtccgacttttttttaggatatagatttgaagtcttcgagaacaccaagctcacaagctggcatggcttcagctgatcagctccttgtcaaacatcatttatcatttcatcatcaattgacatagctacatcgtcatcctacagactacaatggcacattgcataagaacttttatgttgacactgtataactaccattgtaattaagtttcatcctaaactagactttttggtagtttccaggtcaaggggggtcaccgagtggagtcaaattggtggggctcgccggtgggtcccactgtctttccttttccctctttttttcttttcttttctctctcttatccttcccttctctcggttccttctcctgctctctctcgatttcttctctattttctctctcgttctcttctctgccttcggctccttcacgcgcgcccgagaggagagaggtgccggagatggcggcctggcgcagggcggtggtgggggaaggagagaggagaaaggtgcggcgccaatggggaagaggaggcctcggtgcggcagcgctcggcacggcgtcgctcggcgcttggcgtggtggcgcttcgctcggcggcacggaggccggcggtggaggatgggggagggaaaggggctggctgcgatggaggctgtcggggcgaaggaggctgcggccggcgtcggcgacatcgattgctctagtctcttaatgcctaatgggctgctcctgctcctgctagccaggcccagccggcttccttcttcagaattttgtcggaaattaccgataaaaaacggttaccgaccaaacggtcggaaaaaaccccatatcatttctactaccatttccgaaagagattaccgtttccatttccgataccgacaattaccgataccgactgaaacggtaggtgcaaaccggaaacggaagccggaattctcggaaatttccgtaccgttttcacccctagccaccactccactagcggtcggtgcgtgttcctccggtcatgcagcgagcaggcacgtgtggcagcgtcggcgaccggccatgtgcaggcggctgaatcaatggccggggacgacgcatccgcatcggcggccgtccatgcgcagtcggttgcatcgacggccggggacggcgcatctgcgagggcggccaagggcagggcattcgtgtcggcggtgaggtccaacgtggcggcggtagcagcgcctaatcctccgcctaatctcgccggccaccttgccgctgtccgccgtcaggtctgcccagccgggtaccacctcgccgtcatcaagctgtcccacctcgtcggagctcgctgttcctcgctcgtcagtggacctagccgggtggtgcggggtcccgcccacccgccggggcccctgcgggggcgaggacgggggatgttttccacccgaccacctctgcggggccggggccgggcgaagaagtcggggagcgggggcgggggcgttctagcccaacccgtccccgacccgccctgttgccaaccctacccgcgggactgcgatttagggactcatgttttcgcttatgcttatacttatcagccaaaatttgaattttttactttaaatttggagttgattttgaggttttttcgtcgaagtttatttattagcatttgattttagatcgctaagaacacgtatataaaatttgtattcacaaattatttttgtttgtaaatatgccatttctctcgaattttcaagtatgtaccattcagacgagtcaaaggcacctcccgcacaacgaagcaaattggctagccactctgatttgtatagaaaagaaaactaaggttgtgtttagatccagcggtgaaaagttttggcgtgtcacatcggatatacgaacacacatttgaaatattaaacgtagactaataacaaaacaaattacagattccgtctgtaaactgcaagacgaatttattaagcctaattaatccgtcattagcaaatgtttactgtagcaccacattgtcaaatcatggagcaattaggtttaaaagatacgtctcgcaatttacacgcaaactgtgtaatttttcgtttatatttaatattccatgtatgtattatgtaaggatgcggcttccctgttcatattgtgaaattaatccattgttcactactatatatgcataagctctatttatgctattattcaccgctaacaaagtagtattatgtattattcataagctctttttaatgtctaattttatggatgtcatgtatgggctacttcctccgtttcacaatgtaagtcattttagcatttcttatattcatattgatattaatgaatctagacatatatatctatatagaatcattaacattaatatgaatgtggaaaatgctataatgacttatattgtgaaacggagggagtaacttataggcgtgtcaaagggcgcgctattttctactcctgattatattcataagtagtactctctttatcccagtttaatcagcctatgaacaaataacaccaagaccaaggacaacaaaatatttatcattctcaaattaattatcatcgattgaggtgcttcatcgctttgtgtgtcgtgaattactcatgttttaaatattacatgccattgcaccaatcgagattaatctggttggttacatgaatacattcaatgatgcacattactctttgcacaaataaacaaagagacacatgttagacgatgatcattttgaaaatacctcaaaatccttatgggtgatcaaaatgagatggaagcactgaataaacacaacctgattgtctgaataatggctgaatcctgcaccgattatattcatgtgttggtcagttgatttaatcaaaagttcagttagggagtcagtttaatttgccaagtaagatttgcccccatgtaactcgcggaaaagtagccgagagcaaaaatgaacgatgcctgatcggctgatcgtctttgttgctgctttggtgctatatgatagggtaatatctgtatagtttaccggatactcaatagccgttggatgccctttttccaaatccgatctcatatttgctataaaaaactatttggattcgactacgataaccatataagtacccaagtattcagatttttatcctaaattaattaatacaatcgggtgaacggcgagaaaatagttgtatttgcgagatacattctattcacaagcaacttcactgacctatctatgtttgcacatagctgtaaatctcatttaaacgtgagtcctgtgccactaaacttgtcagcgacgatgtcatccacacggcgcgccatctccggcgtcatgtggttcacccagtcaccgaccacgcccttccggaaaagggtctcacgtggaatctttcgctgcgcatcaacgtaacccgttctgttcgcctcgaatcccctcatacggtcgaggctgcagagctccacgatggcttcaaccgtgccggcttcctcctccgcctcggagaacggcagcccgacgaaccgcgccatcttccggacgttcccggcagggtcacgcagcaactcctcgtaccgcaggaagagcacgttgtccggcacctcggtgctcgcgtgccagtagccgaggatgtgatcccagaacggcccgtatatcttggcaccaccgtcgtcgtcgcggtaggactcgagggtttcggcgaatgacacgtcgggcatcagctgccgggtgtagtgccacatggacacgatcatgtccttgggttcccgacagatgtagataattttgtagcctcctctgttgccagaggagttagctgtggtagtggctggcgtggcgctcggtagtatagcgagtggcatatgcgtgttgatgaggcgcggagaggggagtgcgtcgagtttggcctcttcaccacaggggcgaagaggccctcgaggaaagggaggcactggtgcgggttgaggcggtggagcgggtggctggaggcggaggcgggggcggaggtgggagggtggtgcacgtggcgtgccatggtggcgaacgtgagggcgatgagccacgtggtgccgcacttggggaggctggccacgatgacgtcgtcggggcggggaacgaagcgccgccgcagggccacggccgccgggacgtggatctccgccagccagaagccccggtagaggcgtagcttgagcggcaggttgacctccatcttgctcgggagagacgagaccatgtcggcgaggtggtcgtcgccgtcgtcaatcccttccggcgccggccgctcggaggccggcagctcgccgtcgacgtcctcgaacgggacgggaccaaccggggaaaaagatattcctgcggtcgccatggcagaattggcagatgaaaatggatcagctggtggcgcgcacatatatatatactccgtgtgtcaatatgtgcagtggcgtgcaagcagctgcgtgtgtatctgccattcagcgtcatgagaaagatgagcgtgcacacgcgttacttgtgatgatgtgacggcgtccccgcgtccttcgctgcttcgattgagtgatgaactgatgatagagcgatgaagcgatccatatcctcaacagtatacgctgaggatcgagtacatgctgattaggataaacggctgtcaagatttatagtagaataagtcacatagtatatactatgttgtatttgtattgggacggagggagtagcaaactggagagatgcatgggctaggaaagttgttcggaatatcatcgttcagctattgttaagtacaacgatcacatcatatccaaaattaacaatcatatcaacaatacaacagtacagcgctggtcttccaggttaactatgaatttcacataacacacatgtacacacactaaaaaaaaatgattcaacacctttgcaacaattttttatgggacattttttaaagaaaaaactctttaggaaccgcatattcaacatctttctctatgaaaaatgaaactattcaacatctttttatggaatgttattttgtaaagtttatttggagagcagtttattattttttttgtctttaccttcctaatagcatatctcatgtttttttagattggcttatgggtagacgagaaaaataagaaacttattcttataagagcttcttctatacgttgggctctatggttgagtaggaatgacatgattttttgacaaaccaccatctatttcatatatgtaggtaattttcaggacaactcattagctcaggtcttgggcacaactataaaagtgtgatgaagagggcgagtgcttaaaagttacatgccgtaatcttaagacaacggttatgcaactgtttaccaattttggatggatattcataaacagaattcaataattgtgtaagggtgtgtttagttcacgccaaaattggaagtttgattaattagaacgatgtaatagaaaagttggaagtttgtgtgtgtagaaaagtttggatgtgatggaaaagttgaaaattcaaagaaaaagttgggaactaaaccaggcctaatccttaccttgggttggtagtctttagtttgctttttttaacggttggtatcttctttttttttttgtgaacctttttattttttttgtgatacgttgtaataattggctctagctcgttgagtaaaggccgggatattatttccattatttaaaaaaaaagaacagcatattcatggtcggaagttttacaagtctacactaaacaaattccacaaagctagctccaactccaatataagcaaatagggcccaattgatcaatcacaaacaaaacacggcatttgcttctcatcatgcaattgccagcccgcgttaagaattctttttacctgtataatttatgagtgttgcaagcaaattaaatcaatagtagtgaattcagtaattaattgacactcgccctcattttagtggccgggaaataggccgggatcccggccttttatttgggttccaaacgaggccacgaggccttcaaatgtcaccaggccacaatctgttcacgacctatccttttcgccgggctggagaataccgaaggccgagtttagttccaaactttttcttcaaacttctaactttttcatcacattaaaattttgggataattgcaaacatgccactactttcaactcctaactcgaaatagccattataaaaacgcaaactgcaaatttgccatcaaagttggttttctaagcttccgtttgtcactgttgtcccaactgatgcaattaaaaggataaaaataattcatagaaatacattgcaacttgaaagactgttttgcccttagctaagtttataccctcccagccctaggacccgacttgaccgcaagctagaatgatcccctccttctacctctatgaatcatagatctcaaatcctctcatccatggcaaggaaagagctaatggattttgatggcggcgggcggcgacgggcaggcagtgggtgttttggcggtcagaactgcaggctacctcggcttgagcggcggccgcagtagcagcaaatgaaggcggcggcagcaaagctgcatcttgggcagcagcaacattatcaggggatgcagcagcagcaagcaaatgttggccacaacagcagcagccgacaactgcatctaagcatcttagctcttaggcaacaacaacaacattagcaggcagtattttcgtgggtagtaggccagtaacagcccacggttgcatctcctaaggcttttatcctccttttttttttcttatacgataagtatgccaaaataatgtttatcttgcaatttggtggataggggtatccttgtcctaaatttgataaaaaccaaccttctaacggtgatagttcaggctgtcggtctaatggcaggcaggttgggttccagctgtttctggtggtaaatatgcaattatactttttgtagtggtagattcacagtactggttgaaaccagtggtaaatatacaattggccctaaaattttcctacacacacaaacttgcaacttttccgacacaccgttccaatttcaaccaaacttctaattttgacgtgaactaaacacacccgaattcatgcacgactgactatacgaggattcagcaaggctgccgataaaattggcctgaaaaggccgaatttacatacgggactatacggggattcagcaagtttgctgataaaatggaaagagctaatacggcgcagtggcaggagattacggaattggatttctgaaattttgagtttgtcagtttctgaaatcattggattgagaatctgaaatttttcaatcggtctatcagattcttaatccaacaaacaattatctcgttacatggacagtgacaacaataagactataatttgttttttaaaaggtgtagcggaatcccatgaaatttcttgtttggattttaaattgaactgaaatccttgtcggaatctgaagttcagtaatactatgcccaaggcaactagagtctagaactaggcaagaaatagcaagattcatgtcataagacagtaatcaaacatgttctgcaacatcaaatactaactactatcacaaacctaaatgaatcttatgacatgaatataacggaaactcagattcatacaaacctgtccatgtcttatgctagccaaaaaagaatcgagacacaagaaaaatttaacaataaacacaatggcttagcacgagcaaactgcttcattcccaagacttaagaaaactagcattcttgtttaaaaagaaaaagaaagagaacgtcaaagaacgaaaactaccatgctctgttcttcatgtcaagcatagaaatcatggagattagaacaaagataacaatccaatttgtctgttagaagctcaaaacaaagtgaaaacaagagaatggattaatcggtgatttgggacttgtcacggttaattgaagtgagtcaatgacaccgccacaatcaagatagaacaacatgccaaaaacagagatgcgccattctcagtgcagattaagcattcagtctttcaaagctctaacgattctagatcacgaacatttcaaaccagtgaacaatagatttcggattcaatccggcatgatcagattaggaaacacatcgatcgatcagagtttttggacagggcgagctcaaaccttacgtcatcaggggcggcgcgttgtcgtcggagaagagctcggtagaagatcgacgcggcggaactcagcgcgaaggaggcaggtgaacgtggcgtcgggcgcagcgttcgaccgcgtggcggcggcgtggaggcggagcgatggggaggcgagcggggtggcgacccgcggcggcgcgtccgcgggcggcagcagggccgtcgtggtcggcgaaggtgacgagcgcgtgcttgtcccagaggcccctccagcgccgggagatgaggctggtccgggcggcggctgcggcggtggagaggcggaggaggatgaggaggaggacgtcgtcggggagcgagctgaggcggtcctcccctccaccgccgatcaccgcgtcgtcgtcgtcgccaccggaggtggaggagagcttcacgcgcttggtgggggagacctcgccgtcgctgacctgcgcgcgcgcggtcccggagacgagcacgtcgccgtcgacgtcgacgtggtccatggccgagggcggaggcgagcgcggtggcgtcgccgcgtctccgagagagaagaatggagacacggcagacgagcgagatcggaggccgttatataaaaaggggaccaccaattctgacatacaccgtgcgatctagttctaacggtgtagattcgagaaggaaaataagagaaaaagattcgcgatccagctcagctgtgatcgagattggatttttacagagagcaccctgtgatgtgtgatcatttgcaaaccagtaaatttcacaaaactgctgataatttaaccaaattatcataaaactataaatttaaggtgatatattgatataacgataaatttatcatgaaactactgctttaagattgagcatcgcaaaactaaagatttaataataaaattattataaaactatagattttgaggtttaaatctttagcacaaatattatgattgagttataaacatccaagtatgtaagtaaattgacgctaaacttatagttttatgataagtttgatactaaaatataattcaccttaaattcgtagttttatgataaatttggtattagagttgtattttgtgatatattatctttaatttgtagggcatgttcagattgtagcaaacaataaacattatcaaattttagcaatgccaaaattttgacaatttgataatattgccaagtttttgcatgatttcttatatatttactaaagtttagaaaaaaaactaaatggattcacatatttaataattttatttaaaaatgatatggtttgaaatggcatcgatatgaacaacccagtagttttacaataattcaatatataataagttttgtgcaatttactcttgcaaattgcatcttgggaaacggctttcgggtcctcgccgccggctgccgctgccgtcggcggcggccgccaccaccggtccgtgtacttgcgcatgcggtgcgcatacttcgccatgaccacgccgccgctaccttcctccaaagcgcccgcgaaccccacccgcctgccaccatcgcgttccatatgcctacgccacgcacctcgccaaccttagcgcgcctctcccgcatgctcctcgacggttgccacgatcgcccccaagatggcctactcggtctcggacgactccctgcatcgaccctgcgcggctgcgcttatgggcatgggggagccacagctgcgctcatgctgttcgacgaaatgccagaccgcgcctccgccgtgcgtcacgttagaggcgatgcctatttgctcggaaaagatgggaccgaccaagtccgaccactggaagacgaactcagtttgttcgatggagtggcctggaggagtccatctgctggcatggaatgccatcatgaggatgcagtcgcatgcttaggagtccatctgcagatctgcctgtatggaactcagtttgctcgatgcagtcacagccatcatgagaatgcattgcgttcaagcacaatggggtggccgtcgtgttgactgcaagtgtgcctggctgcctaccaccttggaggatgcaatcgcaggcttaggtcctctgcctgacctacatcaccttccctgggttgttcaatgcgtacatctgccattctgtgttatttggtgagtgcaccaaattgttcctgtgttgagctactagtcccttcattactgcacatgccgacgtgctggctacaatgctgtgctatgactaattttagttgtttctgaaccttctgcttttttttgtcatctttttcagtctcctgcatttttctcaagaagattattcggagtattggggccactatgccatgttaccgataattgttttgttcatttttgtcagttacggattagtgagcatcacagctgatttgcaaatttgtggcatcaacatctgaaaagattcttgtaggtaccaaacttcttagtttgaatcattttcttcacagagcttactcctttatttagcatcaaatcctacgtttgagtctcttcttgtagtcagttctcagtgcctctttggttctgaacttgcagtgctttgcattgttgtgagtttgtgaacctggtggttttgttttcagattcttcttctctttgctatagctccttgtatctaagccagattcacgaaatgttgggacagcttctgaattttcattgtgacctttgttctaggtagttcaaaactcaccacggtgtaacacatgcccttctcacaatggtctgtaagaatggtagttacctttgcaacgtgatatcaacaaccactggtcaccctgtgttctacttagcaagtccatgtggaagactggtaagtaaatgataaccaaaacattcactaattcctcaattccatagtatagttcttctccagcctgaacttacctcgtcctcagaagtagttgccgaacgtcttctcctccagttctccatgctgcattcttctgttagactgttatcttctcctccagttttgtgtgccgcacgctgctagcttttaccatctatgccgctgtaaattgcattcctgatattgccaggtagagtgccttggtactagtttactgcaattttgtttgagctatcaatacatcagaaggtaaactgtagcagcagctctccacctttttatttattttctctagaaaactggttctaagtggtttgaaatttatgtttcaggtgctaatgaagcttttgttggttgacttatccttttcttcccagttggcatcatactttgtcataatatgtgcgatatagcttcatgattgcttttcaatttgctcattccttgattagatcttttcactgcactttttaaataatactgattctgtctccattggttgaactgtaggtgttatagtagctgtgttttattgcttcctgaagcaactggcagaattttctgatacagaccatcaaacagttcgggatcaagatgcaaggaacaatgaaacagaaccaattctaccaagaaaaagggtggttttcagctatggagcgacggaagagcagcctgagtcgagcatgtgctcttcagaagatatgtgcagtgagaatgtctgcaagatctgctatgatgctccacggagttgcttcttcataccctgtggccatggttttgcatgttttacatgtgcaaggaggtataattctcatctaaatccttcagttacaggagtcagtttactgctgtatggctttgatttgattgctttttctttttacgaatctgattaacttgtagaatgagaaacactcaagggtcttccggctagctccacaaggtggtgggctagacgacatgggtttgaagcctcaccccttctaattatttgatattaggtcatttcctgatatttgcgtcttattaacatgtagaataaaagggacctgatccctgtaaagtcacaactcacaaattgataaattgtcaagttttggattccgattataagcctcggtctgaactgttatgatttatctctctgtaaagctaggagccaaagatttgttgtcccataattatttgatgaagctcactgaataacaccacattgcctactgttactgcaggatcgcggaagacaaaaatcaggcatgcccaatttgccgaaggctgatccacagagtaaggaggctggtggagcccttaggttcgtcttgtggtgagtagatgatcttgagtcagcagagagaagagttgcaatgctgcactgatgaattgttgccttgccgcccatatgctgcctgtctaggcctgaaggatgctttggactaagcatggaatgtcgatcacctacctgacggattgaccggatgaggaagctagtattgaagatggactcaattaatttacgccggctattgaatctttttgtttcctttttcttgtgtatgtttaggtaaagactttcagtagttcgtactgctttctttctctgatccactgtacgtttcacacacttggagactgatgcatgataatagtagttcgtatcgcattcatgccgtgcactctagccatacgtttggctggaccaaagctcgtggttgcaggcttgcggccagaattattattcttccaaggtctcactctccgtggcggccaagtttccctcccatgtgttgaccatcatgggaaccaac

SEQ ID NO: 69398 - DNA, 950 bp, Oryza sativa
aagattaatttagtagcgtctcaggtaatatttacatgttcagaccaaaagatccaaatccaatcatacagcgcattttcctacaaatggcgttcgctagatagttcactcctatgttatcgacaaattttgaagaagtgtcatcaaaatccatcgaattccatcaaaaacctgttactgatggcattattcagaagatttttcctcctgttctttttgcgtttcaatactctgctcgaaaaaaatttgtcctcctattttttgcatttcaactgatatccccatcatcctgatgtgataatcagagcaatgtacaaaattctctcaaacattaatgaggttcagaaaatttctccttttgcatttcaaaatcagtaaacagcaatgattcattcactatgcatcctgggaagaaaagaaaagaggaggcagcggccatgggaccagtgtccacggagcaaactctggacgctgcattcgggcgtcacgccggtgttggctatgctgctgctacccgttcgctggagggacgagacgagctgcctcgacgacccaccgagccggagcccaaggaggaggctcccctgcgcgttcgcgggttcggcagtgacgatgaccgcggaggacggcgtgcgttggccgagtggctaagtcgatggtggcggcgggacgctggtccgctcgaacatcggctggtcatgtaggcgtatggcctcctatgcacatatagcaaaggaggaaaatgagcagctaaccattcatagtacgcaagaaaaaatggttgccagatttgctaggtccgcgtaacgtagaatacctgtcaggcaaatgggagcaacactgctattagagcatcaaattcaccggctcgacggcgatcgccacggccgcgacagtcacccggcgagcccggaggagcatgaggccgtggcggctgccctgaccgcgag

SEQ ID NO: 69399 - DNA, 9377 bp, Oryza sativa
attaatgagatacaggcgtgccagtcagtttaatcctgcaactgataagatttgtaaataatagatcaaacagccgatcggctgacaagccgatggagtagttccagccgatagtcgataatagccgatgccaataccagccgatagcgatagggtttaagcaatcggctatatgtccaatgtagataatgatataaaggcaatcggctgatgatgatgtaataaaataacaatataatccaatataaactaatcggctagcaatgatatgataaataagcatcgatacgaaggttaaagcacacatcggctagaggtccgatgtcatgaaatccacaagattagattaaacaatgaaacctttgttgtcatcggctaaatccaacttatatgtatatgcaatcctcatgagccgatgcaacgtccagataactcaccggctgaaaccccgataaaacccttattggcaatcaataagcaggctagagattatggttctaagcacgacttagtagatcaaaattaactgatgcagcactaagtataaaaagaaacataatatctagacaatcaagccgatgactgattttcagggtggtagatgcctaggctaatctaatctagcaacgcgatttagccgataccggcagaaaccctaaaacgagaagcagccgatagagctaaattgatatgctaagactagattaacagagacatatgataaataggtaggcaagtatatcatctaaaccagagcaatccaagaggtcgaatgtactgatgcagccttgaacgacgccgatgtagacgatacaattgcctgggccgacggaacattggacttatcccttcgccggagatcgaagacgatgcagccccgcgtcgggtgccaagtcctgccggaacgtaaaaacaaaagtagaaataaaaatggtggcgatgcgccgaattgtattgatcgtagagatcgattacatagaccccgggtgtacatatttatacccatgggttgatacaagtccttgtcggacaagaaagaaactacctaaagataaaaggaaaatatagagtccttatcggacactaaacaaacttttctaaagataaaagaaaactaacaaactattcctaattaatagataaactgccatgccgcatcctctttaaactcggtcacttaggaataagcttcctttagtagattgatttccttaaccgaatatagcaggaatccgactattggtgacttgataactcacatcggctgattccgagatgctgcagccgataatgattctaagccgatgacatctttgccgattaccaaatttcactgttaacacgaggccagcgagcatggcgcagacggcgatgcagccagggaggcgtgacggctggtcggatcggtgtcggtacgccggcgaccaacgttcgtcggcgtcttcttcccccttttcttttttccatttcttctcttctttgtttcttgttgctccggcaattcgctcgtcatggcgcaaccgtgcggcggcggcgcgtccaggccgagcggctagcgtcatgggcagccggtgctgcagtgcatcggcgtgtggagcggatgcatgaccggtttccatggcgccgatgctgccgcttttcctttctttcattttgcttttcttctttgtttcttgtcctctccggccgggcgttgtggcggagcgacggcgccgccaagatgcggacgcgaggtcgccgctgggcgtacaggcgcggggttcgctgccggtatgcaggtgcaggctcgctgctaggacggccacggcacgaccactccccgccgccgatgcccagctcctctccgtcagtctactccccgttcgtcgctagcgagcaccgctgctgcccatcgccggccgcgcccctaccccaccaaagtgaagagaaaggccgggggagagagagataagcgagagagagctacacactgacatgtgggtcccaccacgctgagtcagcctgtcaacgggtcaacaacgccacgtcagacgaagtcgccagcaaaaccaccaagggaggtgatttgctctggttttcagaaatgaaggaggcgttatacccggtttttcggttgagggatgttattcacgcaaacgcaagagatgagggaggcaaaatggacttattcctataagttttgggctttttcacagtcccactccgtgtctgagctctgaacttgtgggcttacactatctcttgctccttccagcccatctttttgagtttacccttcgattaacctactgaagttgcaggagtaatctgtacgacatttttaaccataccattatttaacaaattaataattatgtggttatatttagtttgttatcaaatattggcaatgtgtatagaattttggcaacattattaagccaatcctaccaaaattttagcaatgttgttaatttgtcaaatttttgatattgacaaattttagtaaggttaattttgacattaatcagaacagaccctaagactaaagagtctgtgatcgactgaagttgtgacttgtcgtgcttgttggcaggctggtggccttctctgcatccacgggaaagcctgccgcgaagaagagcctaaggatgaaagggaaaaggtgtaatgtctgcaactactgctactagctgaaacctgaatgttaaaattttgtgtacaaaatcatatacgagtaaacatctgaaaactgagggctgatttggtttgaagccaaaacttgccataccaaaatattggtattttgaacagtaattttggtaatgtttgttttgctaccaatacttaccaataccacacaaatgttgctaaaatattggcattggcaaaatcttgcccatgatttggcattgccaatagtttggcatggttgcaaaccaaacaatccctgaaatcgtcgtggtgtcgttacttcgtcagtggaccgcatgagattcggcgcgtgaagcgcaacttcctacgagagacgctggagaacgagctgccggagggcaccatcaggttctcttccaagatcgtctcgactggggaagatagcaacgtcaagctcctacatttggccgatggttcaacgataggtgtgtgagatcaacaatggctagcagatcacttgtacctctcttcttctcactaagagcagccatggcctgatgcattgatgtgcttttgttgaaggtgctgatcggatgcgacggcgtgaactcggtggtggcgaagtggcttggcctgccaaagccaatcctctcagggcgctcggccaccaggggcctcgccgagtacccggtacccctcccctgatggtgcgcaccgttgctagttacttctccttgacgagcagcaacaatggcggattaattcgctgatcaatctgtcacgtgtggtgtgcacagacggcgacgcggaggagagcgtggccaagatgcggagctacgtgctggcgaaggcggcgaggatcccggcgccgctgaggttccggtcgccgctcgcgctcgtccgcggcagcatcagcaggggcaacgtctgcgtcgccggcgacgccttccacccgacgacccccgagctcggccagggcggctgcgcggcgctcgaggacggcgtcgtcctcgcccggtgcctcagcgaggccttcctcgccgacggcgccgagcacgacccggggtacgaggccgtcacggtggcgctggagaagtacgccgaggagaggcggtggcgcggcatccggctgatcacggcggcctacgtcgtcggcttcatccagcagagcaccaacccggtgatcaagttcctcagggagaagttcttgtcaggattgctggcaaaaactatgatcgccatggctgattacgattgcggaaagctatgattctgttcacgagaaatcaagaacccaagaagagaagaaagaaattggcggtgagcgggaacagtcttaattagcacatggaacaatcttgtgatgttgttaaccaagcacgagggggcgagcttaaagtccaccgtacaatgtactagtaccacgtacacactcaccatggcagatgctcaaggcaaagtcttatgtacggttttctatgcctctgtatcaaagttgagttcagcatttgacttgtgggtatgtgtccgagacaagttttgttctagaaatttcgtggacaaaataagttcttggagtacaaggtaaacccaaccttggcataatttagacacaataacaaaattgattaaaaaaaaggtttatttagagtgcaaatagcacaaacagagttttttttaaccaaaacaagtagtcttgagatatttttttttcttttgattatatgattacatgaaaatacatttaccctcatttagcacattattaagacattgaggctagaaataattccacgaaactaactaaattaaccacattaggatttcaaacacagtgggtaaagtaatatgcccataaacttagcgtcaccgtttttcgctcacggtcaccagaatgtttagaatccgatactcaattcgcaagcctcataatatttgacacccaattcgtatatgtcttccagaaattaccaatttgtttggtgacattatctcccatttttctctttttccttcttttactctacgtttttttttcccttctcacatgattggagtagtggacagttttttgcactataacaggggtcaggccagttagcagttatcgagctaaaatcgtcattcccggtttcccaccgccaaaacccactggcgggtggcggctgcctgctggcccatcgttgagtgactcaaagaagccgatcaatctcagtggcgcagaggtagcaacagatcaagctgccataatcacatggcgtggttaatcgcccgaacatatgctgcaaatgggtaaaatattaacaaaccggtttgaccaagtggcttcatccgcatccaagaatcttatatggaacccatgatttaattaggagcaatttgcagtactgccaagtgtgaggaatccctgtctagtttgttatagtgcttatcatatagccgaccataagccagtgtacatgcatggttctgtggcatctttaatatgcgaaaaaaggttgtatactagctagataagcttgtagcccaaaaaatgaatcttgaagcatctgtagaaatcggaagcaaagtgtaacgtcccgccgccttcccccaggccgggcccgcttacatctgatagctttcataggtcacacatcttttctgcacactttgtcctcactcgtgtgcacccggaaagaatttcccggtcggtcccccatcccaaattgctccaggccaagcacgcttaaccctggaattctttggagattggcttccagaaaagaagttgcaacttgttgatatgagtattctattaatcctattaagccctagaccgggatgttacaccctcacccccttaagagagatcgacgcccccgtcgatcaaccctaggccaggaacgtcatctcttggccacgtccatgtgtgataccattttgtaacgtcccgccttcccccaggccgggcccgcttacaggccaagcacgcttaaccctggaattctttggagattggcttccagaaaagaagttgcaacttgttgatatgagtattaccctcacccccttaagagagatcgacgcccccgtcgatcaaccctaggccaggaacgtcatctcttggccacgtccatgtgtgataccattttgtaacgtcccgccttcccccaggccgggcccgcttacatctgatagctttcataggtcatagactgccctcacagaccaacacatatcttttctgcacactttgtcctcactcgtgtgcacccgggaagaatttcccggtcggtcacccatcccaaattgctccaggccaagcacgcttaaccctagagttctttggagattggcttccggaaaagaagttgcaacttgttgatatgagtattctattaatcctattaagctctagaccgggatgttacacaaagggctagcatcaaccctttaaacagaccaggttgccaatcatgtaagactgtgtattacgcacaccatagcctcagcaaaagaaaaggcttctcacggagtggattctaatctctcgagaggatatcctctcatgtatctttttctttcaaatttgatacaaatagttgtgaaaaattctaaaaaaatatttggcaatgtagagtatagtgatatctactaatccaaaaaaatcaaattcaaattcgatttacacattgagaaaccaaaagaaaaggcttctatcatcactgtcagtcaagtaacttaaccagaataaaacagagggaaatatgaatttgtcagctatttctgtcactgcagctctcaccattcaaatctagaggtttgaccatatgatctatcatggccaccaatagataaagtgaggtcttacaaactaattaaaaaatgcagtacatcactacatccacaaccagttgccctaatagtccaatggagggcctcggtgacagttgacttacaagcaagcaatagtttcttttcgtagatccccatcaaccaaacaaaaaacaacaaatctgagcactgggagagctccactacccccatcatctgaaacaaaaattaatcacctatttgcactgctaaattccctagcttccagacctagctaactgatacctaccagtggggaccacctgcaattccaagaatcaaactgtcatgggcgcaactagtggtggtgatttgtctgaggggagccgggggttggattaacgcgcgtcaaccgcctaaatccaagggggtgcaacatgattaccgacgcttctcgatccaatgaccctaggtaatcacgcgacctccccggccgtaatcccatgtgctccaggcagccgagtctcgtgacctcacgtgacgcttccgcctctagctctcgatcgatcgatcccaccactaattatccactcccaaatgattgtttagtggcccgtatcataagaccggccacgtcgtgcagctagtgtgacttgggagagacagtgtaccggccatttgccagatttgcttcctcagaaaaatagcagagtcggccgggtttgcagacttgcagagatcggaagaatctttctctttcgaaatgttgaggatttttggaaggaaaacaaaagggaaatggagatataggaatcgtggcatttaaggcggcacggtgcagcgtcgtctgtgggttgcaacatgcatcggcatgtgagtctgcctcgggaggcgcgcgctcgtcgatctcgtggccgccgcacttcctatttaagcaccgccgcgggtgacaccgtcccctcctcctcagtactcagatacattacccgcaccgcctaattaagcgctcgcatctgaagccatttcgagggacgtcatggcgcggagtgccttcttcttccactgcgtcgccgccgtcgcggcgtgcatcgccgcgacggccgcggcgctcagtggcacggccacgttctacggcgggagcgacgcctccggcacaatgggtatagtttagacatttgctaattaagcctgatcagttttacacacaccaatggactggtgctgacaatggcgtttgttgttgatcgacaggcggcgcgtgcgggtacggcaacctgtactcgacggggtacgggacgaacacggcggcgctgagctcggcgctgttcaacgacggcgcggcgtgcggcgagtgctaccagatcacgtgcgaccagtccaactcgaagtggtgcaaggcgggcacgtcggtgaccatcaccgcgaccaacctctgcccaccggactactccaagccgagcaacgacggcggctggtgcaacccgccgcgccagcacttcgacatggcgcaacccgcctgggaacagatcggcgtctaccgcggcggtatcgtccccgtcaatttccagaggtacgcacatactccggtcaccgtcgtttcgccggccggcggcgcacagaatcaagtagtgatcacgtacgtatacgtatgtgtgcagggtgtcgtgcacgaggaaaggaggggtgaggttcaccatcaacgggaacagctacttcgagctggtgctgatcaccaacgtgggcgggccggggtcgatcaagtcggtgcagatcaagggaacaaagacggggtgggtgaccatgtcccggaactggggcgccaactggcaagccaacaactacctcaacaaccaggccatctccttctcggtcacctccaccgccggcaagacgctcgtcttcgaggacgtcgcgccgtccaactggcagttcggccagacattcaccagcggcgtgcagttctactagctagcggctcgcgcgcgcgcgcggcggcgcatgagccgccgccgccgtcgcgcgcttgcccaacggcgagcggcgcatgccacctgccgccatttccgttcaatttttgcatttggaaaacttgtcaaaaagaccagcttatttagcatcattctgattggggaaaaaaatgtattcttagctaggggaacgccactgtggtttgcatggctgaggcgggttccaacggtgttcgtctggccgggcggcctgatcgatagcccgccatgcctaaccgcttttacgatgattgctgggaaggaaaactatttagacgactttgcttggacacgaggtaaggagtgcaggcactgatcgatccgtgtaatgctgaaatatggcgctcattggaaggcgcaaaccacatgcgagtttactgtttgacccgatgatgatctcaatgaaatgaattggccattggccctgtaaattgactgcagtatctttgtgctttcactgtgtattttgcgttgaaatttagctcatcctgcatgtggtgaaaccacgccgactcgtgtgcacgtcccgcgagtggaggtagagtacgggatgggggtgctaagaatcccgtcaaaaaaaattagttgtatctggatgttgattttcattcctcgaggggatattccctcattgtttgtatgtcatctaaatagttattaaatttttttaaaaaaaactgataacatagactaatatgaaatatatcacttcacaaacatgcaaaattaaattcaacttctacaagttgcaatgaaaataacaaattaaactgaaaatagttatcgcacattcacaactatagttgtctcaatacaaatttagacacccccaccaacttaagcttgatctaaagtagagtaaattaagcaagaagcaccctcctttattttgttcttattccgcccttgcgtgaggagcgttatggctatgaaagacctgct

SEQ ID NO: 69400 - DNA, 9338 bp, Oryza sativa
tatgctatgtcacccaatctgaatcccaattttattgggttgcagtgtttgccactaacacgtgggccgctttgattgggctggaacatgataacggattgatggtggtgagaaatcacccattcaagatggtttgtgttagagggcgcggtccagcctgaaggttatattatacttgctttaccataggtctaatcgtagttataacttttggtaatacacctatacaactaaaaaaaatagtctaatggatgaggatcaactctatctttaagtcgtgcccctggtaacaattactatgtaggacttaggggctgtttggttgctagtcaaaatttgcctcaatttaccacaagtatggcaaataggtttgaccaagttagtatagtgtttggttctagccacaagttagtcatgccaaactttcctttaacttgaccccacatttcatagatacaataatgtgtggtaaggaggctaagatgtggcttcaattttcttggccacaactttggcaacttagccacaaatgtttggctggcttaggtagtgttacacaaccaatcaaacagcccctaaacccaacagtttcattcttcaaatcaaacagcatgaacgttcctttgtcagactttcgatgagtttgaatcttatacaacaatgctgatttcatgtatgaaaaaagagcgacggcccgctcttcttcccccaactatatacatagccaacatggagaggtcatgcgtcatggccggtcgcagagtgcgccatagcagtgtgtgtcgatgtcatgcgccaacgaggtgtcattggagaggcagctcaacgaccggcagtccggcacagggcatctttggaagggtaagtgcaggcagccgtcaatgggtgcgttcaacggtgcccattgccaataagcacgcccgtgggagttctatgttactagactagtcgagcgcttctcttcataatattgagtgcagatcggctatcatcgtactgtcgtcgccaccaccacctattactagttactggccaccaacagagccaaccgtactaaaaattttgggagatcaaggatagagaaagagaagaaaaatgtacgaagatgaaggataatgttatcatttcgatgcctttttttttttactaaatatgcccatttaacgtggtgatgaaaatggcataaaaaataatgaaaattttatcaagtagcatataagggaatagctactttttgacatcacagaatgaaaccattcaagttccatgctatctcgtgaacaatgcctcttttaagttccaagctatctcgtgatctctaaactagcgagttgctttggtgcgagtttttctgtgtagatttgggctgaaagcctgcctgagtgtctggcccgtgagagaagcccaaggctggaaatctgcagcataaccatgggccataaatcacatgtagcccatatgacactgcatgttaacaatagcacatgttaacatgcaaaaacgcccgttcaaaaaaaaaaaaacatgcaaaaacgtggtacatatgtacacgcagcataggtagcactacttgctaaacttggatatggacggcacaaacccaacgtcccaacctgccacatttccctagtggcgacgggtctatttttttcgagacaacatgcacaaaatataaaatagtacgacgtttttattgatatagcataaaaaatataagttagaaaacagaaaaggacagtcacactaagcgtttacgtctgatcctgatgctgaaaaataaaaacaagcactcaacatccggaatgggtattctaaatgacgccaagactatcgctgtttgcctatcctaaaatccacgatgtagttttcacttttttctaatatattgacgtgcaatcttttttgcgcgttcgaaaagaaaaatgtgattttcatccgaagaaaccattgggagaatagagaaaaacaaaacctcgctctaggcggaaagcggcgtccgcaggcgtcgtagttgccgggccgaagacgacgggtgtctactgtcctgtacacatacgcaacgacagtttgccggtgccggtgccggtgcggctgccgtatcgcgtggctgcctctggcaccggcgcggccatcgaccgttcaattcaagccgcgatgaggcccgtgagcaggtctcgtgtgtttctctcccaagttgggcaaaatttctcagaatcgcgtggtcaactgctgatagcctgataaccgacagagtgattaatagcaccctgtacgtaacagcagtcctctcctcttgtagtcttgtagagtagaagtatagagtaacagtacaggagaaatactccgatccatatataacttctagcatgttcacatttcttcagatttgtattagctgttgggtagccatgcatgttagctgctaatcaagagtcaagacactgctgagttcaaataattaatatatttgacgaattcaagatgtacatacatgtacaattaatccaaaaaaagtactaacaaattaatttcccagcttgagatcatgcagacgaacaaattcctctccctgctaataactgaactgctggttgctggtgaatgtcatgccgaagctccaccagctgggcacgacgttgtagatgtagagcgtctggccgccggtggatgtgacggcgaaggagagcgcctggccgacgagccccgagttgcactgccagttggcgccccagttccggttcagcgtgatccaccccgtgcttccccccttcaccgacaccgacctcaccgacccgctccccgccacgttcgacaccagcaccagctcgaagaagttgaaccctcccatcgtgaacctgatccctccctgcctccagcacttcaccctacacatcaattaggtataggtgtttaagatcgacgaagataaagttagtgcacacaaaatgagaaagttattagcgtatgattaattgattttttattattacaaactttagaaatagatttatttgatattttaaagcaaccgttcatccgtttgaaattaacatgttagaatgtacttaagagcagtaattacggattactactagttgtaatacactgtaagtacttactgttggtagaggacggggatgatgccggccttgtagatgccgatctggagccaggcgggctcggccatgtcgaagtgagggcggggcgggttgcaccagccgccgctgttgctggggagagcccagttgggcgggcacaggttggtggccgtgatggtcaccgcggcgcccgccctgcaccactgcggcgtcgcggcggcgtcgcacatgatcaggtagcactgcccgcacgaccacccgtcgttgaacagcaccgagctcagcgccgccgtgttcgtcccgtaccccgccgtgtacaggttcccgtacccgcacgcgccacctgaacacacagagtcacacagcagcaggtctccgtgagaaacactgacaacgcaatgacagattcgtagcactccgtagttgatagagcaccaaaggttttcttacgtacccatcgtgccggaggcgtcggcgccgccgtagaacgtcgccgtccctttgttccagccatgcgccggcgcgaagccggatgctgctagcacggtgatcaccaacgacgtggcgaataagatcgcgtactccatctccgtcgagacgatagagcagagaatcgaacactgatcaggaggttaccgaggttctgaattttctgatggttttgcagtgaacgtggagggggttatataagagcaggaatgagaattatggtcagatcagagcagggaattgcagagaacatgccggcgatatctcagtcagcagtgcaagctaggctcacatgcatgcaaggaaaatgtaagccgaaccctggagatggaattgcgcgttcaatcaggtgattgatacgctgtaaacctgcaagctgggcatcatcatcagcacggcttagcattttctcctgataatcatgacctggaaaataatacatttcatgcatgtaccttgcatgttcagtaatccgtacttgccggcataaaatggatctacttagatattagtctgataatctatggacaaaaatataatttggaatgaactgtgcatgcatgccatggcttatcagcatctatgtggaatttgcaaattcttggtaggaaagaaactctgagccacatgaggccatgagggggccagcactgtcagcacatggaagatagctaggaggtggataaacaactgatcagattgattattaactcagcgcctacttagatgtctaatcatttggaaaaagctgactaaaagagtcagcagatttaattagccaccggtaccgcgcgcggtacggcgttgaaattgattacatttttaagcaggaaaaatgctgtcaagttgtgcactattatactgacttctatttgctctccctttgaattaaaccatcaggcgtacgaaaaatgtttttctttctttgggcaaagacgcatcatatgctacgatagatgcctctgcaggaactagttgcaaacttgcatacggggtacttgtgtgtagttgtgttggcatgcatgagcttgtctgtgttcgtaggatttatcattcatatccagtaaattccactgccagttctcttagtggtagagtccttagactttccttcttcccttccccactgcaaaccactaaatgattcttaatgttccctgtttttgaattattgaaatgattcctcaaaaagtttttggtggcaggttgccggtcttgatgtcaagatcgtcagaaagagggttacaaggacatacaccgagttcagctagattacagaaaggcgctggagctagaagaaatcagcaccttttgctttggacactggcaattagcggatcaaagcattttgtggcatccaagtagacaataacagtgtcagtgtaagacaaagtggtgaggactaatcgccatttggtgtagccatgatcgtgtcttccgtgtaaacataaaagtttctcaggagtcagcaggaaaatttccgcattccaaatgagaccctgatttatatcacggtagaaatgactggtagccgccagtaagtagtaactcatgaaactcagcatataatttcatttcccggtgggaacaatgtacatcaagaatgtagttttaacatcatctacgtacagaacgaatgatagatcggtcacaaacctcgagtgagattactagttcgacctgccttgccatgaatggacctgcgtagtactactactactatacacattacataggctactagtcttcactagctctctcctggtgcatgctctttccccactatgtaagcttcttcaatctgcagccttattatactgatcttgctctgcatgccgttgtagtgtgcctgttagtaggaaaactggaggttggaggagaatgactggccgaacttccaccacgccggcacgatgttctggaagacgagggtctggccgccggtggaggtgacgccgaaggtgagcgtctggccgacgaggccggcgtgcgactgccagttcgcgccccagttcctgctcaggggcatcctgtcggtgttcggccccttcacccacaccgactggatcgacccgctcccggccacgttcgagatcagcaccagctcgaagtagttgaaccctcccatggtgaaccgaacccctccctgcttcacgcacggcaccctacatacgtccacaaagaatcacagatcgtacgtagtaatgatgattaattagtgaatagttaatggcattggtttgacttaattatcatggacatggagagtcaaaccgtccaatattattgtagtatacgtacctctggtacagcaccggcacgataccggccttgtagatgccgatctggagccaggcgggctcggccatgtcgaagtgcgtgcgaggcgggttgcaccagccgccgtcgttgctggagagggcgtagttgggcgggcacaggttggtcccggtgatggtcaccgtcctcccctgcaggcaccaccgcggctcggcctggtggtcgcacgcgatctggtagcactgcccgcacgacgcgccgtcgttgaacagcgccgagctcagcgccgccgtgttcgtcccgtaccccgaccagtacaggttcccgtacccacacgccccacctgtgcgtggtcacctcacctggcctctgttagctaacgacgactctgaaactgtacctacttactggtgcgccaatgcgtatacgtacccatcgtcccggaggcgtcgctgccgccgtagaacgtggccgtgccactggaccagcctgccgtcgtcggcgcgatgagcgacgccgcggcgatgacaacgacgagcggcagaatgctcggtgtcttcttcttcttccacatcgccatgaatcttgcaggtggactagctcgccgagttgctgcaatgtagttagtgacagtggtagtagtaactatgaagaaatgcgagtgatcttaaataggagcgggatcaccggcatggaatttttgcctgcgctgcagcgcgaatggcgcatgtacgtacactgcacacactcagctccaattaattgcgtcgtcagatcggtgatctccttgtttcttcgtagcttctttgcaggcacactaacatgcaaacgaagaagaagattctctcatttctctccaccagatcgatctgcagctacgcgtcttatattcgatccgtaattaagctgatcacgctgccacttccgcatgttctctgctgctgcatgctcagctcacccaagggcaaggggaatgattagctggaactatttacgcttcttaaaccggctatcttgtgaattgtttagttgacagagttgacacgccatggaaggatttggtgagatatgagaggcaagcaagcggcagctatggtacttgctcacatgagggagagcggcaagccgggcgcaggaagaatccaagtgcgctgtcacacggatatggcgagaagatggtgaattatcaattatcaactcaccggatttgcagaagtcgccggcagcgttcacatacagtaaccagattgatgtcatttttaactatactattttttgataaagttgctaaaaaaatggtacgtttagtttgttgccgaatttagtaaatacataagaaatcctaccaaaattttggtaatattgctatcttgccaaaatttggtaagatttattttggctataatctgaataggccgcagattttctatttactttttcctaactttttaacttttaattttaaaattatccatttcaaaaacttaaatatatatcgtttaattagctaacgacattgacacatggcaacatttgtcttgccaagtctccttaatcggtgtggcaggataaaactgtcacgttcgttatgggtgatgtgacagtgttgttttgtcatatcatgtgaattaccatggctaagagatttagatcttaaaataagtttctgatgatttatttttgaaattaaaaagttttaaaaaaaataataaaaagggtaaaatatctccgtcctcgccgggttaggcagccgaaaggcccagatgattacatcggccgtcacgtgaagcccaattcacatgggtcgcagtgtcttcccgtcccaactaatacggctcgttcgaacactgaaattccgttctgaccgaactgggccgtacgttggtgacagtcccgctcaggcccaacttcaacgggccgcagattggcagcaatcccgttcgggcccagtaagaacatggctcgggcctcaggggttcggagttgggaaaagtacactgaaggtcgctcaacttgtcatcgagttacaaaatcgtcctccaaccgtaaaaccggatatagcgcatcccccaacttacaaaaccagtacaaactaggtcactcagtggttttgacttcggttttgttcgatgtggctacacgtgtagtacctcaaggttctgagtttatatctccataggagcgaatttaagagattgggttatttgcggggcaaagttttctatttcaatggccgtatatatccagttggatgtagaggctggataaaaaatatcgttctctaaaaaaagaaaagagaaatggaagatttaggtggggaacctctctcctatgattattcaaaaaaaaaagcctcgacaaacatttctttttttttctctctgttttagtctccttaagtctatggtttacttgttatctgacttgactatcacaagctcagaacggttgtttgacggaggcctagtttagttcccaactttttctttaaatttttaacttttctatcacatcaaaactttcctacacacacaaatttttaacttttctgtcacatagttctaatttcaaagcaaacttccaattttagtgtgaactaaacacaccctgaaactgcacatcatcacctgtgtactgaattctatttgtctcaaaaaaagaaaaagagaaacgaactgtcagtcacctgcagttgctgtccaccactgacaagcatttcacttttagttcgtgtgccaaaattttgaaaaatgaaatggcatattggactcaaaaagctacttcagcctgccgctgacagaaaactctccaatccgacccatagggcgcgcttgccttttgtctcagattacaggaatagtgatgtccccttctgcagagcaatgtgaagcatgagtgcatgttcagtggagtgttaatagatggaactcaaggagggaggagactggagcaggagtgcaggacacgggcatgctatgccgtacctccggcacggccaatggcacaggtgccggcacgctttgctgctgacattagccgtcctcgccgcggctgttcatcgggccgttttgttttgatactaaaaatatgcactaccaatttataggcaaattgcaaattgaatagtatgcgttagttttgattgagccaaatatttaacagtgccccctatcttatttggtcatattttagaagcttcttccttatacaataagaatttggctttatatcggtaacaatctaaatgattgctaaataattttatcctaccaatattttggtagtgccaaagtttacctagactttgacactaccaatgaattagtagggtaatgaatcaaacaagcccatcatctgtcacccagctgcagtcactctgggcatatggagacgagctaaggcctatggtctatggcggtggctaagacaccatcagcagcgatgagggggacgaggatgctgaccgactca

SEQ ID NO: 69401 - DNA, 3997 bp, Oryza sativa
tatcagttcacccagttaattaatttcaagtttctgtaaaaaaaaactgtatggttaaacttgtaaattcagctgctatacttttaatagatctcctcttagttgtactctctcttaataattcgctggaaacggctggaaactaacctgttcggtctaaaaataacttgcacaaaataaactaatggagtctgttgcgtattcttaaatttttttaaaaaaatcaaatgaggtcaggacaaagtcgatagtgcctggagctaatcgttctgttccaggaatatgtgctcaacttccatatgaaaacgaactaaaatcgagatcgagaggaattgctgttatgcacatctgtccggaaaaacttgtactataatcgtctgagagaacataaacggtttgtcgttgcatgattatagttaattagagtagattcttcagttgatgataataaaaaacgacatggttacctactactacttgataatacttgtcattttggatgagactaatatcaaactttatttttttttaactaattctaaaatatgtcttttttttcacgaatgcgcaaaataattatatgtcaatatatcagaaaaaaaagtgtttatttacacagtgcaatcaaccagaccggcttatgccaagcgaagggagaaaagacaaaataaaaaaaaccaaggaaaaaggaagatactactacgatagtaaacacaactctaatcaacggaaagggggtagagccacactacctgtcacaccccaatctggcaccgccgtacaacggcacctgataggagcgtgtcgtaggaaaaacggcgcgaaccgctccctacgaaaccgcgatctcagtaccagtcccaggacatagcgctggtacccacggtgacaaatatgaatcattacaatccttaaaataaatagaggacttatttaccttaacttaggttgcagctcagacagcccgagaatgcaaccgacgacacggacgaggcaaacaccaacaacaacagcagcagcggaaccaacggtctaacacccaacaccacaggcgacggctgggaaccaggacaaaacccttaatcttcactttacttcatcttcaacttcaggacggaggaactatatatatttatatagagcaagggtgagtactttcgtacttagcaagtcacgggaatttaggtgtttaatgcaagcttggaagagaggcgaggttgttttgcaaatcctttgtttgaaatcattttgaaatcactaagtgatttacttcttgttaagtttgggctgaaaagagacttgcgtctcaaatcgacttaagagatgcttttcaacaactcaattggtaatgtaccgacctcccgggttagatcattacctctcggctcccagagccatttcacttgattaatcggctcccagagcctttctcattttctcggactcccagagtccagctgcccagcagcaccacattccgcttccactcgggaagcctagtctatgatgcccgtagacatcccgaatcacacagattcgtttctgaccactcaggtcatccatctgccacataggctgattctggttacgattcccatcccacaacttttcacaaagcacaggcaaacaaatctacgcaacggaaaccacctcacatccgcccatgaccgtgggcacggctgttcgaacagttagttaacctccgcagaggggtacactttacccacaagatacgaccttattccgaacacccgtcggtgtcggaggttcgcaacaaggcctttcctaagccggcccagggttacctcatgccacatagaaggatcaaatcctcacataaatataggccattttagttttcacaaatcaaactccaaccacctcgatcggtaattcagcaagcttctcttccttgcttaccaggaacccggtttggctccaaccgaccccgccccggcgttccccaactattggcatgcgaggtttccctgaaccgactaattacttagccagggtgtcccattccaccttgtggttgcactttgattatgctcgatgagtttcccacaggaatcggtccttatatgcgaatacaggacagtgccacgcaggcacaacccccgcatcgtgagttttcacaattcattttatgtttaaacacaccgacaccacatgtcgggttttcaaggcttctcaaacccatttcccaagttttcgacaatcaacggtgcatgtgagatatttggtatacgcgctcagagagcacgaataccaaagtaccacaagggtggagcgacaaggaatcatgatagtacagcctacaggaattagtgcgactactgggtaggtccgtcggtttggcacgcaaaccgaggccaagtaagttatgtgtgtgactctaataatgcaagttgtaaacaaaataataatgattttctaattataggagcaattgatcaaagggtgacttgccttgctcaaggtcttcacggagcttcacgaatcttcgagaaaacccgcgatcggcgaaaatccgataaccgcaactatacgcaaacaaacaaaaaccaaaacaaaagaccaagaaaaagaccctatttagactaaataatagtgcgattaaatagatctcaattttatggaaatactggaagttgaacggaatcaatcagagctacggattgagagatatgaattttggaagtttaattggaatttttgggcaaaggaagatatttgtggaacaaggggaaattgatttatgaaatttatagaaataatattctcaagaatattattgtcaatttatagaaataatattctcaagaatattattgacagtcacggacgtgcgggaccaagggaaatgattcatggaattttggaataaggaattgatttatggaaaaggaaatggacgagggatgtatattagactttttcgggcggcaagggcgcggcctaagggttgaaggaggctcggccgagccatttaggccggcgcgggcgcgggaaaggcggtccattagggcgcgcggaagggagagggagcggtccggtggactgagtgcacctcgcgggttccaggtggggcccgcttgtcggtgacatggcccacggtgggatgggcgcacgcgaggtgcggcgctagggtttcgggtgcgagtggcttaggagcggtgcaccgggtggatggatggcggcgggcccacgtgcagccacacggcttgccgtggaccgcgcgcacgggagggaagacggagggagggggcggctgactggcttggcccggtcaaagccgaggtggcgccgacgtggcgcctacgtggcagccacgcgggccggcgggaggaggaagaaggggaggccgagatggacggcggacggcggccaagttcaccggagctcgtcgcgacgattcgagagagagggagtacaccggaacaatgggaaggacgagagggagtgagccaccggatcggatttgccgaaggggattcgatggcgacggatttcgacggtggcggccggcggcgatcaagagggggaatcgcggcggggcgacgataggtcgattcaaggaggagggagcatctccggggcgcggggaactcatttccggcaccggatggggcggaggactgccgaggagggctggcgatggcggcggcctccgggagcgggcggcaacggcggcaagcctatggcgggcggcggcgagacctggggcggtgtccatgcgtgttcgggggggctggccgagctaccacgcgagctagggagggagagggcgagcgaaaagagagaacggagggtggcactaccaagccgggacgggcgcagttgtagcgcccgttccgtcgtggcgcctagcgggaaaatgtaatttctaaaaaccttaattgcgaaaattgtttcttcgcttgcagtcagtctccgtgccattccggatctcaaatccccgacctatcgtcacgttcaaatggggcgcaggaat

SEQ ID NO: 69402 - DNA, 1957 bp, Oryza sativa
atctctatccccctcccccctgtgtctctctctccgtccctctctcccccggtaagcccgcgcgccgcgagagcgtgcgcgtgatccgcaccgagccgagcaccattcgcccgcgctgcccgttgcttcccgcgcgcgcaatccgtggtggccgaccgcctggttgccgccgctgtcagcctctgccacgcctgccgcccgagtcgccgctccgctccacactgcccccgccgtcatcgccgtcgtcacaacccggccccgccactccgcgcgctagcctccaagggacggaggcagagctcctcctcctccctctgccgcgtcgccccctctccctcctccttttctcaaagtggcaaggggcaagccccctttccctcctcctttttcccttttctctcccgccggcgtcatcccccccctgtcgccgttttggccgcgaccgccgagcgctagccctctcccttgaccgccctaggtcggttcccaaaccgacatcgccatcctataaagcccaggcgccctccctcccttctcctcttgtttgtcccatcgcctccactccattgtcgccgcctcccgtgctctgttcgccgccgcctttcgttgccacgcgtgccggaggagccggcgcgttcgtggacgcggaaggggactccgggagctcgtcttcttcctcttccccggcccgaggccggagagatcactcccgtgccgtcggcctcttgtcacagcgccccgcctcgtctcggtagtgcatccctccgttctccctcctcgctccatctcttccccttagctttgagtagccgctcgagtagtaccccagtagctagttggcgccgccccagcccgcgccgccgctcgcagtaggctcgccgctgtcgccgcccgagctcggaagcgcctctcgtcgccggcctccctcggtgcgtttcctcctaatccggcgcaagggacggattcccggagtcgcgtagatgctctagctcgcccgaatcgatctcccgtcgcgccgtcgccgtttcccccttccctcgccgccggttgccgccgccgcaatccaccgccgtcgagccccgtccgacgaatccgagccattggcttgtctctcctcgtctcgtgcaaccacccggtgtgctcgctttcgcctgtatcgccgtggttcgctccgtcgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtccctccccgtgcgcgcgttccaccgcgagctgtgaggctgcgcgtggacccgccgcacccacgtccaccgcgaaccgcgcgcgtgcatcacgtccatcctccaccctagcgccgcgccgcgtgcttcctccgcacggtgagccgagccgctgacaagcgggtcccacccgggaccgcgcgaggtgagcccggcccaccggctctctctctccttcctccgcgcgcgcgcatcttgggccgctctgggccgccttcttgggccggccggcccgttaagctcggccgagccgctctttctctcgggccgcgccctagccgcccaagaaaagtctgttttctctccctcctttcttttcttttcttttcttttccaaaaaggatttaattaaatccttttcctttagaccaaaaatccaataatcttagaaattcaatatcttcccaaccgtaaatccgattgactccgttcaactcccaaaattcctcaaatcccgagatctatctaatggcacgcttagaggtcatcaatagggctttattttcgccgtttgttgagttgtcccgtttgcgtgtagtttcggagcccgaagacccgcagtgcgaggatttcgaggatcaagctccagatctcgagcaaggcaagccacct

SEQ ID NO: 69403 - DNA, 3468 bp, Oryza sativa
gtagctgatgggatcagctaggcccgggtggccgtttgaaaagttgttggcccgggtggccgttgaaaagctgttggccgggtgccaaccttgtttcaattctaaagactgatacattgcacatactccgaccggacgagacgcactgtctcatccgtgtcgtttgagaagcactcacttagttgtttcagaaaagagttcgaataaaatcaattgcaaaaacaccagcctttctttgaagcctgcattaaacacttatttcccctggcttgctgagtactcccgtactcacccttgctctatataaataatctccccccccccctcagttgctgaagaagatgaagcggatcccgctgatgaggagttcttccaggagcaagccggcttcgatgagttttagggtttcggcctagttcccaagtcgcgcctgtgatgtttggtccaagtcctggcttccgtttcccttttgtaatgcagttgtgagctcgggatctgtccgcagcccaacatgactgtacttctactctataataaagagacctctgttgttgtgatattctgtctccctatgataccagcactgtttcctgggactggtatcgattaacaggttaatttggagcgtcacgggctagttccggtcggtactagttcggggcgtgacacagtactaactcctttgtcagaaatgatatgtcctaagtattccagttgagtgcaagcaaaagagcatttagacctcttagcaaataactggtgttgcctcaaaatagcaaaaacttgctgaagatgatgcaaatgactatcaaggtcagggctataaactaagatatcatccataaacaccaacacaaacttcctgataaatggtgcaaagactgagttcataaggcactgaaaggtggagggtgcattcgtgagaccaaatggcataaccctaaactgaaattgcccatgatgtgtcttaaaggttgtcttggcttcatcagtttccaccattcgaatttgatgatacccagctttcaagtccagtttagagaagaatttagtgcctgagagctcatccaataattcatcaacaaccggcataggaaacttacttttaatggtgagagcatttaatcttctgtaatccacacaaaaacgccaactaccatcctttttcttgacaagtaaaacaggtgatgcatagggactcatactaggtgtaattaaaccagcatcaatcatttctttcacctgtttctcaatctcgtctttttgtaacggagaatagcgataaggtctgtagttgacaggagtagcatcaggtactagagaaatagcatgatcaaaaaccctatgtgggggaagacacttaggatcgtgaaagacatcgtcaaagtcagttaacaattgttgcaccgaagaaggaatcacatgctggacatcatcctgggaatgttccaacaaagcagcagcccatatttcacaacccttatgccatttcaaaagttgtggcagagtgacagcagcaatttcagaagggactgcagcatcttgtactccttgaagagaaatccaagacccttgatactgaaacttgagtgttttattagcccaatgacaagacatttccccccattgctcaagccagtccatacccaagatggcatcgtgaccccccaaagtgaccaccctcatgtcataagtaaatgtgtgcccctgaatccaccaaaaaaaaccaggaaccacatactgacaaggtaagcaatcaccattagcaactttcaccagagtagaaggaattggttttagaggtaaacccagcatctgtgcaaagttgtaatcaataaagttgtgagagctgccagaatccaccaaaagtaacaagactttactatgaaccaatgctctcaaacgaatagcagtaagaaggtaagctcctgtcaatgcattcagagaaatatgacagtcctcctcatcatcagattgttctgcagcaataacaacatccaatatgtcatcagtgagcacctcttccaactgcatagctttgatttggcctccaacagcacaacgatgttcaggagtatatttgtcaccacacttaaaacaaagaccctgagcacgtcgatagtctttcaactgcttagccttccatagatcccctttatctactcgacctggagtagtatcagaactgacatcactcttgtactgaggaagtttcacaaatttccctttgagagctttggtagctctactagccaagacagattcctacataagagcaatagcagatgcttgctgtacagtgtcaggcaattgaacaacaacagcagctcgaatttcttcagtaagaccattcataaaacgagtcactaacattttaccccccacagatggatcaaacactctgatctgatagacaagagaatcaaattgttgtttatactcagtcactgtactagtttgagtcagagtatctagtgcagacattttcttacgttccacaacaccctcaaattctgttgcgactgccattctaaattgatcccaagagttaacctcattcactaacttataagaatgataccattgagccgcatttcccgacatatgcaacacagcagcagagactttgaaattttgagtgatttggtacatgtcaaaataagtctcacacatatccaaccaaatccgcatatcagaaccatcgaaacgaggaaaatccattttaggaagtggctgatgacgccaataaatcccatcaccaaaaccacgacccaaatcaaccccatccaacataggaggaacaggtggattcaacggcggaggagtcgcagaaccacttgtactaacctgcgagatcccggaaggcgaacccaaaatcccggcctgatcagagcagctggccacccgcttcatcgaacgggccaactcagcacactcttgctgcaccttgccgacggaatccatggcgagatccaccttggtagtcaccttctcaagactgccaccttgggaatccagccgctgatcaatctcgtgcatccactttgtgatgccttccaacttctccaagagtttggactccatggagtccatagcttgcttcaaaggggctgaaagttttgcgggcgccgtggcgaatcaggaagaatccaacgcacggcgacacccacaacctgtctctgataccactgtaacactacgccaccgcgaaactcgccgccgacgagagagagagatatttagacgagatcggagttggggacgaagagaaacagagctgaggcagaggagagacagagtttggagagagatagatttgatttctttttgccaggttggccacagccattctctctctcgagtatttatctcctgattacatggaccgtttgcccaaacgatttaaagcacgcaggccgcattctatttgataaagtctagcccaaaacacacacactatcattcaca

SEQ ID NO: 69404 - DNA, 6460 bp, Oryza sativa
gccccctttttctgcatctgaagtttggacgcaactcgggatcggcgcccgatgggattcagcttgggtgactttgtgttggcatgtcacaacgtgacattgtgaggatctctgccatcaaaaacacatccaacggctcgtttggttgggcccgcctgcaggtcggaaatttagccgccgatccatccgtcccgcgggagatggcgcccgccgatccaacccatcccgtttcgcctcgcccgagtccagccgtcgccatcgccgtgagccagctgggaggcttgctgtcaccgcgcgaggccgtcgggctcgccgcgagtggggaggggaccgggcggccgccgcgcaaggccggggtcggggccctgccctgctgccacgaccgaggagagaagccaagccgccgcgcgaggccaactccatgccctgtcggcctgtcctgccgtgacctgtggagaggcgccagggcgtcgaggccctaccctgccgccgcgaccgggggaccgggaaagctaccaacagtacgatagaacatttttctctgaaactcagtcagtcaacacaagggagatagctatatccaattcactcacaaatgcagtgaaatcattgcatttccctccatttgaatggcacaaccatacatctcctttgaagtcatatatatcaagcatcagcgcgcgaacaccattctgcaaaaaaaaaaagaagctatttctatgagaatcaattgtggctagatgtatcgtcagacatgtagaacaatggctagaacagatgatgcatatagcaggtgcgacatttaattgatcagtgactgtatcctcttggttgtcaaaggtgatgcgtggaactccagtgtgcgatggctccccaacaattgcaaatgaattgtgtgtcgtgagataggcatactagttgaatggcagcgagttgttttgaagaacaaatcaaaagcaaactccagtcaggatgcagcaaacagaagctgtttgatgtccataggctgatgcttgtgcaggtagccggcaggggcagcgcggcctccaggacgtcccctcctccacgcgccgagctgcagattacagaagaaaaatgaggccggttcaccacggctgcagatcaccacgactgcctggactggctcggcggcctccaaccgcaaccaccaccgcacgagggcaggcctggtggccgaccgctgctcgcgccggcagggccaccgcggcgatctcgacgctcgcgcgcggcggccccaccggagtcccgcggcgacaacccccttccgagcggtggcaccggcccccttccaagtggcggcggtggtggttctgggggattcgcgagcagcgtgctccggcaggaaacggagcaatgcggggtgaaagctgaggcctgcaggtgggccagcgcagtggacccttggatttattttcaacggcccagatcgctgcaatgtcacaccgtgccataccatggcaatgtcacagaatctgagtcccgcccgatgggagggggaaaatcggaagctgacatcagtataacacatgcgcgcaaaatcactttaaactattttttctcttaaattatttatccaagtcattgaaaaccgcatgtcgtaatattgagtcgatggttatgcagttgttcgctaactttggatggagattcataaataggattcaataatttttgtgatctttttatgctgtgagttttcattaatctgtatgcttttgtttattcaggtgtgagtttttattgagttggagtaataattggctatagctttttgagcaaaggcaaggattatattccattatctaaaaaattagatctatacatagtaaaacattatgagtacactaacatttttttttaaaaaaaatgaaacgaatttccttaacagaggatttccaaaatacgcgggcaatttgttgcaacggagtatgtggtggggccacgtggctggtgggggcaggaacatgtggtgggcccacagagcacgtgcgcgtatcgtgggggggagagcgaccgatttttcccctcctcgagcgacgatcagcagcaattctgctgaagttctaaacgtatgagaaacttttggtgacagctcaaacaacgttggctagatgtaagttagtaaaatttattgttagaacttttgatttttttaatcctaatttgtttttagcttggcttttaaattttaagattgttttacctggaatagctctaatttacaccacctttagaataggacatgactatatagcgcacgatcgctggtttgattaaggccctgtttagatctcaccctaaaattttttgacctgtcaaatataatgtttgaacacctgtatgaaatattaaatgattatacactgtaattataattgttaaatttttagaaaaaaaattgtcgacagatatgtagccaaaagtgaactggcaataccaacgccgaacgcatacgcaacggcgtcatagcacgagtagcaccttttctcatggccctatgtatcgtggagtctgtgtgatatttgttgtaagtattgggaagtggaggaccagactttgcctaagctgtgcgtcgtcaagtttcaaccaggtcaggtgtgtgcctctcgctgtagtagtctctaccattcccagcgcatgaaaccgaccgtaatgaagaaagcccacgacgcaccccaactacccaagtgacactcgtcactcgtgccgtcggtcatgtgcatgcaccacgcacgcatggaatccacggcaacagcggcgacgcacgcccaccacctctagactctagtagttgtagtacaccccaatgccacatgcaaaagcgaggggttgtttggttggcatactcacattactaaaacgtgccatactttatttagctaaagctgtttggatgctatattaagtttgccaccattcaccatactttttatgctacacttgtctaagttgtgacttacaaaaagtgagccacaccttagctagcaaaattgaattatgccacactttattgagttgatgatatgtgggacccaaatagataagaagtaatactgccacaagtgtggctataaaccaaacaatatactaacttggtcaaacttatctaacataagttgtgataacctttggcaaactttgggagcaaaccaaacaacccctaacatgcctaacatgtggctaacaaaattgaagccacacttcaactataggagagcaaacttgccacacttttatgtgtcaatgatatgtgggacccacgtcatggtgaagaaatcttatcataagtgtggcacgaaccaaacgaatgcctaacttaattaaacctggctaatttgagttgtgtcacagtgaagcaaattgtggcattgagcctcacagcccctcaattctgctgcgggtcgcgactttgcgaattgcgagtagttggcgcacgtactactcctactacacgtccactgcgtgtgtctgcgttcccggacaaaattgccagccagtgcacaagtgcaggcgtgcggccacttcccaaagaaacccaagtagtggaatttccggaaattaaaacagcataaagtgctcctaccactcctactagtagtactactacttctacccaacaatcattccaaccagtctccaaacaaaaataaaactattgcaaccagcctccaaaaaaaaaaaaaaaccttaccccaaccgccaactcacgggctttggcccctggcacggcagccttaacaccctgtttaattccatctccatgcctcatacctacccactaggctagcacccacgacacacataaaccgagcaacctgtgagcagatggccccatttgtcactggcaaatcgtggaggcgacaccggtgtgaaacaacaagccgcacgaccccccagaaatctcctcctttgcctcggcccctcccacggcgagagagcgtccacccgacgctcagcaactggagcaagcacgggcaacgagtcgcagtaaaacagcagtgcggactcggagacagtacggggaaaacgcacatcgagcggtggagagtggagtggagtcgaatgcagcgcgagtgagtccaaaacgactcgtctcgtaacaccgaagcgaccgagagcgcctactgccgcctactgcgcctgcgctgccgccgcgcaagcccaagcgcaacgcatccgcctctgcctcatcctctcctccacttgctggtcgctgccattgcctgcgcctccactccacttctcgcggctcgagaggctgacggcggggcgcctcgaatttcgccctctccgacgagcggaggcggaggagggagcccaggaagaggatgcgaaagcagtgaagtttgtagaattttcagttgcattttgctgtttctgcttgggagttgctttggggcgataagaattctcttgttgatttgttcctcgcaggagaggaggagaagaggggggaacggaaatctcagctgctgcgtcagtctcgcagatctgctccgttgagctgctgtttcacggaatcaccatgggtggaaatcatcgccatgggtggtaggattggttgggtgtcgccgatcttctcgcttcacgccaactaatcgagtgaattgtgggaagaagaagaagaagaagaagccgagtagacgacggcaatggcgtcgtgggagaacctcggggatgtggcgaccgtcgtgcagctgacggggctcgacgcggtgcggctcatctccatgatcgtgaaggcggcgtcgacggcgcggctgcacaagcgcaactgccgccggttcgcgcagcatctgaagctcatcggcggcctgctggagcagctgcgggtgtcggagctcaagaagtacccggagacgcgggagccgctggagcagctcgaggacgcgctccgccgcgcctacctgctcgtccactcctgccaggaccgctcctacctctacctcctcgccatgggctggaacatcgtgtaccagttccgcaaggcgcagaacgagatcgacaactacctccgcctcgtcccgctcatcaccctcgtcgacaacgcccgcgtcagggtcggtaaaaccatatccctttcagcttctctcatcagtgttcatttgtttaatcgtgtagttgagtgttagactagtagcctgggcatgtaggcttttaagaaatgttggttgcatcattctttgattctaaagtatggtatatggaatgtttgcttttgaaattggatggaaaatgatttgtcttggattcttggtggttttcctgtatggtctcatgggttctttgttttctgttggttggtgtgacccaaaggattctattttagaatctatcttctgaatataaccgacgctgcaaccttttggtgctccatcattttcatcgtctatataatctgatttttttgttggtgtgaatgtgacccaaaggattgtgaaggtatatgtatatgctaggaaactgattttttttttagctccagcacagtgagctcaatcactaatcatgccacttgggactagtgatctgcatcggatatcatgtttatttactcctatacttgtcatctttgcttcacaatccttttttttcaggagcggatggaatacattgaaagggatcaatgtgaatattcttttgatgatgaagacaaggaggttcaagatgctctgttaaaccctgatccaagtacaaatcctacggtagtgctcaagaagactctgtcatgctcttatccaaacttgccatttaacgaagcgcttcgaaaggaaagtgagaagctccaagtagaacttcaaagatcacaaagcaacatggatatgggccaatgtgaggttattcaacacctcctaggagtgactaaaactgtggcaagttcgattccagagaaatgtgccactcctaaggtttctgaaaaagctgactctaatcacacaaaagtcagtgaagatagtgcaaaaacatatcatgatgactctccaaagaagcaaaaggatgcctgcactgcaccacggttagtaagtttaactagtttctttcggtgactatcttcttatgatgtgggttgcagtggtaaaaaaggcagtgtataaaaccttttctcattaagtaacattaacctgaacaattactatggccatttctgggtaaatcatgaaaaatgtgcgcattcttccttattttagaggtgtaagtcttgtatactcaactgtgtgatccaacaaaagagaacttcactatgttctgttctagacttgaaatagaaattttgttatgtgcttatgcccctcaaaatgcgtatgcacattataaaaattttgatagttcctatggtgcatatctttctcagaagttctccgccatcttcttatggccatgatctggtctcaagcagaggatcatacagcgacgagtggcatgcagatttgcttggttg

SEQ ID NO: 69405 - DNA, 3236 bp, Oryza sativa
tcctgctgttgttacacttgctgtgtgaggagaaagcttcgtcaaaagctaaatattgcggtaaattttcctgtcccttcatatctgttgtcaattgattttttttcctgcttctctaaagtagaagtgcttcattctgaccctacaatgtgaaactgagctacctctggaattgttacagctccatgttatacactatgggtcatttcagaactgattaactgaactagactataactggggctatgggtcattttggctaaaggattataaatgaaactaacttaacaaaatgtctgtctgtccattgctaatgcagaggtttgttaaaagattgggtagagttttatctgaaagaattaccatgcacactatggagcgttcgtatatcctaagagccttttatgttacttaaaactctgtttatgttatgccgctgacagggaggttgcattgatgatttcctatcacatttgatgtgttgttgctgtgcgcttgttcaagaatggcgggaagttgagattcgtggagcttatggtgagtttcctacttccatgttatccaattaaccagttgagcacgtggatattatagggaatatacatggatgatggagtatatataacagtccacatttcctccttaacagtatcctaaatactagtatatggcactgttgacttttatttggtcaatcttttgaaactttgaccattaatagctctgaaaacattaaaaaaaacaagtggatatatttttctttataagtacatttacaatattacaattttgttagaaatgatcttaaattctaattgataaacagtgatcagcgttgctcactgaacacggaatgaattcaacagtgttatatatttaaaaacagatgtagtaaatgggaaggaagattgtattatagtgatatggtctcgaatcttctacggttgaaacattgctctgaaacatttcatgtcatcataaccctgccgatctcaaagacaagcacaacatgatttaaattgcacaagcaatattaatcagtatgcctcatttcctgcaggagagaggactaagattagcccaccctcatttcagtacatggaacactaagcagcgatgcaaggcttgagcttctgtgaagataatgacctaaaggctagagcaacccggtatcgtactacaatagtaatgatgacacagctacaacattgttgtatttatgcttaccctgcattgtttgtgttggtactctgtttatagtaacatcagttggtgttgggcacagtatgttgtatgtagtactttgtaagaaaaaacacaagttacatgccctcgttgtgctcgtctctgttgaatcccccatgcataatttaacctttagcttcatttgcactataaaacagtaacaatattaaaaaagtctcaaattgcaaaggcaatggggtccagaaactcggaggaagaaaactgttaacaggtttctcaaaaaaaaaaaaaaactgttactagtagagataaacaatgcgatgctgggccatgcgaacatgatgcaacaattcaaacaaagaccatcaactaaaaaacattagactttcaccatgagcttccgtttaccacgacgtacataagcttccaaggctcaaggcaggatgtatattttggcaatttaagcaggtcgtcactggccgccatcttatttatcagtatcttggcgaaatccatttcataatcgtcatgtgaagaattgttaagcatgtgaacagtttcacgatgacgcgatccacgggacacgcagacatacatcaacgaaggtcgttgagttgagatgaccgtcctaccagagttcctccaggcttcctgtcgaaactcaaacaacaccggcagatcgatggcctcaccgggcgtagcagcctagggtgagtgcaccggatgcaatctggccgcacgctactgctttcagcgaatcgaacggaacaaggagttcggataataaaactccgaaccccttttcaggctgcagtagaaccaaagcaagggttcgggaacaaaactcctaacccgcgtagcgcaggtgaccgtcgtctttgtgcccaactatctctgtagattgccatctcttgctctcgcaggctgcagcagaagctcttgataatgaatcaatgctggatgaatacaaagttcagcacattattggacgggatcgcaatgcaaaatcaccgcgctcggaggcagcgttcagcgtggccgtgagactgcattgggcaaaaagcgaaatccaacaactccagcgtctcatgctctcagccctgtcaaactcaaaaaccggaaaatcgatcgatggcctcaccgagccacgtctccgccttcctccagaccacgcagctgaaacaccgaatacgaggcccgcgaccaatgtaccttaccgaagtgagtattagtgtgggccatagtaactgggtagtagtagttgttcatagcatccacagtgtttatgtaggggatgggaagtaaggtggggcccgctttgaaaaaaaacgcaagttcgctatagacattggcttgatgtgtcagaaggtgcttatacctggtggtagcactactatccggtattagttcttcaccacctccatagtggttattacccgataataaggtaatatttaatgcttactactccctccatttaacaatataagttattttagcattttccacatttatattgaagttaatgaatctagacatatatacctatctagattcattaacatcaatatgaatgtgagaaatgctagaatgaattatattgtgaaacagaggaagtacctgctattttgctacactgtagatgccctggggatcagagaataaaactccgaaccccctgcaggcagcaagagaacctactcagcacaggtcacaggtgatcgttctgtgtgttgcgctgcgcccaactatcggctcgccttcgccgccgtggcgtctctgtagactatcatcccttgctctcgcaggctgcagcacaagttctttagtggaaatggacaattctgggctaataatgcagttatgtgtttggttgacttgtcgatttcttgataatagataggatcttgcttccgaatcgagctcttagtcatcgtcttgaaggcgtcgatcgtcgacggacaagaagtttgtcaagttagaattcctgcctttcaaatttcgaaggagaatagtcattttggtatgaa

SEQ ID NO: 69406 - DNA, 2866 bp, Oryza sativa
catctggtaagaacgggtgccatcctagcagaaatccagactcctgttagtgcactcgacgaccgattcgctagctggctgaagtcttcgttcttctcagagacatgtacgctagaaccctgtagccgatgatcatcgcgaccagagctacaacttctgtcacgccgttgtcaagaggtatggcattgatcagaatgtccgggacaggatgatattgcaccttcagcagtagcctgtacgtgtggtagttgaatgacaggtagcggagccaggatatgaatggtggaactctctgcatatcatgatggagaagagggcaatgcgtaagacggagtaaagacttgttcattcagtatgttcttcagcattgcatcagtaacacagggaagtgcttgctctcacctttacaaagaaccctcctgctagcatgaatgtcatgactgtaactgaagctagagttgttgccttcttgatatccaagaggctagctccaattgccaatcctaatccctgcatgattacttttttcttgagtaacagatttctaatcactgctaatatccttttgaaatatctaagatatatgatggatcaaccaaaatgttccctaacttatgaataaacacaggtgatgactacaacttcatgggaaaattccttggattttgttcccatctcaccatctatttagatagttttgatgttcatcatacattctttttctcatgtaattggtgtgtatatagacagtacaagttcaactaacagaataaacttttagaaaaataaaaaatgctataattcatttcttatataggtttcctcctttagaaaagattaagggccagtttggttcatggcctatgttgggcttaccaatttatgggtcaagtaaacagtacaaacaaaagtttggtttggatccaaatatcggccagcctgaggagaaagaatcggccacgccgtcgacaggagccgaatcgcgggcgtgaaatttgaactcccgcgcgcgcggccacacatcgaccatatgtattctacgctgcacacaaaaatataagaagataagctctagagttcccagttcccatttgtcctctgttttttgacgcccttcatcttctccatccaataaccacatctcctccaaatcttgaccaagaaaacccaagaagatcctcatctggtcatacacactcatcttctaaaccaaccgaaacaaataatagctcaaatggggtagagatttggggctacatctaggagggatgggggcgagttgaaacttgaaaggggagtgactgctcaggagaagaacaggacgagtacgtgtgttgtgattccagcagtagctgtactgactccggcgtgctcagttgctgtgaaaaacaccatcgattgctacaggaaaaggtaatcaactgatgctccatccgtacaatgcttgttcatttgtgctactaatgtagttatttatagtctgccattaccatcttaactagtagcaataaaaaacagtaggttgaataaatcttactgtcttagtgttgatttctttgctcaaaaaaatatacaggtgtccatttacacctcagtaatgttatttttagtcgacaaatctacatgttggctgggcacaatatttattcagtaaattaatttgtttttcactgaaccgacacatttccttaagtaatttgaagctgcgtatgtaatctcatccagatggagaacactcgacaacaatatatgcatcacttcttgctaacgaagaaggctgtagtggtactttgtcttttgatcatcatatggttgaggaacaaatatcgtaggaggagtagtcgcaaaggggtaaaatatgggcccctagtccacagggatgtatggagaacaagtgaactaatcaggctgatcaacatttcagataggacgtgcactcaacaattaagaatgtcccgtgcagtattctacaagctttgtgctcgtcttaggaacaagggactactagttgacacctttcatgtttcagtagaggagcaagtggcaatgtttctgaaaaaggttggacaacaccattctgtttcatgtgttggattctcattttggcgatccggtgagactgtgagtaggtattttcgtattgtgctgcgagccatgtgcgagatagctcgagaactcatttacatcaggtctaccaatacacatagtaagatcaccagcaagaaaaacaaattttatccatatttcaaggtaattctaaacaccaagccataacaatgcatattacaatacattttgtttattttaactctaatgtttcactttgatatgtacataggactgtataggagcactagatggtacacacatcagggcaagtgtgccagccaagaaggtggataggtttagaggccgcaaaccataccccacacagaatgtattagctgctgttgactttgaccttaggttcatatatatcctagcaggttgggaggggtcagctcatgattcccttgtgttgcaagatgcactgtctcgaccaaatggccttaaaatacttgaaggtaattaaacatttcaaagaattcatgattagccttgctataagttgacgttaggctctatgacatgtttgtagggaagttctttttggctgatgctgggtatgctgctaggccgggtatattgccgtcttatcgtcgtgttcggtaccacctaaaagagttccgtggccctcaagggccacatggacctcaaggcccaaaatgccctaaagagcttttcaactatcgtcattcttcacttcggactacgattgaacgagcttttggtgctttgaagaatcgtttcaagattcttatgaata

SEQ ID NO: 69407 - DNA, 1409 bp, Oryza sativa
acaaatgcaagtacatacctaggctttcacttacatagtaaagtttgtatttttttggatgctattttcaaacttttgcaatacgaccatccacaataggatggcatttgatggcatagccatttgatggcaccaaaccaaacctggtttagccaaaaattggcaaggttagttttggcctttaaccaaacacaatttagcctttccaaatattggccatgccaaattgtgcctttggccaaattttggtaaggcttgttttggcctcgaaccaaacttgctctaaaaataggagatgtcaatggaattataccacgaaattagcttgaaatgtacctgagcagcaatgatgctgaggaagacggtcaacatgctaagaaagaaatgtgcggcagttgctttgaggcctgccatgaagtagacaatcaccataaatatgactggaaggaaaaggtccagtggcagatcacttgtcgttctggccaagaagtatgcactgagcttgtacatgtcagctgcacgctccttgttcaacattgccctttcttgtgggaatgtgaagatggcagtaaacacaggaaagaaaccccaaaacacagctatgaaaaacagtaagccggcctgcatacgcaagataaaattgtgttatgatactaatcttcctgcatacccgagctgacatatcattaataagctctctgagtaaccaactccgccatttcacatgaatcacattttctttggcgtaaaatgaatcgcatgattattgctatctatgtacctgatcttgtagaccttttggtgtcgagggatcagagtgccaccatagtagacctaagataactgatgttgctatgacctgggtgattctcatccagctcaaataatcatgtcgccgttctttgatccctctacagaagaggatggaatattgctgccaccagctagtgccccattctcgctttgatgatgttatagttgtcttcatatcgtcactgattggaagtggatctagaagctgcttcttcgccttgtatgccactcgattctcataggcgtctacaagatactgcatgaaatcacatataaattattcagacatctaaaccaaccctcaactcataacaccagcacattgctttcatgtcgtcacctcatgaacatcttgtgctgatggcttgtagtcattcttggtattagtttgcaggttttgattttccatgtgcaccttgtcatctaactcggaaggaacagaaacatcagtagtgtttccgttggcgagatccagtagaaattctgctgggttcattgcgatgagcggggtgcacccaatggactgaaagtagggcatggcttcagatgccttcccaaaatagagcaaacttcctcttcccaggaggataagcttg

SEQ ID NO: 69408 - DNA, 4043 bp, Oryza sativa
  unsure (1)..(4043): unsure at all n locations
tgaagttaattttaagatattttcaacatattttctttttcagcattagcttttaaatcactaagaatatatataaaaaaattatctacaaattaacttttattttctaataaaccgttttaacttattgggaatatgagcaaacggtgaggttttagggctcgcaaataactaattgtaaataatttagttaattgattaattaataatcctggccccggaggaattaattggtgatgccacatcgtgtacgaacaagtgcatgctacggagtaactaattaataattaattaagacgctgcatgcatctattgcacgcgatcagagaggtcagaggatgaaccttcctttgtgttgtgttacctgcggttgagggacttgcagtatggctcgtcgttgtaggagacgcagccttcgacgtcgccggggccggcgaccctcccgccgaggatgctgagcagcgtcgtcttgccgctccccgacgggcccatcagcgccagcacctcgccgggcgccgccgacccggatatcccgctcaggatctccctcggcgtacccttcaccgccaccttgtacttcacctccgcaaactgcacgaacgaaacgagtctcatctcatgtagcattagctcactgaacctctcgcatgccggcggcgtacgtccatggagcttgggataatcgatgcgtttggtcgatttaccttgagatatatcggcaacgtcggctcggtcatcagcttcttgcgcggcgtcccggcctcgatgtccatcgctgcatacgcacagcggcacagagaatgagaatatatatattagggaagtgatttcatctctcaaggagatcggatatccctcgtttcgtctatattatctaaatatctataaaaaaattaaaaaaattagtaacataaattaatataaaatatatcactccacgaaaatacaaatttaaatccaatttttataagtggtaataaaaatgccaaatataactacgaaaggtccgatacccatatgtgcatgcagttaggatcagtaggagtgatgggacgcatactgttgtcgtcgtcgctaaagggatggagctcggcggagcacatggtgtcctggggagaaggggtaaccccggtaaaggtaaagaaaaacccaagcctggcgctgaaggcgcgcctaagggcgccccgctgaacacaaggtcctccatttcgagcttcagctgcgcgctgcgggacttgcggatgtggctgttgttgttgttgctgctgctgtagccgtggctgttcccaccggcgccggcgccgccggacgccgagcgcttcccgaagctggacttgcgcgacaggctcgtcgtcgtcgtcacgtcggccgtgctcagcaccgtctccgccgacgccgtcctgctcagcgactgcgccgacgacggcggcggcggcggcgccagctggtccgacttggtccgctcaatcatcccccctcccgtgtccatcatcggcttctccattatcgactccatgaacgaacacgaacaaactacctagctaacaccgtcacgttcctagcaagcacatttagagcagtagcttttacacgagacgagccgttatatacacagacacagagtgatgggaaggcaacacacgcagctaaggcatttggcaagcgagcgatggaggtcacgcgtgtgaggtggattgtggcgagggcgacgtgggggggaggcagcggaggggcagggggcgcgccagcgaagcgcgatgcgggacgcggggcattaatggagcgggaaagcgcgggtgtggctgggcgcgctcaggcagccagcttccacacatgccggcctcacgacgacgtatcgcgcagggcacccgcgcgagcccccgcctgcggctagcttagcccgcgacagggacgtccccggccacctcgccttcctcgctctctcgctcgcggaggcctcaggcgcgcgcgcgtcccttgcagatcgatccagcgcgcgtgcgtgtgcgttcggtttaggcgtacgtgcgcgcgggcggcagcggcggcaccgatccttttaagtcagcttattggcttatataatttataagccggtggatttaatgtcctaagtttagtggtttagttatacatctaccttacataagccaaaaaaaacttctccaacctagcttttggcttaatagtgttagagtggcttatggcttccaaaaagccaaacggaaaagctgcttgtttgtttaggtttagacttttcgacttataagttggcttataagcctaaacaaagagggccttagcccctccgcacaaattgaggcgctgggtgtgaaacacaaaatgatgacctatttagcaaatgctaacgtaaaataagtgtttagttcacgccaaaattgaaagtttggttgaaattggaacgatgtgacagaaaagttgaaagtttatgtgtgtaggaaagttttaatgtgatggaaaagtgaaaaaaaaagtttggaactaaactcgtcctaagtaaagttcctttaggcgatacatccatatctttacttgatgccatattatttactccatccgtcccaaaataagcacaactatgagtttccgtgtccaactttgatcgttcatcttaattaatttttttttaaaaaaaaataaaaaacataatttacacataaagtactattcatgttttataatcttacaacaacaaaaatactaataaaaaaattaaataagatgtacgatcaaaattggatactgaaactaatggctgtacttattttggaactgggaagtacaattcattgcagggttgctctatctcccgatcgatgctttaatttttctcgatccaaatcactgtcggactgccggtggtcgtttatccacattccatgttagcataaccacgatcaagcatggtcggatggtcctgttcatcggtttacctatgccttctatcaaacaagcagtaattttgcgcgaccaataacagctaactcatcaccacctaattaaaaacagtatagtggccatatgcctagataggatctaggaagaagacttgtgtgcgtcatgatgtagtgatttaatttttcttactaatgttgtgtttagttccacgttaaaattggaagtttgactaaaattagaagaaaaaatattgaaaatttatgtatgtagaaaaaatttgatgtgatggaaaagttgaaagtttgaagaaatagttaggaactaaataaggtctaagcaagatcttcaatatttggaacgcacattcacatcatgatcatgaactatctttgaggtggccattattgtttccaaacacttgtgagggctgagaaaaacaagcatctaattaaattaatgaaggataaagagattttttattaaaataataatatgaacgcgaaaacatgcttagaatgtactaacggcttaggagtgaaatataaaattttcgagccctaggcaatgtacagcccctatatacgatcttctagccataacacaggaaaattcggagcaggcaaaagtcgtcgatcgcagctgcgcaggagtcaggatggacatgcttggcatgatgcctctttctgttttccgtgctcacactgtcgtcacacagtgcaacgattaccatatatcattcgtgaagagaaacacgagtacacgagcggtcgagcatcctaatctcctttttaattttttttttatttttgaaaacaagcatcctaatcttgacgaggatgaaagtatcagcaacggccccaatgctattgttgacaagagatgtgatgtggctgtggctactggctggaatcnggtactgcatgtagatgtactccactccagtaggcagtacgcctgcacagtcttttcctgactgttacggacgcggaaatgtttgtccggagaggagaatggtctctgctaaccggaagaccggaaccaccgaccaatcgggaaacggcgtggcgttgccagtactgattggtactactgggtagtatctttgacctcttggttaatgcact

SEQ ID NO: 69409 - DNA, 7404 bp, Oryza sativa
aaatatgctcgcaataagttatcagcaagtagctgaaaagaattgaacctaagagttgtttctgtacgcaaatgattaggtcatacataccagctccaagaagtcaagaagaggcataggcgaaggacacacaagatattttggagcaggcaaagtcgcatgaattatctgaaaaagcaaaatcggacaacagctgcgaacacagctcttatctgttttctctactccacacggtgcaaacaattactgataactcgtgcaaaatcatcaacacatgcatatcctaattatcttgactaggaccatcatctctaaaaatataagaccccggccccgtgcgaaatgtaaaataggtctctagctagattcatgccaccaaacatactttcactgtttcctcaagcctcatcgaatcttgcatgtcttctgggcttagcgagattaaaaaaaaagaaaataaagcaagattgaagtgaaaccttgaattgagtaagacaactgatattgaattgaggagggaaaaaaatcaccagtttgtgttctgcattcactagacgaaccgaagaaagagtgggctaaattgtgctttctattggttaacatatgggctattttttttttctctctgaagcatggtacttaagcaagtgcattagaattcagggcctcaatttgtagggtgtcctatacagctgatcacctgcccttgctaagctgatcgaaagtattagcagctgagatgggtgttaggtggtgtttacatccagggacataactttagtccttgtctttagacactaatttagagtattaaatatagactacttacaaaactaattacataaataaaagctaattcacgagacaaattttttaagcctaattaatctataattagagaatgtttactgtagcatcacataggctaatcatggattaattagactcattagattcgtctcgcaaattagtccaagattatggatgggttttattaatagtctacgtttaatatttataattaattttcaaacatccgatgtgatagggacttgaaagttttagtcccatctaaacatggccttactgttaacaagagggccctcactgctgttgagtgttgacaagatgtggagtggctggtgcatgtacgtcttcagagtctctttcgaaaattactgacaaggaaatgtttgtctcagaggagaatggtctctctgtgaaccaaagacgggaagcaccgaccaatcgggaaacggcattagccattgacccccttggtttaacgcactctgctgcaccatgtatgacgagacgtacacgtaagggaacgtgcggtaggtagtagtagcaggcaagaaaatatcaggaaaaattcttccttgtgcagtcttgcatgcttgcagggggggtgtgcccgttccctgaagggagtagcactatcgataaatttttcctcagacgtataaatataatataattacagtgttattaaattatatcataatataatttatattaattttttaaaaatctcatggtacacgctatttttcacgaggtaaagttcacaagacgtaatctcctcccgagcacgtgctatgatttttttctaacaatttaaaattatgtgaaagttgcatacaagtttagttttttttaagtagttatatacaagttatatcataactacatagaagttataatataattacattttaattataatgtatttatattaatcgagaaatacttttatagcaaataaatctttcgtggacatgtggatgcagaatctgctcgctgccgccctgttcgtgccatagcgcaacccagctccgctcttgggccggaacgggattccggcctacgtgatccccgttactgttgggccggaacggcattacggcatccgtgcgggccctgttatggttgggccgtaccggggattccgatctccgtgcggccccgggaggggggcgtggtggaggacgaaggcgacggtggcaaaatcggcgacggcgacggcggcggcggcggcgatggcgaaggggagggacgcgcggtgggagtagatactgtagtcgtgcgtgctccggaccagcagcaggtagcggcgcggggaaggaagctactggtgggggacaacccagatccctcgcccgcgactcttctactcgcgctcgcacgccctcgtcggccgcgccgccgccgcggtgatggagtcgccgccggagtcctcctcctcctccccggtcctcctcaacatcggttcgctccccttctccctttcgcaaaaactcgctccccatcccaccgctcgcgtgaatttagaggctgatggtgatggtggtggctatggcgcagggggcaagaggtacgcgaccaccgtcgagacgctcacgcagcgggagcccagctccatgctcgccgccatgttcagcgggaggcacacgctcccccggcacccggacacggtacgccgcgtactcaccagtggagctctcttctcgggagctgtagcctcagaggatgatggtgggtgcagggcatggtgttcgtggacagggacgggaagcacttcaggcatgtcctcaactggctcagggacggcgccgtcccagacatgtcggagtctgagtaccagcagctcctgcgagaagcggagtactaccagttgctcgtaattggaattctcgatcgtttcttcgattcatcagttgcagcttcccaattaaccagccgttgtgaaaacatgatggtttgttttccagggcttggctgattgcataaatgatagattgggttggaaaaatgatgagaatttctcggaggccgaattgacacgcaaagatgtgatcaagtgcatccaagctccgagagtcagatttcgtggtgtaaatctatctggccttgatctatccaaacttgtaaggtctttattgttgttctctattggagttgctcattttttgttatggttattaccactccattctagttgctcttagcaactctgatttcgtgtgtgttcaacagaaatcaataaagcattttattttttttctttagtttcttgtaattttgtgacttttacggtctacaggatttatcagaggtggacttcagctatgcatgcataaagaatgccaatttttcctctgcttatcttcgtaaagcaaagttcagggtatgccattcacacctaagttcttcgttgtttaactgcttttgatgaagtagtagcccttaggaactatgctagttatcataatattttaaggcattttagttctgtcacaaaaaaatatctaagtctttgttttttgtatgactgtcaaatgttgtatcagtaataccttaccttgtatgttcatgacagctgacagaagctacttgttcttcattccaaagtgcaaatttacatgagtaagatggtccaaccagtttcttttagcttatagataggctctaagatgaaacacggtctctccttttttacttttgtgttttttttttgtgttggatgcataagcaagcagctaaccatctatttcctcctttttgtgttatttttgtttcgctgtgttattgtaattgcttgatttggaataacaggtgtgagcttattggagcaaatcttgaaggatctgttctagataaagcaaaccttcaaagtgcaaacctacagggtatgtaatccctttctttacctgtcttccgttttatgttatatgtttccaaaaaatactattatgctcaggattatcctgtttcttcattttcttggcttttgacatccttttcaccagggaagatcatcgtccctgtagtattagacaatgtagctatgcctattttgctttcactctctcctattcagggtgtgcttatattcttgtaaaaactaagtaggaaatgattgagttgctaggcttattttgcagatgcatgcttaaagcaatgttgcttcattgaaacggatcttcgttctgctcatctacaggtttgaaagtttattgtacatggtgtgtttcatgaatgttcccagattctcgcgctgctattctgctaacatattgcattcctggtcagtatacaagaaaaagtgaaaatcatgatgaacattagcataaagcaaagcatttctgtttttttttagaagttagttttctgctgctagaggtgatcgaatatctagtttccatccttgcaatattttgtatcatccaaacttccaaagtttggctgcaaaattttgtccttgcccaaagtattatctgcaacacatagacatatattttgtccgtacaggcttgtatcgtctcttcctgaacatttgaatataaggcataaaggctccctattccaaatggttttcagtaacttaaaatacgttgatatttgggttcttattactcatttcctcagtgtcttattgtcagtccaactggattttcagggtgctaatcttatgggcgccaacttgagtggagctaatcttgaaggggccaatctcaaggtaacaaaaatggccccattcaacctgcactttcatcctgcctgtcatatgtaacttaaggaaagctacttgagggggttaaccacagagctcttacacaaagacagaaaaaatgattctaatgtatccaactcttcttttactgccaagcttgaaataaagtgtctgaagtttgcactaggaaataactctagaagaaaatcaccaggagatgttccaaaggcatgaactgatgctgagatgtgcatgtcatgttttgcttacaaaatattaacaaatagggatttgcgaaagagatggtaatcatcttaattgatgataatgcttgcatataaggttttcttttttgtaaacatgtgatgtttgacatgagtgaaaaggtttcgacctgtagtaagtgtgataacagtgcaaacccgttatacttagaaccatgaaaccatgactgtttgatatgaaatcatggttaatcgtgtactgaagtgtacattaacgaaaggtcattggcattaacaccaatccctcttttcttgtgccttagctgacaacccagttccttgtcctcgctttgttattcaaacttctttatccgtactctaagctagtctgatttgcagggagctaagttggccggtacaaacttggaatgtgcaaatcttcagcgagcctacttgcgagaagttgatttgcgcgaaactgtatgttgtcctgcttgctgcttgcttcttcttttttttcctctctctcttttcagtctaactaaatagtgaacagtgaaagaatctaaacttacttcttaaactatgttttactttgacttacagcatttaactggtgctaagcttggaggtgcaaatctgcttggagctatcagataataccaagggaagaagcttatatcttctacatttacaattaaactgaaactggtgctttggtacctcgaacattatcttgcctgcaccaacggtttgttcatgagtaaatagtttcttgctaccgattctgcagatagtcatacagctttagtcggcggttgtacatatacccttgtcacattcctctgattcgaaattcggtgatgaactgttggatacagctagttgcttagtatcatcatggatagaagctgttctagtaggaaaatttcctgcatactttgggatattgttgtgaacaatgactgaaaattttagtgggaaatatatcttcgttaatgtgcatacaattttcttttcatcatatttactcttcctttaagctttcagtaaaaccgggctcaaaagcgaggaaaatcatattttactcttgttcatgaacctatggaacttttgatgatgtagaaattaccacttgtataggctgcagagatcgatcatagatacaattaactgcaaatcaaatttgtttcggttataatttgcgtgcacagaacacttgcgtttccacacgtattccgaaaggaaacgttggcaataggtagcaatatgtacaaggtgaaggtatcgaacgtgtaagctacgtgcaggcttccgaaacttgcacgtcgtcgttcaggggggctcacgcatgcaggatcacttcagtgtgtcagacgcgcatggcgatcaatggtcggagaagccgatgagaccatgtccgccgtccgccgccgacggatccatcatcagcctgtacttggcgtagaagccggcggcggccaccaacgccagcacgacggcgaggaccaccctccacggcgtcttcctccggccggtcaccaaggcggtgccacccgccgccgccccgtcgttggccgcgccatcgtcatcttcttcttccttgtcctccttctcttgatctgctggtgcagcggtttgctgcgcctgcgcggcgccatgatcggcgggtgcggcggcggcggcggccttgggctcctcttccgccggcgacagcttgggcatggtgatgtggaggacgcggtccctggagtcgaacctggcgcggacgtcgccggcgttgcagtcatcggggacctggaaatccttgtggaagcggctccaccggttgccggagacctgccgctcgccgcttatccgcagcttcccgtggttgtcgatctgcactctcagctgctccttcttgaaccctgcaattgcacccgccatccaaaatgacacatatcaaaccttgcattgcatgaactgagcaataaaaaacaatttgtattcggtctaaaagttggtgttgaaaaacagaatgcgacgaaaaacctctaaaatcaaactgcagttcccaaaattgaaatttaattttgttgcggctcataagcgaagaggtgggaaggaataatgctcttgcctgcggcagataggttgatttgaaggaccttcttgccggcctcctcgaccagctggtgcggcggaacgaagtcggtgtagttgcgcggcgaggtggcggcagcagcggcggcggccatggctgcaggtggtcgatcactgaccggtgatcaggtgctcaggctatgatcactatcaggtgtcgattgatcagttgcaggtgtggtcgagttgatttgagaggaagccggtgttcgtgcacatatatagtgtgtggattcagggttgtttggagtgcgatgcaggaggaaggattgcttcattggacggcgtctgcagggggccggccgcgggaatgaagctaccttgcttaattaatttggttgcgctccctcggtgatataccttgtctagccttcgccaacgcatacagatttcccccacaaggaatctgaaccgtgctgttgttacttgttcttgttctcacagtataagtatttcctgcgattttctgtggtttgttctgggcggcactgtcgggatgtcggcagtcggcacggtaaa

SEQ ID NO: 69410 - DNA, 705 bp, Oryza sativa
attcctgcagcccggaaagcgtacagaaggtactagcgaggaaggtggctctcgtgagaagtatatcagttggagtgatgatgctactcagttcatgcttgagtggtatatagagctccgcaaagacaaacctagtaccttcaagtggaagaaacaacaccaccagcaatgtgctatagctttaaaagacaagtttgggattagagtcaccaaaagccaagtccacaggcacttaaggctatgcaaggaaaaatggagttggatttgtgtagctttagggaaaagtggctatggttttgatgcagcatcatgcaaatttaacattgacccatctgagaaggattcaaacaaacttggtgtaagctatattattgtgcaataatttctgagttataattcatacaagaatgtgctaaatttgtttatttctaactatgtttcttctcatggcagacaactaaatataactacttgactaagcctatcaaattctttcacctctttgaagaattatttgttggttgttcaaaagctgatggttcactagcaattgaccagttcaatgcaaatggtagcagtgatagtgatggcagtggtagcatcaaggagttggaagaatacatatttgcattggaagatggtggccatgattctgacacgatagctcgcaatagtcctactactgatggcacttattcagggcat

SEQ ID NO: 69411 - DNA, 1221 bp, Oryza sativa
cccgggggaggcaaactagacttttgcggagggatttgatttggaaggatttttattcggaattgaactcgacgatagatcggggattgagatcttgagatggcacggacactagacaacaagcaaagaaacaaatttcgcaattagggtttttaggagataattttcccgctaggcgccacgacggaacgggcgctacatactgatcttgagaagacagcagcaatgctggcttggcctgtgcctacttctgttactgaattgaggggatttttgggactgacaggctattacagaaaatttgttcagggttatagtatcatagcacgaccattgacactcttgttgaagaagaaggcctttctttggactgatgctgctcagcttgcttttgatcagttgaagacagctatgagtaacactccagtgttagctttgcccaattttcagcttccttttactttggagaatgatgcatgtgcttatggtcttggtgctgttttaagtcagcagagtcaccctattgcttattatagcaaaactttgggtcctgttaatcagaaattgtccatttacgaaaaagagtttctagctattatgatggctgtggataagtggagatgttatctgcagagaggtccatttatcattaaaacagatcacaaaagcttgtgtcatttggatgatcaaatattggggactgaattacagcaaaaggcaatgactaaattgatgggtttgcaatattctttccaatacaagagaggggttgataatattgttgctgatgctttatctagaatgccttcctcctctcaattttgtgctctttctgtggtccaaccgatctggattcaggaggtgatcaattcttatacagtggatcctcaagctcagcagctactagctgagttggctgtgcattctcctaattctcaagggtattcattgacacaagggattattagattccagaataagatttggattggatccaatgcaggactgcatactaagttgattcaagcttttcatgcttctgcacttggtggccattctgggattgctgctacttatcatcggtttaagaaattatttgcttggcctggtctcaagttggatgttgaaaattttgtgaagcaatgtcaggtttgccaacaggccaaacatgaacactgtcggcttcctggactgttagctcctctcccaattccaaaagag

SEQ ID NO: 69412 - DNA, 4659 bp, Oryza sativa
agagaatggctggggccaacttggcaaaaagaaatcgaatttatctctctccaaactctgtctctcctctgcctcagctctgtttctcttcgtccccaactccgatctcgtctaaatatctctctctcttgtcggcggcgagtttcgcggtggcgtagtgttacagattagtgttgaataatcgttgactagtttaacagtagaaacgagcttttccccttttagtccgaattgcgccatcaagaaagtggaacaatacccgttgttattgccttattggtacccacgcagctcaatatgttcctttcactgcaagaagttttagtttggtttaataatttggtcacttaaacctttccattgttcatgtcgcaacgtagtctgttagtctgaaaatttttcactagcagccttgacaattacttatagtggctttagttagcttactgttgttccatctcctttctgatcaaatttactaggtgcgtctgagtaaggagcgcaatactaacgaggacaggctcagcagcttacctgatgagatactcatcctgattctcgacaagctagatgcacgcacaacaataaccaccactatcctttcaaagcgatggcttaatcttcctcggcgctcccacacatgttacgacttcgccgttgatgacctcctccctccacgctaccacaggttgaagcgactgtggatggaagccaaggcagcgtatgaggcagagaagtcaccatatgtgacaacaaacagggatgctgtgaacctgagcgacttttatgccatgaaggacaagatggatcagtggacgaggaggatccgtccactcacggctgccctggaacgctatgaacgctgggccatgcggcactatgtcaagcgggtggatgcattccttctgccccccgatggtgtgcaccgaactatccaaaagctaaggcttcaaacctttggcaggaagtggaaccaattcattcagcgatgggttactgcagcgattgccaggtggggagttgaggattttgagcttaacgttgaaggccgttgcatcgcctatgacttcaagatacttgatggatgtcagaatttgcagctgaagcggctcgttctgttcaactgccctcccttgggttcatttaattccttgacgtttcagaggctcacgagactctccttgtgtaaaacttcgtactttggattggctaatcggattttgacacattgtgtgcatctattggactttagtatcagatattgtccgggttactgtgctggtggtctccgtatcaatgtcccaacatcaaggttaaagaatctgctggtggacaactgcaaatttgggaaaatctatctgcattcactgccctgtcttgaaacttttgcttgccggggcctactgccttccaagatatactatggcgaggtgcctggacttaggcatgtaggtttggactatctaaaaaccgaaggcgacagcaaagtcgatccaagtgttagcaacagaacatatccactgagcaaattcttgaagaggatcccgccaattgagagccttgttctgcagttcaaaggacctgaggtgagcgatcatacatactcctgaaatgaactaacagactagtcactagtgtatgaactaatagtaatagtgtagtggcctcttgtctctaagtgaaattgcgttgcattttcatgtgtgcaggtgtggattgagccaatagctgtacccgacccgttgcttcatctcaagaagctattcattgcaaacgtaccaattaattgggatatattctggattgtcaccctgcttgatgctgcgccggttttggagtcatgccatgttcatgtatgcactctacaagtctcttttccttaaatatcctcttcaatttttttggaatatatctgtgaattcacacgagaattctcaaaccttagtgcagattgacaacaggtcggaaaatatggcttcttggctagacgtgcaagctcaagatcgtcagtaccattgcctgaaggagctcgttgtcgtcggcttcaatgcagtagggtggcaaatcggctttgtcaggcatgtcatgaaggcgtcgccgaggatgagacgggtgcacttgctcgatgggcatgtcgttgaagacaaggagcgggtgctcgagggattggaggtagtcccacatacgcgggagtggcacgagtttgagagatcagaggtcctcgatgatctctgggatgggaatgggatctgctcgccgcaactggaaataattctggaatgatctgttggcgacaggctaaggtataattgtggaaggtgtcgctaaggctgatactggttcacctgctcggcgggtgtcgactgtcgagtgtcggatttcaggatttgcatcgtctgatattacggagagaatggctgagagcctgagacgcacagtaaaatgtgccaggagctacaatatcttgccataaacacagtaaaaacgctgtgcgaacagtgtcggagtactgttcactcatacggtatcggtttactgttgattaccgtagcgatcgatcacatccggccgcatttaatctaacggctaaaaatgaccaatggtagagagtacggtaggtttttgacaaattcatcactaaattttatgatatcataccttgaatatagagtttcgtgaaaaatatagtgttaatatgtggtttgtaatactacctctttaaatctatagttttataatagtttgataaaagtagaaatagttctataaaatttacttaaataaaaaacggatcagagaagcagccatataatgcttcaaacaaaccaaaaacgagtctcgtgactaatggagtatcaacagtcacaaactcatgacacgataattatttttacatgcccttattgtcaactctcggttattttgtattgagtcaaacaatgcctcatcaagcaaataaataaacaaataacacaattaaacacgtgatttctatccggcacgtaacgtaccccacatctcatggagcagacgcagatccatccaagaaagcgattgtttcgtttatccagggaatacgctaaacgcggtatatttgtaaacgaaaaataatttataatttttttatatatgtgttattaactatctacaaacaaagactgcaaaataaattttgatgggaaaactttaaaattaattttgaatttaaggttgaaaatttaaattttggctgataaacgtaagtactccctccgtattttaatgtatgacattgttgactttttgattaacgtttgaccattcgttttattcaaaaaatttatgcaaatatgaaaatatttatatcatgcttaaagaacatttgatgacgaatcaagtcataataaaataaattataattatataaattttttgaataagacgaatgatcaaacgttggataaaaagtcgagggcgtcataatatagaggtagtataagaaaaaaaaagattgggctaaagatatcgtcaatgatagcttatcgtgacagcgcgcgtcaaacacaacccgcggaggaggggacgtgcacgccgcaccaccaccaccaccaccatccatcaccctcctctcccccgagtcagccacagcccgcctccaaccccaaccaccgcacgcagccgcgccccgtgccgcgcccgtgccgtcgcgtgccgcgcgcccgcgtggcaaaccacccaaccacccccctctcgcagccaatgcgacgcgacgccctcctctcctcttccaaagtcgccatccgtttcgccgagagcccgagcccgagaccaacacaatacagtaatacacaagtacacaacacctccacccattgcggcaaagttggcacgatctctcgctgccttggactcttctagttctagtttagtttgccttctttcttctccgtctcctcctcgcggcggcgcgcatggagcggctgatctccaagtccgtcgccgcccggatccctctgccggggggcggatccccatcccgccgcctcgccgtcgcgggtctcggcggcggcggcggcgtcgagccgtgggcggggaggctacgggcgcagccgcgtctcgggccgatcgcggcgcggccgcacgatggtgtgtcggccccgccgcgggaggccgctccggcggcggcggttggacctccgtggaagttgctgtggagtctgctccccaaggtgactgccccaattttgggttttcttttttttcatctactggaattgcaatgtttggctcgaaaatgatgcgcgcggtagaattgccatggtaggttctcaactagtgctagtcgtagtacttaattgtggtaattatgccccttgagaaagttcgttcagcttgacaaatgacaaccttctgtttgagatcgaatagcatgacacatgcctcgactgggctttgacaatgccacggctgtgtatgggatgagaagagtagtatgctttgtagcaaatgaaagagatctccaaatgaaatgctgtttttgtgttggctctacctctataaatgattaagctggtgttttctggcgcttccatatacttcatatggaaaaatacaaagccaatgcacaagaaaatctttattttagcagaacagaggggaacatgtgagcactcttaattt

SEQ ID NO: 69413 - DNA, 787 bp, Oryza sativa
aggtgactacattatttttcatcagaagcaagggcattatgcttgttttctggtttggttttgtgcatatatgctttggttttttaaaatcgtatttccccatcattattctgatttagtcaacattttgctatatcacaggcttccagagctgctcttttcctattggtggcgcttgttaccggcaccctgcaatctagcattccttatcctgcccatgcatcagtgcaatcaataaccaaaactggtggactatttacatcagagatactaagcagtggttgggctggtttcattgctggatgcttgcataccttgtctgggcctgaccatctcgttgctttggcaccactgtcgattggaagatcaagactggaaagtggactggtcggtgccctttggggttgtggtcatgatgcaggacaagttatttttggcctgctattcttattactcaaggatcgattgcacattgagattctccggacatggggaacaagagtggttggtctgacccttctaatcataggaggtatgggcatccgagaagctacagaggttcaggaatcgtcgctcgccctggaaggcgtggactgcaacataaccagcagtgagcctttacaaacccctgctgctcccaggaagaagaaagttggttttgcaacatttgccactggagttgttcatggtctccaaccagatgctctactgatggtgttgccttcattggcccttccctcacgcttcgctggtgcagcatttcttggcatgtttttgatggggactg

SEQ ID NO: 69414 - DNA, 2863 bp, Oryza sativa
tcaactacttcgagctggtgctggtgaccaacatggccgggagcgggtcgatcgtgagcatgtcggtgaaggggtcatgcacggggtggatccagatgacgaggaattggggcgccaattggcagtgtctcgctggactggccggacaggcgctcagcttcaatgtcacctccaccggcggccagaccatcgtcttcgacgacgccgtgccggcggggtggtcgttcggccaaaccttcagcacctaccaccaattcgactactgattgagctatatatgttcagacatcaggaatatcagatcctcgtctgaaatctgaatgtctatctgatcgatccagcattggtaatctgtttcattgtaagatcgagcattatttgggagtaccattcatttgatcgttttaattgctagtcggtggatgtaaatcaagttgaatccactgctatctttaatcgatgtgaaactgtagtagtaccactgaagatcacattccatcagacttcgattacatcataaaacgtgtaccacatgctgatgacagccgacgagtcatattcctcgatggaagcagagtggcaattaaaggctacgactagagaggctcacgagaaaaatacatgtacaagtacgcaataatatcaacaccaaagccatcaaataattcgagactcgtacacaagaaaactgacaggaagacagcggttgagctgattctgaacgaagcctttcgtgtggaggtgattaccaaacgagacgagctacgcaggacagacagcgtcagccgctgtctggtgatgcatgacagcagagacagctctggggatcgcaacaagagcttttacttgtggacggacgcttgcaaaatccatcgacgatcgtgggacgtggctagctcggcgatcaatccaaaggagtaccaggagactactagctaggagtgtggaaccttatccaacaacacaacaagacaggagaagataaaggccccggattctcacgtaacagcgtgtgttttgcgcttgcgttttttttttttttgacttttttgcgcttgcattcgaatcacgttcctgtatcttcatgtttatgtcttctcatcagtcatccctgcatgcgttcgagagatcaccttttccttttctgggttccaaaagatccgttaaaatttggggcttatttggtttaataccctatcaatatatgttggtagtgccaaactctaggcaagttttggcactacaatattttagtagggtagaattgtaaatgagtgcatttgaatttataccaattgagagccaaattttaaattgtggtgaagaatattctaaaattatgccaaattgagtattggcattaccaaacatttggcttcaaaccaaatcatcacatttgctatttaaaccaccaaaaaattggtatggcaatattttggtatcaaaccaaaacgccccttaatataggcaaaatactgtagagatgcatttgatagtacagtgataaggagcgtattcaatcttcaacacgaaatattgcaccaatagtaacacgctagaagcatatctgaaaattcttggttgaaaaggcagaacaaagaatatatgctgattcactattgttttcaaaaacaaggagctggggcagtgagcgatgaggttgggcggcgaagggatgaggtcgtcggaatccagtaggccagtagtcgtaggccggagagacaaaacaaagatgggcggtgcccctccctcctcgaccaccgctggattttctcatcccagacgtcgcaattatttcactttcccatgacgtggatcctccgcggcatcccccgccgtcgatccggcatcggacgggccgcaccccgcggggccgcgtggatcccacactaatacctaccggtgccacggccaggtcgggcccacgtgccagcttcccctccgcgggacgccagcgcgagcggctttagagcggcgcgggggggtgggccccacaccgggataacaatcgtggccgtccgtgtcgatcggacggtggagggcggtgtgaacaggtggtcgctgcggacttgtctcctctctctctctctctctctctctctctcccttttgtgaccccaccggagaaagcccttcgctgcgtccatccgtggaagggaacggaaagggggaagaagagctgcagcgagcgacgagggcatcgccgcctccgccgccgccgcgcgcgacggtttatcccgtccccgatccgatcgtcgccggggctcctcctcctccaccctcgccgcgggcaatatttggaaccccccagggaagtatctctcaccgccgatcgcctctcatgccgtgctgagtggagcgcctaccgaatccctacccccacccgccgccgccgcagcagctcgtgccgtatcctgtttacagcggtttgtgggtgatggcttccaacgccgaccagcacgcggcggcgaacggtggtggggggacgacgccggctgcgaccggtagcccccctgccgggaagaaggcggcggccgctgcagcgtggaagaggccggggaacggggcggcggtgccggtcgtggtggcgcctgggagccccatcatggacgccgactcatggccggcgctgcccgggctggcgtctccgccgccgacgacgctgacgccgacgccgatgccgcccaaggcatcgcccaaggtggctcctctaccgccacccgctgtaagtgtttgatccagttgattgtagaataatagggggattgaaatttattgccgtttgatgggattgattgggttttcccgttggggaatcatctcaggaggcggtgatcccaccgatctccttggggaattccgg

SEQ ID NO: 69415 - DNA, 1828 bp, Oryza sativa
tggggagggggggggggtattctgcaacaataagactgaagcatccaaaatacaattcatttttctatatgaacaaactttctgcaccttggtaattaagcatttaagttccaagagaatgactacgtctgaggactgaatcatttcccatgaattgttacaagtgttaatgtttttctaaaagaacaaccaggagttataattgcactcaaatgtcagatatgttggctggtcataagcagggcaaagagagaaactagccactggaatgcaaaaagaactgtagaaaagagacaacaaaggtagaggctgactaaacagtgaaaaggttcttaaaagtgctaatgttgttgtaagacaattacacaataggaatgttttgtgatgcagatagttagaataatggaaataaagtgaatttgaagatgctctgagttgtttttgctttgcaccggcacatgggacattccacaatatggaatcatggacacatatttcacatgactatacatggatgattaaaaaaagagagagaaaacttattctatgccataacatcatgcatgtcctgccaaaaaatatatatcaatattcattggccaggaattaaaatagatattttgcttcttttacaactctgactgattctgacttatattgtttcgtgtaggtaaaaaagctgactaataacgtgcagtttatcttggaaacagttctgcaatctaccgtggttgaagtacaggtgatctttaattctcataatttacctttgaagtaatttcatattttgagtttcaaacagacttatctgccatatacaagtgctgtaatttataaatatgcaagtaatattcatgttctgctatgtgcggactgcggaatgtactgctggtttagagcatgtactataaggatttaggtgttgcctccaaaagtgccacataggattaggtgatgaggtgtagagagaggatgagccacccttcatgcaagggacaacctccgcacaatctccaagagaaaaagagagaatgagatagtgtgggagtgaaccaacacaaaaaaaaatgatgtttgtgtattagaggtaatatgttgtacatgttgcctcttaattaatggatagatgacatggctaaaattagaggtagtagccaactctactataagatttgttcttagtgagcagttttttttaagtatttaaacttgatttagtgagcagcttaccattacaaatcttctcttcactagatatttcagaaagggtaaacatgacattcaaatgggctgtaaatggcgtggcatgctgtataaaaggaacattctagggaaatatttttggtttctgatcttcaaactgacattatttagtttcagtttgtaagggatgctgtactttactgatgatctttagagcagcattatttagttccaatactttacattcaaaagcttgttcacctttattacaaccaattgggtagctctttatgctatatctgcatgacatattagtttgcgtgtctacctaggtaactcggcctatatctgcatagcgtcttagcttgtatgcgcacctttggcgtaacgttagtagtaggaatattggagtactcagactgttgtgcatgcccaacttaagtccagttgcatccttgtagaatcttagtccaatcttgtgtgtacattggatctggatccacatgttgaaatgtgcgcacgacgaacattgccatggcgcaaaggaatgcaccattgatttttaaatagtatattttttagcaccctagatgatctcacatgccaggaagcaggccttctctat

SEQ ID NO: 69416 - DNA, 2089 bp, Oryza sativa
ttaacgcaggacttcaaaaatgaattgagagctgtttcattactaagttttacttgccaagttcctttggttaaaacttaatgtatatcacttacaggtacactcttaactgattagccactaggaaaaactgaatgtctctgaacgtaatgctagaacatattacgaggagaatcttatctagtgatagcaaacaagttgtcaataggtgtattcaataatgatcttaaggttttcctatagattggaattgtgatagcttgacaacactgttatttatcattctacttacccgcatattcacttaagttaaaaatatctaaatagtaaccaccaactcatctagaaatcactcatctatcctccttgattagaaatcactgtaataaacttctacagtagtagccttttcttttgtcaatcttctgaaacaatatgacttgaaggaaaatttcgtttagcctgtgacaccccaattgactccccaagacgttagaaacatcatgtacttttggtttcctatcatggcttcttgcttgaaatgagaatgacatgaatatgttttttttttaattctaattcacattttctccatacatctgagttctcgctgtgtttcttgcatacttactttacagggtgacaaattgcggaagcgtgaaagatgggagatctggttgcttccaaaacaaggttattctgctggaaattcttctggttcgctgtcccctgtgacatccaacattgattcactggcatctcagtttcaatctgttggacttgagggggcaggctaccatgcaagtcaaggaatgcccggtgaagctctccttactaggtcagcaacttcagttagtctaggttatcaggcaccccccttgggagggttatacagcaacgggagtggaccactttttgggcagaagtctgcaagaagtttactccggagcgataccttttgaggttttacacaagaaagattacaacggcatgccgagttttctctggttacggcacgcgtacctcatctactggggtgaggagtgaggactaaaatccagttgatttggaagaaaacaaccaaaaaaaggaaataaaacatacaaaaaagagagatagaaatacccaaaaaaatataaaaatataaaaaccaaaaaaatcgaaaaacttaaaaacaagaggaaaaaacatagtaggtagtattatgtgcaggacttatgtattttgtggttgtgctcttgctgggacgtgagtacgtgacattacctgttaagtactcgtttgattgttgctcttttgcagactgagttgttatggatgttgtcagtcggaagctgttaaagacgagacaaacttatttcaaaaaactgatgacattattatcagttgtgcatcttctgctgcccaaattgtgcatatgcattgtatttcttttgaaaatcgtattcatgttatgtatactttatgctgatttggtcgaacgtggacatcgatctgccgctatgaaacatctgccttcttcggcaaaattgctgttatgtgcttctggcacagagatccttcctatttacttgggggaaaaaatcttattcatctctatagttgtgctcaagagtataacaaagttgtgggcaggccattgtatggtctgcaattggtattatctgtgaatgatacgttttattagtaataatgtcccttacgaaactttggtgatatcaaattatgtcattatcaaattttaggaaagtaagacggacatgtgtggtgttaggtttgagacattctggtaaggtttcaacagtagaaactactgaaaatgccacaacttgataagattgtgttgacttggtattgatctagtgaactagtggtagtatgtgttaccttgccaaattttaaatgtcaaaatttaaaattaacatgaaagagaacaagcccgaagatagatcacttctaaccattctatcagtagcaatttattttttaaaaaaaagaaggctaaagttttgcctcgtatatattgatagagcaggaggaaaaaccaaacaaccaaataagttatttacatgtccctgccgtaaaaaaa

SEQ ID NO: 69417 - DNA, 1151 bp, Oryza sativa
gccccaccacctcctcctgctccacgtaacccgtcaccgtcaccttgttctgcttcgcgtccacctccacgctgctcacgcccttcatctcctccactgctttccggaccttcctctcgcacccttcgcagtccatccgaaccttcacctccaccttctgtgtaccattttttttttctagttaacaccccgttccatttcataaaatcataatgtaggaatttatgtgattttacaacttacgcagttgcatttatcgttcaacccaaaaaaaaaaaaaaagctgacgaggaaagatgaaagatcgtagttcaaaaggcgttgtacctggaactgcttgggcttcttcttgagaaggatcttggccggcagcacgcgcagctcggcgatgatgtcgtccacgcccattctctccgatggcggttgttggtatcagtagctcagcacttggaccaatgaaactagccaggatttgggctctcacaatgcctttctttcacaggagggtttaccggtttataggctttccaaacgaagggtatctgatgatcgatgatgccacctttcccaggtacttataccgatagagatggctgtgaaaaggataaacttgagacgcttcttgtgcttctgacgaaaaaacagtgtactgaaaatacaagcagaatgggctgagcgcacgcatctcgcgagtgtaccgtggtagagaatagtaacatggatggacgagtctggattgctctgcatgcttcccaaatcccaactcattagttggaaatggagctctgtccggttgcttctatttggatgtttccacgcgtgataggctttcttttgtgaatcaccttttcgcgaaccttctacgctcctttgctgttttggtcgggccgtgctgtgcatcttttttgtgagatttcattcagttccaccaagcattgtctagacagagagaagaaaaagatctctgttgtgaatcttcctgcatgaagaagccttatacgattcaggctgtgatatatacactacactcgccttcaatgtactatagcacgtctgaaatagctgaatgattttgcgaacaatatagagaaattcacatatataaagttttttgcgaaaatcgcactgttaattcaccattttattcactg

SEQ ID NO: 69418 - DNA, 2477 bp, Oryza sativa
  unsure (1)..(2477): unsure at all n locations
ttcctgcagccccggcgccctcgcccagccgcatgcagcacgagagcgaggcgagctcccccgacgccaccaccccatgccagtgtgccaccgcccgacctcgccggctagggcaggaggcgtgaacggcaccagcgagcccccctctcccttggccctccgactggcttcgccccccctcccccctctctgtccactcctcctgaagtcggtgacaacaaggtgatcttccttgtttctatcgactccctaccactggatccaccaccattagccactagcccactacctcttaactagtcgctttgttttggccccgcagccaatgccagcccaccgccctccttcatccccacggtttcgggggcgctactttgttgcccgcccaattccaccacctactaccagtcttccgccgatcacggccatctctgtaaagctggcggactccccctcttccccctcttcccacccctatcaccccaaccccaatccggatcctaaacagttaggatcgtcgttgttgtccgctagagttcaacaaggtcgttagagttggctaactggagcacggatggcgaagcagatatgaaggttagaagtttgtaagattttacctcctttttttcctatcgaatgtcgaatgtggtttagtaattcaacttattaaaattgtagcagctggaattaccggtttaaccatataaagcttggaattgataggaagtgaaactggagaccagccggtagagggtcgcatccgcgaaaacactgaaacgaggcaccggaaaacacacacagatcacacatgttatgcaagttgtcaaagaaatgttcgcaaaaacaagttgtcaaagaaaggccgaagagatttcttgaaaatgaaatggtttaattggcttgtttgagtgtcacacgggtttgggttgaaccaccgaaggcctacatgcgtagttgggtgagcaagcccaaggatggaaatttggttttgggttgaaccaccgaagcccgaaggcctacatgcgtagttgcgtgagcaagcccaaaggatgaaaatttgcagctcaatcagacgcacacacaaacattttttttttgaaaagaaaagaaaacacacacacaaacagatgaaaatttgcagctcaatcagacacacacacacaaacagtaaggtagcgtaacaggtccggatttagttttcttccatgcatattgctctagtactccctccgtctcattttaagggcaaccataagtttccgcgcctaattttaatcgtccgtcttatttaaaatttgtttataattagtatttttattgctatgagatgataaaacataaataatactttacttgtgacttatatttttaatttttttcaaaatttttcaaataagacaaacggttaaagttggacgcggaaaaccatggcgacggagagagagtagcatatagagagcaccacgcttttaaagcgatctcatacttctagaatcagtaagatggtactaaattttacgtgcatttttttgggcctttgagattttttttcagaaattattgtctaactacatgggcttgcccatataattccaacagtcaaagggtggtgtctagatgaaagagagtacattaattaaatgtatattaagacgcatcaacaatgcatagtacaaagagatatatttgtatagtatccatgatgaagaaactactactagctagcacgtacacatttcatgatatacgggaatactcgtggaatgcaatcttcagtagcaatttcatatcatttaataatgattgccttggatatattgcaacttaatttacatccatcaattagcaactgaacaatcaaatgaattaatgatcccaataaacaatgctcgatcttagagcgctctagcttaattacaaatgaaaacgaagtatgaatgctcgatcgatcagacattcacatttcagacgacgatcttgatgttcctgatgtctgaacatatatagcttagtagtcgaactgctggtaggtgctgaaggtttgcccgaacgaccaccccgccggcacgacgctgtcgaagacgatggtctggccgccggtggaggtgacggtgaaactgagcgcctgaccagccagtccggcgagacactgccaattggcgccccaattcctcgacatctgaatccaccccgtgcttgagcccttcaccgacatgctcgcgatcgacccgctcccggccatgttcgtcaccaacaccagctcgaagtagttcaacccggtgatggtgaatctcactcccccacttctccagcacttcacccttcaatataatccatcacaccacaacgtgttaactatttcatgatatcatgcatatatatatatatatatatatatatatatatatatatatatatatatatatatacacacacacacacacacacacaacttnttcgttttagagtgcttttac

SEQ ID NO: 69419 - DNA, 2958 bp, Oryza sativa
ttgcagatgatgaggtagcattgcccgcacgacgccccgttgttgaacagtggcgtgctcagcgccgcgttgttgatgccgtagccctggcgtacagattcccgtacccgcacgcaccacctgtttgcacacatatgcacatcagcggttaatcccatcgagaccatcccatatgcacttgttccaacatatatattccatcagattgtgtcttgcattatgcatgatgatgcattgccgtgcaatggttgacacaatgcgatgcgagaggaaatggagtagacgacgacgacgtacccatggtgccggagccgtcggcgccgccgtagaacgtggcggtgccctggagccagccggacctcgccggtgcaatgcagagtgcaagaatcgcgagcagctgcaggacaatgttccccatgatttcctgtagctatagctaggtctcctgcgcaggtgcagctagatattgttgggaagaatggatttggaggtgagggatgtgtgcggcattggtggtgcttaaatagtagtaataagatctaggaggtctgaactctgcagagaggcatggattgcataccaattaattaagctagggaatgattgtcgttatgcattattgaagcatgcgaacactgttccaacgatcgcatgcacatggctctgcaaacgccgagagattgactaacgcgtaatgatgcatgattggtttgctggtctaagctctactgtcgtcagaaactgtaagtcgtaccttgaaactgaagtttccaatcgagtagttaaaactgaacagaagtagttgtgacttgtccgcggggaataacagaaatgttccgaacagcagaaatgctcttgatcatttacgcacgcgaatgtcgtttctgctagccatcacgcaagctatagctgaattgaatgttagccatagagtctttctaattacatgtcatgttcacactgtttccgctggctgaggtaacaaactataatacacccttattttataatacatagcgccgttacttttcatataacgtttgatcgtacgtcttattaaaatattatactaaaattagttattttgtggtaacttattttatcatcaaataaatttaatcttaacttaaaattttacatatttatattaaatttttttgaataagacgaatagtcaaatattataaaaaagtcaatgacatgatacatttaaaaaaggagatagtatttccattttctacagatcggaaatgaaatcctcaatcagaaatatttcacgccaaaaagatgcatccgctcatttactggctacctaaattcttttcttgatttttttattagtaccggatattttaagttcttaattggataagcaagtagatggaatggaaagaaagtaggaatatttcatttcttaattaattgttctttcagtgctgtctaattaactacaggctcaactcccttgaacccttttacaaccgcagcttctttttcctcttccaagttccaactactcattatctaaaaaaaagttccaactactggcgagacattgaaatagtcaaataatttgcatcatcttgttcagtgctcgaggtcaaccaacaagaaccgtatgatcaatatagtaaaatacaacattctttatgaatttcttgttctgatgagttctagtgcaactagtaattaaacggcatacgctgtgagcacaaattctgcacatactcggaaataccggttggtatgttataccttgcttcgttgagtacataactaaccattttgttcattatgggtatccgattcacatctgcacccgccattgcaatcataattatttgagtaatatagcacaatgtttatcatttttttgcataatcaatttataccacatttgctccaaatataagcacttccgtgtgtttcctaaaatatatctgaaggaggacgtctagtttttttaaaaaaaaaacgcatagaaatagttatattttggaacaggcaacaagtattaaaccatcgattaatacactttcaaggttgatagtacttatcgtctttgacaagaacatgatctcaaaaaataatcctgaccatttttttctatataatatacataaaaatatcaacaaatatatgattttattgatgtacatttgaagtctaatttacacttatggtctctatatttttaagacaaatattttagttctggtatgttggcaattgtggaaggaacgaaactccatgtttactctctcttcggtactagtggttctagagtctatggtcgttaactggtgttgtttcttttggggttttcttgatagggtagtgtaacgctccgcttttcgtgagacattaaaaactaattcggcaaaatcctaattgcgaaaattttcgttttttgagtgagagtctaagtcgtgccatggatctcaattcaatcccgttgttccctctcatcgaaatcaaaatcctctgcctcaaatttcctcttccaattcaagtctccgaaatctaattccgaaagtcaatcccttcctttgaatcctcgtcaaatacatttccgaatcccaaaatatccaaactcctgttttgtttccttccttgactccttgaacccttgtgtacaaagtatcaaatttagattcaaaacccaaactccaaatctctccaaatcaaaatctttcagcaaaagtctatgcctcccttgtcgatgggcggattcctctctctcccggcccatcccctcctctcggcccagctctcacgcacgtgcgtcgcacgtgttcgggagtgagagacagcgccgactcctttctctctctctctcgacgtcgcttcccgccgacgccaccccaaaattctggccgcgtcgccgtttcccgcgcgctcgcgcatggccgaccggcaaggacgccgctcccaccgccttcgcccttcccgcgcagg

SEQ ID NO: 69420 - DNA, 2832 bp, Oryza sativa
tcatcggtctgtatgcatcataaaatgtgtatgtgctagtggtttcttcggccccgtttggcacagctctagctcccaactccaacttacctagagttagagctgtgccaaacggtacagatcctccattttttgagtggagctagttgagctactcatagaaaatgaactacgggggttaggggtggacagaaaaagaccgaaccgaaaagaccgaaaccgaaaaattcggtcctaggtagtgaaagaccgaattttgttcggtcaatttggttagtctcctcggttaaccgaatagaccgaaatatcaaaaaattctaaatgcaacctacaatccactatatttaataggattaaactctaattttcacatccctacttcttctaggcatgcaacctaataaaagtctttactcataagtgcttaacgaatttttttgtgatttttgtgttgaaaatttccattttttctttgcatatatgaaaatattgttgaatttcggtcaggagcgagaccgagaccgaatttatcggtcctgactttttgcgctgaaattcggttttcatttttcaaagaccgaaaagaacgaaagaccgaagaccaagaccgaaattttcggttagaccgaatgcccacccctaacggggatggagctggatttttgctgctccacagctccactctaccccaaaagacccactaccctttaattttttagtctatttatacaaaaatgccactcaactgctctttcagtcctcctctcctcccccatcttcctcccgatccaaaccgagctgcatgcggggagcggtggcgtcggtgggtagcggcgacaggccgaaggcgcgcggaagacgacatgcggccggcggcggccggcgcgcctggggacggcgcacggccggcgggccggcggcggatgcggaggaggatgacagagcggcggtcttcttcaacccaggcatgggctctgggcgcaagggtggccggttgtttgtgcctgggtgtcacgccccgaactagtcccgaccggaactagcccgtgacgctccaaattaacctgttaatcgataccagtcccaggaaacagtgttggtatcacagggagacagaatatcacagcaacagaggtctctttattatagagtaggagtacagtcatgttgggctgcggacagatcccgagctcacaactgcattacaaaagggaaagcggaaaccaagacttgggccaaacatcacaggcgcgacttgggaactaggtcgaaaccctaaaactcatcgtagccgacttgctcctagaagaactcctcgtcagcgggggccacatcatcttcttcagcaactggggggggttatttatatagagcaagggtgagtacatgagtactcagctagccatgggaattaagtgtttaatgcaggcttcaaaggaaaggctattgtttttgcaattgattttatttaaactcttttttgaaacgactaggtgagtgcttctcaaatgacacggatgagacagtgcgtctcgtccggtcggagtatgtgcaatgtatcagtctttgaattgatcaaggttagcacccggccaacagctttcaaacggccacccgggcctggctgatcccatcagccgccgattttccaaacatcgaacccattccacagcagtaatttcacaagcagtagtcaaacaaaactacgctaggaatcacctcacatccgcccatgactgtgagcacggctgttcgaacagtttgttaacctctgcagagggggtacaccttacccacacgacgttactagccttggtcacccagcccgtgcataacagccacgtctggtgactttggggctttcacgacaaggcatttcgaaagccgacacaggttcaccgtatgccaacgagaggggtcccagactaacaccagattaggtcccagaccatactgtgccaggaagcccgggggttctccccgacaccaccccgttgaatccacatgtctcttggcatcaaggctcccccgattagcaatttactcagctaggggtgtcccatttcacccatgtggtcgcacttgtcttatgttcggatgtaattccaaggaaacggtccttaagtgcaagagcgggaaaccgtactcccggtacgttccccggtccgcgaatttgaaaattcatttagttcgcaagagccgacccaggtgtcgggtttttccaagtcttttgtaaaacccaagttttacccatcattggatatttttaaatttgaggagaggtgtcccgatgcgcgtgcttgaaggcccgtgcatcgaagcacaacagtcgacaaagggggtttaagtgttcaataattcaaggagggtaattgcagcaattaggattggggggccggcaggttatctcgcaagccacggccgaattacttgtgtaaatcctattcatgcattatttgcggaaaagaaatacttagatttaaattataggtgcaagatgatcaaaggtgacttgccttgctcgagatcttgagcttgatcctcaaaatcctcgcactgcgggtcttcgggctccgaaactacacgagaaatgggacaacacaacaaacggcgaaaataaagccctactattgacctctaggcgtgccattagatagatctcgagatttaaggaattttggaagttgaacggagtcaaacgggcttacggttgggaagatattgaatttctaagattattggattttttgtctaaaggaaaaggatttatttaaatcctttttgaaaaaaaaaggaaaagaaaagaaagagggagggaaattagacttcgca

SEQ ID NO: 69421 - DNA, 3551 bp, Oryza sativa
gcaagggtgaccggttgtttgtgcctgggtgtcacgccccgaactagtcccgcccggaactagcccgtgacgctccaaatttaacctgttaatcgatgccagtcccaggaaacagtgttggtatcacagggagacagaatatcacagcaacagaggtctctttattatagagtaggagtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggaattatttatatagagcaagggtgagtacgggggtactcagcaagccaggggaaataagtgtttaatgcaggcttcaaggagaggctgttgtttttgcaattgattttatttgaactccttttttctaaaaacgactaagtgagtgcttctcaaacgacacggatgagacagtgcgtctcgtccggtcggagtatgtgcaatgtatcaatctttagatcttgaaacaaggttggctcccggccaacagcttttcaaacggccacccgggccaacaacttttcaaacggccacccgggccaacaacatttcaaacggccacccgggcctagctgatcccgtcagctgctgatttttcaaacatcgaacccattttctcaacagcaatttcacaagcggtagtcaaacaaaactacgctaggaatcacctcacatccgcccatgaccgtgggcatggctgttcgaatagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaagggtgtcccattccacccatgtggtcgtacttgtcttatgtttggatgaaattccaaggaaacggtccttaagtgcaagagcgggaaaccgtacacctggtacgttccccggtccgcggttttggaaattcatttagttcacaagcaccgacccaggtgtcgggttttccaagtcttttgtaaaactcccgttttacccaaattgttactcagattttaagtttgaaggcgaccgtcgatactcgcacagagtgcacgaatatcgaggcgcaactgggtggttacaaggggacatggtatggcaattaacaatcgaaggatcaaatgcaacaagtcaggtaggtccaccaatctgccttgcagatgggacaaaagattaagtgcggtcctatcaatacataatatttttcaagcaatataattaaatttcaattataggctcaagatgttcaaaggtggcttgccttgctcgagatctggagcttgatcctcgaaatcctcgcactgcgggtcttcgggctctgaaactacacgcgaaacggaacaactcaacaaacggcgaaaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttaattaaatcctttttggaaaagaaaaagaaaagaagggagaggggggaatatagacttttctcgggcggctagggtgcggcccaagagatttggggcggctcggccgagcttaacgggccggccggcccaagacggcccaagcgcgcgcgcgcgggagggaggagagagagtccggtggaccgggctcaccacgcgtggccccgggtgggacccgcttgtcagcggctcggctcaccgtgcggagggagcacgcggcgcacgcgcgcgggcggggaggaacgcggtgcacgcgcgcggtccgcggcggacgcaggtgcggcgggcccacgcgcagcctcacggcttgcggtggaatgcgcgcacgcggagggaccgaccggggtcggcccgacccggtctgggctgagctggcgccgacgtggcgcctacgtggccgccacgcggaccggcgggaggtagacgacgatccggccgcgaatggacggcgggcggcggcggcgagcggcggagcgaaccacggtgatacgggcaaaagcgagcacaccgggcggttacacgagacgaggggagacgaaccaacggctcggatttgccgggggttgctcgacggcggcggattgcggcgtcggcaaccggcggcgggagaagagggaaacggcgacgaggccacgagaggtcgattcccggcggtgagagcatctatgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactacgggaaggctactcaagctactaccgaaagctaggggaaggagatggagcgaggaggaagaacggagagagacatcaccgagaagaggaggggcgctgtgatgagaggccgacggcgcgggagtaatctctccggcctcgggccggggaagaggaaggagagggtgcggccggagtcctcttccgcgtccttgctcgtgccggctcctccgacacgcgcaacgacgatcggcgacggcgaaacagagggcggcaatggcgcggaggcgaaaaatgagggagtttggagggggagggcttgggcttaaatggacggcaatgtcggtttgggagaggggaaccggcattgaacggtcaaggcgcgagctggcgctcggcgcttgcagccaaagcggcggcaggaggatgacgccggcgaggagaaagaaaaggggaaaaaagagggggagaaaggggcttgcccctttgccgattcgggaaaaagggggggagcgggagcatcgcggcagaggtaggaggggctcggctccgtcccttggcggcttgcgcgcggagtggcgggggccgggcgatgacgacggtgatgacgggggggacggcttggagcggagcggcgacaccggcgacaggcgcgcgcagaggctgacggtggcggcgaccgggcggtcgaccactcggctcgcgcgcgcggcttgcaacgggcggcgtccgcgcgggcgcgcgcacgcgaacacggcgcgcgggaagcggctttgcgagcagggagctcgcgcgaggggagggggcgcccggcgcgggcgactcccccgcacgcgcgagcagcgtgcgggcgaggctgagcggg

SEQ ID NO: 69422 - DNA, 3293 bp, Oryza sativa
attcctgcagccccacttgtattcctgtgagaatcctatgtttttcctattccttcgtttttttcattcctatgatttaaagggggctaagtgttggaattatatgtgctaaatccatgtagttagacaatagtttctaaaagaaaaaaaatcaaggcccatcacatgaaaggatgcacgtgaactttagtatcagcttactaattctatgaatatgagatcactttttttaaagtgcggtgctctctatgttactagagcaatatggatgagagataactttaagaaaagcgcaccttaaccactcacttcacggagttttgtcatgttgtcttagagtggctagaaattcaaaccgggtatgctaccttattcttttctgcttaatggatagattgattaacgatacgtttgctaaactgctaaacgatacaatgtttgtccctttttgcatgttaacatgtgagggaggatgttcatatggaccagaggatccaattgcctacgtacatgtccttttattgggcaattgactatatgtgatttatggactatgagtccatgattaacgacacgttcggcttaactctcgggcccaggcatgctggtaggccttcgatggttcggcccaaatccgtgcgacactcaaacaagttaagccatttcattttcaagaaatctcttcggtctttctgacagtttttttttcttttgcgaacatttctttgacaatttgctaacgtgtgtgatctgtatgtgttttccagtgcctcgttgcagtgttttcgcggatgcggctccatgagatgctaccggctggtctccgatctccactccttatcatttcactcagtcaatttcaagtttctgtacgaaacctttatatggttaaactggtaaatctaacagctacaattttcataaatcttttcttagatgtatcaggtactcttttataattcgatcggcctaaccaagctattctgtctaaagaaacttgcaaaaattaaaacaaaccaaaaacatgtcaaacgatataatgcttgaggttaatcattctgttccaggaatattgtgctcaacttccatacgaaaaggaacttaaatatatacagggtgaattgctgttctgcacatgtctgaaaaaaaacttgcactataatcggtttgccgttgcatgattatcgttagagcagctgcttcagttgaaacttgatactaaacgacttacatggtggtgtactatattaattaatctattactataatctatcgatcgggcaaacaatgagtattactcaattaattatgactgcaatagagcaatggcggatacagatgtgaattgaatatgccccctgaatgaacagaacggttagttatgtgttcaaagaagcaaggtataaaattattgctattgtacgtgcaatgaagagtgcagaccttgcgctcccactaatcgtagtggaattcatcagcaaaataaataaatcatatagaaatagagtttttttactattttcatcatacgattcttgttggttgacctcaagcactgaacaagataatgcaaattatttggctatttcaatgtctggctcgccagtagttggaacttgggagagaaaaaaataagcagcggctgcaaagggttcaagggagttgagcctgttgtagttaggtggtactgaaaggataattgattcagaaaagtgaaatactccaacgtcctttccattccaacttctcgcttgtccaattaagaactttgaaaaattccgtactaattaagaatttcacggaacgaatttaggtagccaataaatgagcagatgcatatttttttattacaaattaaaactgattgagaatttctcgttgagaaatctgtgtgtgaaatatttctgatttagaatttcatctctggctggtaaaactgatatattacagtttggcacatcaggaagtatatttaattttttttaagatgatggatagaaatccgatcctatattcacacacatacttaaagattacatgggtacttaaggcacattctaaagagataattgagcttaactactactcgttttctattagcatgttttttaaactattaaacgatgtatttcgtgcaaaactttctatattaaaaatactaccttttcaaaataaaataatttgatttatattttttaataattaatacttaattaattatatgctaataaagtttttattttgcgtgtcgctaaataagacaaaacgttaagctggaaagaacgtgtcctaacactccaaatcccataactgacacaaaagaggaaaaacaacaataagaaagataaattttacagttcctaagatgtactgtatcaaaacttttaatgcaaacttagctcctctcggtacctacttaactactataaaatcactaaaagaaaaggtaaacacgatatgtagttagaaagattgtatggctaacattcagtttagctatgcatgcttgactagcatagaaacattcgcaagcatgcatgttcagagcatttctgttcttgctgcgaaaacgcaacgacttgtgttcagattgaactgaataatgctaatatacgacttatcatttctgatggaggaaacggtacgtagagcttagaccagcaaaccaattaatcatcatttcgcataagtcaatttctggacgttgcagagccatcagccatgtgcaacgatcgttggaacagtgatcgcatttttcaataatgcctacgacaatcattcccttgcaatatgtaatccacgcctctgcatgcaggcctcctagatcatagtactatataagcaccaccattgccgcatacatccctcacctccaaatccattcatcacaacaatatctagctagctagttatctagcttaattactctcgatcgactgcacaggctcaacctagctaagaggaaatggggaacattttcctgcagctgctcgccgttgttgcactctgcattgcaccggcgaggtcggactggctcccgggcaccgccacgttctacggcggcgccgacggctccggcaccatgggtacgtatacgtcgtctactccacatacggcccaaatgtccgactcacgtacgactgaatttgatttatttgattgccatggattaaccggatgcatgtgcgtatgtgtgcatacaggtggtgcgtgcgggtacgggaacctgtacgaccaggggtacggcatcaacaacgcagcgctgagcacgccgctgttcaacgacggcgcgt

SEQ ID NO: 69423 - DNA, 1090 bp, Oryza sativa
gtagcaaacagaggagatcatggggaacattctcctgcagctgctcgccgttgttgcactctgcattgcaccggcgaggtcggactggctcccgggcaccgccacgttctacggcggcgccgacggctccggcaccatgggtacgtcgtcgtctgctccaccctctggaatagcattgtcaattatgattgacaaatgacaatgttgcatgcatgcatacgtgtactttctctattctaaaataaatcaaactaaggcgaaccttactccccagcacgcaaaataaagtagcgtttagcacatcattaattaagtattagctaaaataaatttaaaaatagattaatatgacttttgaaagtaactttcgtatacaaaatttttgcaaaatctataccgtttagtagcttgaaaaacgtgcgagcggaaaacgagagaggtgagttaggaaagtagagataagaactcagccctaatgtgggatgtaacatctaagctcctagtactaagggtgtgtttagttcacgccaaaattgaaagtttggttaaaattggaatgatgtgatggaaaagttggaagtttacgtgtgtaggaaagttttgatgtgatggaaaagttggaagtttgaagagaaaatttgaaactaaacacgacgtaagatattattcaaatttgtagtattaagatatgtaacattttataataataatagattgatttattttgaaacgaaggaagtacgtcatatgcaacctgaacttgtgacagaatatttgggtgcatctgtacttgcaggtggcgcgtgcgggtacggcaacctgtacgaccagcgctacggcatcaacaacgcagcgctgagcacgccgctgttcaacgacggcgcgtcgtgcgggcagtgctacctcatcatctgcgactacggcaaggcgcccgactggtgcaagctcggcaaggcgatcaccgtgacgggcaccaactacggcggctggtgcaacgcgacccgcccttactcgacatgtcccagcctgcctgggagaacattggcatctacagcgctggcatcgtccccatcctctacgggctgcagga

SEQ ID NO: 69424 - DNA, 2243 bp, Oryza sativa
catatgtccaaaacaatctgaatactataatttctaaccagtcactgtaaccatgtcctgataccattagtaatatattatagcaattattctattcggtgcatgattcatacgtaatccttatagctcgtcgggagtcaggactcaggactagaaatggcaagagtaactaatacggggtcatggcttaattacaggacattggacagaagtgttgatgaattagttgcagactttgagctcggtttgaagactgctgcggtggataactattcaagaagacttgtcgagttctgtatccttcaggcgctgcaagttgttacatctgttgatctaggagacaagatccatgatggatcgcttagtcggttcacatttgatatgatgctggcttgggagacacccactccttcagatcaacaagttaccatggtttgtgatttttttatatttgtgtgaaattgtgtgtttgtgttcttctgaaatctgatctaaactgaccaatatggtgacattacaggagagcatagctaaagaaagagaggataagaaggagccgctcggagcaaatgaagctgtcatgggcgatgagacctcactgttctattcagatatcatgcctcttctcgtatgttaacacatagctgattaaattcctttccgtaaaatttcttcaagctattcatcggtaatgatgtttcaggtgaatgaagaaccaacagttggagaagatgcatatgtgtggtttggatctgtatttcctttggcgtgcgatgttatcaatgctcgattcacctttgaagccctgactgctacaaccgctaataggcttcattatcctgcttacgacaaattcctgaaagaaatggacaagtatgcaaccacttcacagttagatcttttttgcaaacataagcaacattgcatttcctctgttttttaatggataactccattgacttttgatgtgatatttgactattcgtcttattcaaaacagtagtgcaaatatgcaaaaaaatttaagtcaaccttaaaagtttttaatgataaaacaaatcataacaaaataaacgatactgatataatatttttgaataagacaaatagtcaaatggaatgccaaaagtcaacactttcatacctccctgctagatgtcgttcttcttctttttttttaacaaactggtagaactgcaaattatactgataaagcatgagaaaatgatacaaaatatagaacactgaccaccagtccaccacatcctgatggatgccatgtgaaattgacttttttttaggtcttccgaattcttgcagaaggtgtcaactccaaccggaactgaacttgctgaagatgaattcatcttgcacatcgagggaacagcaggaacacaaagggtggtgcggcacattggaaccactagttggccaggtcatcaatctgatcaagagttatattatttctggtttcttcaggtcttagcattttacgttgatgctttggtaacattttcttatgaatgctacattggttgtatactatacaggcaggctgactctgacaaacaaggcattgtattttgaggcttctgggaaaatttcatacgaacctgctttcaaagtcgaacttacaggcagtgaaataggaaaacaagttaaaactacttcaactggtccttttggtgcaccattgtttgacaaaggcatcgaatttgaactgtgagttccctcttgcatttcttatttttgtgttcatatggacaacctacacggatcaattctttttgttattaaaattatcactttgccccttttgcaaagaatatcgacagtaaccattcatctatgcagaccagaacctttggttttggagtttcctgagatgaccagctcaacaaggcgcaatatgtggcttaccctgataagggaagtaatattccttcaccgattcatatcaatgtacagcatagactcccccattcacaaatgggaggtgcattcgagaatcatattgggggtgataaggcttcatgctgcaagagagatgctaaggatgtcgccaccgcctccttctagcttcctagtattctcgctttacgatgagcttcctaaaggtgattttgtgcttgaacaactagcaaataatctgaaagagacgtcaacgataactccgctcagtgcatcccatgtgttcaagggtttgagcaagtcgcatcgggtagctttaagtgcggagatag

SEQ ID NO: 69425 - DNA, 1008 bp, Oryza sativa
  unsure (1)..(1008): unsure at all n locations
ttcctgcagccctccaaaagataatctcatgggagaaaccacttgtgactatcagtgtccttgccatgatggtgttaaccatatacaggttagatttatacaccgcatttaatttcaacatacattttactcttggaaacgatcagggaacatgagatgcaaggtccctttttttttcaacatgatgcagagagtgggtcggttttgcgttagcggcatccttgatactggcagcaggattcatggtttgggctagacaaagaaaaatcggtgcactatgctcagaggtgatcatcgacacttcatcggacaagacgacgatggaaagcctagtggaagcacagcaaagcctgaaaagagtgcacgagtacatcaagacagcaaatgtcgtgatcctccgagtatcgtcgatcgcgttagcgaggtcaccaaaggtatcaatatcatcagagttcatcacacacgttctccgatcaccgaatcgttccaccgttgcgattcatttccatgtcatgttaacgcgttccttcatcatcatggtgtggaactctggataattttctgagtttgcagcatacagaaacggtgatatggatgctgacagggttggcgctggcgctggccgtgatcccgttcaaatacgtcctgatcggggtgatggccggcggcttcatgtcgaacacgaggatcgcgagagccatgtcgaacccgcagggaagccggcggtggagggagtggtgggagagcatacctgccgtcccagttcgggcggttgacgggggtggtctgtgaagtgttcgacgaaatgccggcagaaaaatcctcggtattgttcagctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69426 - DNA, 724 bp, Oryza sativa
tcctgcagcccagatcgacgcagctcagcctcgatcccaatcactgtcaagtcagcgtggcgactgatgaggagcaccactagcactgttccatttgtaagtactctgctagctactagcacaagcaaagcgatgcagggatcagctagggattcgtcagcttggccgtgctgataatataggaaatgcccttggtttacaggtctttcattggacgcaccggcgacggctttccccatgtggtgttcgccggggttagcgattttgatacatatatctggcaggtgaaggtgctgcgccgtcgagatgcgcgcgcggcgacttttcggcgcgtcaaacacgagaagcatatagaaggaatagaatagttacatggagctggtctttagccaaattctcctgaaatgggaaagcctatgggagaagcgcagatgtcaaccatcgacccttgcattatttggaaaattctaagcttagggctaatagcagtaggagagtgtggagtgtggtatggtcgaagcgtacaggccggtacatgggactgatggtcccatggctatggaggtctaggctggctttttctagcaagatatcatattattgtacaagcttcagctctcaaagatgggtggagatttggtggtcctgaaggaatgttcatcggcaagaatgcgtttttagtaggactagtgttcatcttgcctgcagcttttgttggcacact

SEQ ID NO: 69427 - DNA, 5010 bp, Oryza sativa
gctagggaacacaagaactaaagtggaatggctaaagaatgagctggggtcgagttggctaaatataacggctaggtgacgtcatctagccgttactcacatatttgaactggagggttgccaggaggttccgggcctgggtgccaggaacttccgggtaacacttaggaaaattttcaacctcacctcagcgccaggaagttctggacagaacctccgggtgggactctctgtcccaagtagagccattttcaaaaacagctcctaaaaatatttcaacacttggacactactaagagcacttgtgttatctcagaaccacacttggaacccctcttaatagaacggcttttcctaaattcaaagcgaaaaagtaaactagtctaactcggccccgagtcttctcgccgctttgattttgatgatttgggggggtctccaagcatcctagcccactcctaagcaacctgggactaatacaccactaggaatgtcatcttcttgcttcaccttgagggttctcaacgtcaacgccatttcactattaagactattctcacctacactcattaagcatattagtcccaaatcaattatatctttgccttgatcaatgcccactttggattttgacttgatgttcatcgaagaaccacatcctcttgatcctcggcattccatcttgcggtcttcttataattgatacggattactcataacttcaaatggcctcgcacggtccatcatgaccatcatgacaaaagccttcactcgcccttcaccaccggattcggtccatcggcgccaagcctcttgcttgcccttcaccccccgcatggtccattatagccgagccttgcttgcccttcaccgttttgccataaataaccacttcataccccgcatcatcaatgtcttcacttgctcctcatcaaggtataatgtccatcttctagccgagccttgctttctcttcaccggtttgccatagatagccatttcataccccgcatcatcaatgtcttcacttgctactcattaaggtataatgtccatcttctagcttcaatcttttaacttgatgccggaacttaacctaatctcaccaactcatggaaatagttagttccaacaatgggttgtcattaatcaccaaaacaatcaccgcactcttaggatcatagatattccaatctccccttacaaggcaattctagtgcatagatctttcaaaattgtctaactcttaagttcacgttaagatgctattcatttaggatgaattaaggttgcacagagagattcattgcgcagcaaagagagacaaaacgagatccttcgttcattaagatttgtaaacaaagagggaacaccagtagggaacttaatatatcagagtaaaagaaatttacttacaaataattaactcatccatacgattttaattcccagaaggtagaatagcattgaattgcaggtaaattcagaaccgtagttttctttaacaccatgatcaaaactctagtaaatttggaattacgcaaatcttacactgcaaaatctcaccagtggaccagcaattatctcatctcaaccctatagaacacgtacgatcaaggagcaaacataaataagatcccctaattaatacaaaacgatcactctaataacactactagtcttactactaattaatattttgatagcaaagtgtcacagcttcagcttcaacttcgcatcagtctccactcttcttcttcttcttctccgactgctcgtcgccgccgcggcctggccccttctgctgccgctgcgctgccggcggcggctcgtcgcgcgacttggagaccatcatccccattgccggcgtcgcgtataacctctccttcgccctctccttgcgtgcgcattgcttccttctggaggagttgtacgtcgtccccgacgcgcgctgcagtccgtgcgagctcatgccggcgagcatgcgcgcgcggccggcgcgctcgtaccgcggcgcgtcctccacctcctcctcgagctcgcacaggtcgtccgccagctcgtcgcacatcacgtcgccggcgaaccccggcgccgacgcctccaccgcctcccggcgaagctggagcgtccgcgccgcctcggcgtggtcgccgcgctcggccgccgcccgcgcgatcgcgatgtcctcggttgcctccacgcgcacgcgctcccgttccacctccatggacacctcctggtccgccgcggacacttccaggggccgcctcacgacggcgtcctcgccggcggcgacgtcgatggttcgcccggtcaccgtgtcgcggtacgtgcagctgagcttgatcagctgggtggcgtcctccgtggcttcggcgatcggcacgttgatgaacaggaggaagcgccgctcctcgtcggcgtagagctcgccgacttcgaccgacgcggcgcgggcccgtccgcgtcgacgcggctctcgtagcgccccgacttgatctcccggacgagcacgcccgggctcgagcacgccacggcgatgcgcgcgtcctgcacggcgacggaaaggagccctccgatgcactgcgcgaacgagtcctggatggccgcctcgttctcgacgaaggagaacgtgccgcccgtcgactccgcgatggtgttcatcgccgccgcgtcgtggtcggcgccgaagccgaacgtgtggatcggcgcgagctggccgcggccgccggaagacgcgaacgaaggcggcacgaggtccatgtaactcatgccattgccgcgcctcgggacgacgtacgagtccttcccgtcggacaggaggatgacgctcgagacggcgttcttgtgccggcggtcgccgagaacgcggccggccacgcggaggccgtcgccgatgttcgtggcggagtcatcgacgagggactcgacggcgcgcttcgccgtggccttcccgacctccgacatgcggaggagccgcgtccggcggctcgcctcagtcgagaaggagacgacgcagaggcggtcggcggggccgaggttgtcgatgacgaaccccatggccttcttcaccaacgccagcttcctccccgccatgctcccgctcacgtcgagcaccgtcacgaggtcgagcggcgcgcgcgacgccgccgccgccgcggccccggccgccttggcgtgcacgagcacggcgaacttgtcccgggacgcgcccctcgccacggccgggtactcgcagtgcgccttgaccaccaatccagccgcggcatcgccgtcagtcgccgccgcctgctcgccggccggctccaccggatcgtcgtcggcgtacaggggaggctcgtcgtcgtcatcaggctccaccgccgcggccgacgacgaggacagcgccggcacgtcgctccagcgcgcgttgcagagcgggcagacgcggcggccgtgcgcgacgttccgggcgatgcagcggttgtggaaggtgtgggagcactccgccgtgaagatggcctgcccgccggcgatctcgccgaggcagatggcgcacggatcggtctctctctccatgggtacgaccgtacgacgaagtgacgaacagttgggacctctggtagcttcctcgtgcgaaaccctaacgatagatgcgagtctttataactgcggcgacttcaattaaggagatagatagcatccgtgcacttcaagtgcaaggtttgttttttttttttgaataaagttaagttcaaggaattaactgaagagaacattccaattaacacgtatctccactcataacactctcaattaaattttaggccttgtttggatgtaccacgttcctggcccatagacgtttttgtgccaagataggggaccaatcggattggagtaagttcactttaggtcctcatgttgacatcgagtttaaatcactcttaaccgcaaaaccaaatataactagaggtcaggaacagtattgtactattgtgtctagttccgactgacatagtgacatggcatgttaattatgatcaacccggctaattcagtgtgaaaccctggtggcaggggctatcgtcctctacccctcaactcctcaggtgcgtcgaggttgaaaaattacattaggctaggcacataacatttgacaacggttttttttcctttggcacgtgagatcacgtgatggctacaacatcaccaacacaaaaatgttgcaacacaacaaaacttccttgttgcaatgtttaccacgatatatttacaataggtgtgacatggtgcacgggaggtgttcgtccgttctagcttcttctcctctccctgtcccgctgctgctgctgcggcggcggcggcggcggccgcgtcagctcccgcgacctgcgcgaccggtcgagcatgtccagcatcgccggcgtcacgtacgacacggtgatccccgtcgggagctccgacgatcccccgcctccgccgtgagcgtggcggcgcggcgccacctcgccggacatctgcctcgacgtggcgcgctgctgcgcgtgcgagctcagcccggcgagcacgtacgcgcgcccggacagctcgtactgccgccggtccgccacgcgggcgcgcatctcccgcagctccccggacagcgccgcgcacatggcgtccccggcgcgcgccgcggcggaccgcgccaccgcgcgctgcctgctccggaggatctccgccgcctccgcgtactcgccgcgctccgccgccgcccgcgccagcgcgatgtcgtcgatggcttccacccggacaagctcccggtccacctccacggagcgctcggcgacgccggactccgcccgcgacggcctgagcaccaccgcctcctcgtcgccggccacgctcgtggtccgtccggtctccatgtctcggtaagagcagcttacttcgatcaggtgggtgacgtcatcccaggcgggggctctcgggacgacgacgaacagcaggaagctcctctcctcgtcggcgtagagctcgccgacg

SEQ ID NO: 69428 - DNA, 2601 bp, Oryza sativa
cgccacgctcgccgcgccgccgccgtgcctccgctccccgagacgcctcggcgcgcggaccagcggctcgtcgtcgtcgaacacccgtggctccacaggccgaaagaacggctgcgccgccgacgcagattctacgcggacgcgcccggcggcgccgcgtcgttgccgcggcggaacgacgggagctcgcgccaccgcgcgtggcagagcgggcaggcgatgcgtccgcgcgcgacggtgccggagatgcagtggaagtggaactggtgcgagcactccgccgtgaacacggcgtcgccgccgccgcggccgccgcggcgcatgtcgccatggcagatgccgcacggggcgctgtccatgccgcccgccgcgaggctttgaccgagaaaaaaaccctccttggtgtggcggcaacccaccaacgtgtaggatttgatgaatcattttgattggacgaaaatgtgttcttgactcgtcgttggaattgcgttcgcgtatgcaccgcgttgaacgcgttcattagggtcctaaacaagtcaccgggtttctgcgaattagtctcgaaccatcgatttggtggagtattgtaatcgtgtttatgggttgactagttaagtggatctgattttgctggagtataataatgtgtctttatgtctgattatgttttataaagttgttaatcatgaatataaatcaggcaactgaaattagagttgctagttgctaccacgtctattttcaccacagatttgaaagctgtcgttgcttcccttgttgcaaacttgcaatggcaggtgacagcatggagccagagttcacaaagccgtagctgctaaacgaaacaaaatacctgatttctgcaaggacaacaattcccagtgcagctgcatcagcatattctttaagttacatacaccatttcaatccttgggaaatggcatttcaattcccaaaccaaaaaccaaagcattgccaactagaaacagaattgcaaaacacgttcatcagcactgaatctacacaagcaggaggaatccatccagtcatccagacatatcaataccaatgagtagcaactcacaaaaatatacaaggttctgaattctgatgcatctttgattctttacagagtagacgagcaaaactttaatccgagacaggcatatatatgaagtatactgctacttctgggcctctgcctgttcaaagtttacctctgaagtagctaaaagctctacggggaaaaaaaatctcaactgctctgtgcacactacactactacagtcaagatgtacaactatatatttacaaggaaaacatacaaaactttccacatcaagccgtcaaccgtgtgcgatgtgagcctttgtgtgctagccaaatccgaactgtgcggtcatcacttgccgaagccagcatatgtggcttagcaggattccagctcacacaatttacagtaagtgaatgaccgtataagacctttattggcgtctccaggtgccttttccaaatgtagacctgtcatcattttggcacatcaaaaagatggaaaaggcttgacaagagcagaaatccatgtactagctaatttcagtttatttttgctgttcacagaatcttgtacataggtccatgcctaacgatgtgaattatgtgcctccactaggaaatgtcaactatcaaacacactgcggagttaacaagagcaaatctattttcagataaattaaggaccgcaaaccaaacaatgctaatcaacctagtaggaccttcaacattattgatatttcagttaagccagaattgaatgtaaggtttagtgctatgttaaagaggccatgtggacattatcagtgagcctgcaatgtttacaatgtttcctcatagaacaggaaccttgaaagagtaccaagaaccaagttacaaggtaccgctgctctatatgcgccactccttattctcaatgtacgcttatgcttgggagggtggttatgttgtatatgtatatacaatcatatgatctacgaaaaaagtcaggacgaggcagctaaggccaaatgcaatattaaattccataagaaagctatacctgggaatcctcactgccactagctatgaacagagagtttgatccaccaaagcaagatctaatcacaaactttccttgcttgtgtcccttgaatttattatccgccgcagtagaactttcactgattctccacaaatgaatttcctggctgttgaggttgacaatcagtgattgtccatcaccagagagagatagcgacgaaatcgtctgctgctcacgtattctccattcccgcccctttggaagttctcgaatccaaatttcattggaacatacacagataagatgtttgctatcaggagtcacagctatatcactgactttaggtattctatctccaacccatgattccagttcttgaccttctaggtcacaagtgaagatcctctttggagaactttcaggctcacagctggcacatactattttctccgaattagggaaccatgcacatgaattgataatatggccaactgagctgctaaatttaagactggggctgcaggaat

SEQ ID NO: 69429 - DNA, 6547 bp, Oryza sativa
catttcagacatttaccatagtatccaatacttaaaaattcatatcaaatttttctggtaacatttttaataaataaagatttacattatgaagggatttctcataaagtatatgtgtcagtttcacaggggaaaaatagctccgctcatcagtggacaaagtttaaaatgtatgattgcacgtatcgtataaaaggcatatactttctataaaatatcttatagcactagaaatttatgttttcttccataccactaagtttcaacatttatcctttttgcaccactcccattaaacctgttagtttcagctgccgttaagtcattggaagctgtcagatgtttttttcccgaaaagacagtcatacctcagtcaatagttgctggcccacattattggaaacttcaagcttcttctcctttcctccattcctcttcctatggtggagagggaaaagagctttgatggaggtacaagagaagattagcagcaacaggaattggggagtctatatcacactttggcacaaggctagattgagggatgttgcattctctaatcaatcaggcttgttctgttctccaatagctttctctatgtgagttaaaccattaccaagtatggattatggaagatgggttaagtggaatgcatggcttgttctgttctccaatagctttctctatgtgagttaaaccattaccaagtatggattatggaggatgggtcatgtggaatgcatgctatgttttgcatggagttagtctgaatgttgtggtccagaagtggttaaagttataagatattttatatattaaaaacgagttgacttataaccattagagttaagaagaccaagttgtaagtcgtattctgaaacaacaatagtgaaaagcattgttaacagctgctttggtgaaaggcataccttccatatgatggccgtgcaatcacttgaagatgatgccagatagtttccatcatttgagaaccttacaaaccaaacttcattgttatgaccacataatatctgcaaacaggcatggatgtgtcaaatatccatcttcggactatagtccccgcccccaagcatgaaacttgtctagtgctatagatccctgaaagaatacataaatgagtttacctgaatagtaatcccctcttggctaaaaaagaatctaataacattattatcattggttttgaagtatctcaagttatgatcatttcttttagaatataacagaatttgaaaaatcagaactccacagaagacctctacacaagcagataaaacatagtttgaaagcagagtagaaaagaaaggtttgaagtggtgctgtttacagtgtttctatctttcaaaacaaaaccgagatttcaagtgcaaagactcttaaataatgcaaatccctgcctcactggggctagagaatatgcagtacttttgaagagtagtgtctcccggtagcatgataattttatgcttccaaacattggcacggaaaggataaaagctgcatatatattgaaaaaattacagtgaatattcgagttactgagttagataaccatacagaagtacgttctgaaaactagtcagaacaattgccagcataaaaattgtacattgtcggctctagtttttgaaattgatctgatttcacatacttataaaccttataactggggtgtttgtgcaaaactggtaatacaaatcaacaatttaaactcgcacctgcgaacacttggaaggaatctgctcttcagggcacttatgatcctcaaacaaagtgacctcgtccggtaaattgtgatatacacaagacgaaacctgcttaacaactgcattctccaccagaagctctagccgaccgcttggcacatggaaccatggcgggaaagcatcaaccagatccaagaaaagcccaatcctccacccgaccacggcatccggcgcgaccgccccctcgcacgagaccattgcgcgtgccagccagtgcacacactccctgtcaacgccgaggggcgcaatccggcgccagagcacctccctggcgcgcggcagcccagcgtcgccgatccccagaagctccaggaagtgccccctccacaccaagaactccgccgccgcgcgctcccggtccccgaggcccgccacggcgcggatcgccgccacgcacgcgtcccaccggccagacattacgtcgaacaggaggcggtcgtgctccgccgggtacagcggcatgccggactccgcctccagcgccgcggccgccctccggtaaccgagcgagtagagcgactgcgcgatgacgcgcaccagctcctcccggtccacgagcccccgctcgccgccgagccgggcctcgccatgggaagagacagagctcgcgtgcatctccatggacacggctgattcgcttcgccagcttgagggatctcacaccccaagcagccgccaagaccaaaaccccctcaaaaatccgagttccgaacacaaaagaagatcaaatttccgagcggatcaaatcaaaacttcaagagagtaacaaaaaggggtcaaaaatttctccgctccaacacagacgcaacaagaaaagcctcgaaagcgatcaaaaattccacgcactaaatgacagaaaatgacagggagagctcaaaatccgcaaaaaattatcggataattcgggcgaatttgggagtggcagtgtggatttacaaatgatccgatcaaaaatcgaggggctactgggttttttttcctcctccgtccggatctgtgtgaccaaatctgtgggcggaaaaaggatgggaatttttggggacgggatcgatgcacggtctgtgtgcgctggagagatctggaccgtccgttggatgctgggggttggatccgagccgttggaggtctcgtggatcaggataggatcagtgttgttggtgtcttgtgggctggacagtagcgcgctgataagaccgggaatctggagtctagaatgttcggagaagaggcagtttcggtgcttcggatatttttgctttgctctcagccccctcactcggttgagttcagaataaattgcacaatacagagggtagagtgcaccttgtttctagtacaatatatatgatgaattacctattcatatatattatactagaaaatgttctttttagttctaaatttttaaattttgagatggaggtggtacatagtttcattttacattagggaatattaaaataagtttcattttgcacgaggtggtgcatcatatcattgaaaagaaatctagtaaaatatgaggaaaattataaaaccctttgaatttagactatgtttgatgaagatttattcaaaatttatgaaacgtcatggaaatcatatatatattatgatgtatcatgttaagtgaaacttaaatcaatggacacaggtgcaaagtaaaagcatgtcctaaacctagtgtaaagtgaaacaacatacactttatctggtgcaaaatacaacttactcttattttaatggtttactttggtcctaaggtcttttttagggaggggcaaagcaatcactgaaaaaatgttttcttcgatataagtccttagaaccacctaatactcttttctaaaaaaaattaatactcacattggcataattgtgtagttaaatttcaatattatagatacgagacactcctacatgagtgtattcgacaaggctcgtggaggttttaatccaagttagatctagctgggcgggcaagcaggacaggtgccaaggaggcaaagacggcagctatatgatgagggaggaacaatgacaatgagcgtgcatcaatgaagatgacagtgaatcggtgcgcatggaatcaaatgtaggagggggaggtgcatgagccctctcctctcaccttgtgcacccatgttgcacctaccaccaccatgcctgcacgagcttaaatttggattaggagagaaggtcaattctcgtgtttacaatgggttagactcacttgggaggctgattttcatgagtgaaactaaaacgcggcaaaccaaacacccttccgcagcatgtccggtgtgttcctacaacaacttgcaaagcttgtttttcattttctaccaagactcctttcaattcagaattgctagaaaactattgatagtttttttttctatcctaaaactttcaaattattgaccatcggttggcctcgagattcaaagaattaatttttaacttgcgcaaggactcccaacttgttgggtcaacgcatgtgcttgtagcatacttttttgggttaattggatatttggatcatgctattataaatttaatggttttgaaatataccattcatatttacctatttgtaaccgtatcattataatttcacaaatattagagctatgccactacatagcttttctctacattttctatttttttaggactaaattaaactaccctcttcttcttccttcatctcccatctcactccatatcttctctcttgttcatcgatctccttgtccaccgccaagctcagcctgctgctccgactggcaaggaagcaaagatggtgctgttatggaggaagcaaagaccggcaagcacaaggaagcaaagatgctgctattatggaggaagcaaagaccggcaaacagcaggacgtagacgaaaatcttacgatgcacacgcatggctggtggatgtcgagcagcaccgtgtagaggcgtcgtcgagcacagaggaggaggggatacatacgcttgagccgagttgtaagccgaggagagagagagagagagaggatattcacgccgccggcgagcaccgtcgtccccgtgccaccctcttcgcatgtatggaggaatccgatgcagtggcgacagcggccaaacggcgagacccccggcggcgtgctccgtagcttttgctacttgatccggtggctgggtagcaagtcccggtggcgtgctcccttccagctctgccggcagcggcggcagccctcagcctgctgcagctcttcatgagcttgtgtaagttggctggaatagaagacagaggaggaagaaagaaggcataggtattttggtctaaaatttttataaaatatggtgaaagggtatttagtggcatatctctaatatttataaaattgtaatggtattgctataaatagatgaatagtaatggtgtatcttaaaaccaccaaatttataatggcatggatctaattaaccctacttttattatcacttccggtattggcgggggccattacaatgttatcaaccgattgaaactttaatacagcctttttttatcctgcaggaggggaagacccaatattatactagcatatcttttggttcttcggtcatccagaggtgtacattctcattctgcctggattcggtattatcagtcatatcgtatcagttcaacaatagtattccagctttgaaatataaaccagtagcagtttataaggaagttttaccggctaaagtgcaggattttggggctgtttggttcccagccacattttaccattacttgccaacaaaagttaccacaccttgcctaaggtgaggtgatcaaattgttagccacaacttactaagcttaaggaaatcttgccacacttttttgagccattgacacgtgggacccaatttgttggaggggaatcttgccacaactgtggctacaaccaaacacctgtcaaatttgcctaaccttaggcgtggcaaactgtggcaaagtgtggcttgtaaccaaacacacccttaatcaagaaacatggtagatacatacataaatggcaaaatttgctactaattagctgtgagacactgcaaaatcatgacactactcatgaacactacgaaagttgtgaaattggctgtaggacaccagagccaatattttataatttccgagacaaaagaggtcagagaaattactaaaggaccatattgcccctggacgctgcagcttgtagaccagacccagtcggcatcatgtccatctcccccacccgacttcccattcctccccaatctctaaccctagtcgacggtggcggcggcgtcagattcggcgccggcgccagcggtgaggacggcgagcgacggcgacaacctcaatggtgcaagtctggtcgaagcagatgcagcagagttccatgtcgctcacctgtgcccaaatgatcaacacattttgcgaattcacaggagtttgctgttcttctcagacttgacctgtcattttgctgaattgcccatactctgccactgaaccctacatcagcagagcccatggtgtgcccatccccacttaagttcatcggtgagcttgaaccagaagctaaggctctcctggaagcagctctgatggaagccaacagggagagggagaagaaaatcctgaatggcacaaagtactccctgccatcccctttgcctggtgatgacagtgccgatgacgatgcatgctcagaggtatttgagtgctgaacaatttca

SEQ ID NO: 69430 - DNA, 5523 bp, Oryza sativa
gtgagcgacatggagctctgctgcatctgcttcgaccaagcttgcaccattgaggtcgctgccgtcaccgccattgccagcgtcgtatctgccgccgttggcgccggcgctgccgccactatcaactagggttagggattggggaggaatggggaaatcgggtgggggagatggacacgatgactagacccagttgggtttacaagctacggcgcctaggggcaatcaggtcttttagaaatttctctgacctcttttgtctcggaaattataaaatattgcctccagtgttctacaaccaatttcacaactttcgtagtgtccatgaacagcgtcacgattttgcagtgtctcacagctaattacacgtgacggagcgtgggggctcctcaccgggagaccgcgcaggcccccctttgccggttcggccgggggcgctaagtgaggttcttcgccctcgatctgaggaacgtcagcgagagaggaaatgcgcaagacacgggcgacgtagacaggttcgggccgctgagaagcgtaacaccctactcctgtgttctggtggatctgtgcgtgaaggaatcagagaggccgagagcgaaagagagttcaggctctagaaaccattcgccagagtcccaaacccccctcctttcctctttttttctttttttctaggcctgggcctcctttttatctggtcaggggttaccacatgggcctctagctgcctaagaagggaaacatgctttttacaatgagggctagtctacagccggaagtgacctttgacaagcagagcgcacgtctcctgccccgcttgcccgcttttccggtggacgcccatttcaaccttcatttaatggccagcgacttccttgccatacctacgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccagtcgcggaccggataagcgtgcgctgcgccgcattaaatgcggcgtggcgcgctcgtccaatcctgctataaatgcggttaggtgagccccgctgtgctcacctaacccacacgcgtggcgccaaaaccacagggggtcggggcgccccagccctcggggccgaaacgggggcgccccagccctcggggccgaaacgggagcggtccgacccctcggggagacagagggaaacccaaaactattagggaaaaaaacaaatctaaaacaacgaatttgcatccattatctttctttaaatatcctacgcctactcatataactctatatatagaatatatagtaaacccaaaattattatgcaaaaaaaaatccaaaacaaataaataaagaaaacaatcttgatttcatctatcacgaaataagatcattaatatctcctcagctaaaaaaatgattgtgtttttttgttgtatgggatatgtttaaaaaactctgaatatattaaatgattaatctttaaaaaattaaaatccacaagcaaatatatttgaaccaattaattttgatgaatctcaaaatttattttatttgtttggatttcattaaaatttatgtataaaatgacacattaaattttagtatttttgcttcacatgacatacaagttctaaattttatataacaaatatgtttttcacttctatacataataaataaatcatttatacatacatccataaatgttttttaatatatatattcatttgtcaatactaaaatagtggttcacaattttctttctataatattttatgaaaagtataaaatttcaaataagaaaagaagtatatacatattttaaattagtgagcacaccagttttatcatgtagtttatttttgagtgatatatatatatatatatatatatatatatatatatatatatatatatatatatatatatatatatatatatatatatatatattgtaactaggaagcgtgccgtatgctaaacgatcaaacaacatggcatcagtcatggaaccttgtatctcagaactcatatctatgtcactcatgaaactatcactcagatctctatcactattataaaagcaatctccttctgcactgccacaaacattatgtgccatcagacggctatagccattgatattgcaataagtgtagaattaattggctcatcaaaacggaatgatcgatcgtgatcattgcgggagtcttctccgcaagtcatcttctccaactccatctcgcgcccacaaaagttctcctactgagatgcacaattctaatgcccatataatcatagtaaagacatctgattcgtcctgtcaacacataaaaaaaattgcattaacttattgctgtacaacaacattgaaccatgtggtttaagactttttttgattgggggaggggcgtgcaagtacatgagaaattttatgctacttataaaataaattcagagagttaaaatatattatcttctggtgcttttttttaacaatggaaaaattacttttcaagtcgatagcttaccagtgcatggtgtcggcagagacaccgggcaacaaaaggatgcaccattgtcatcattatgaattttagcaaaaaaaaaaaacatggctctatcatgagtcgctagaaagttgaggtgggtgcgattattggtaatgatgaccatagagaccttcgaaacagtatgggcactcctcgttattgacaccacatattagatagagctccaagacctgtaaaaattagacaaaatacagtttggtaagcaacattagagattatcagcaaccaacaaaaaacaatgaaaaaaccttacatacccaggcaccgtctgctcgtatgcattcagcacatcattgcacgagtgcgtgtgagctctccaaaatagtaatactccctccgtcctcagaagacttagagtttgaattttgtccccacaaaaaatcaacttctaccactctacatactctcagcacataaaacaaagaagttttatcccttaaataccctttacctatctatcactatcactactttttctaataatgaggggtattttggtcatttttactctccactatttttttatgggattataggaattgatattttttaggacggagggagtagtacctagcaaaggagagtgaagggagtggctcttcacaactacgggatgatccaggacataccaacatcgcaattcactcaacatcttgcgaggagagctggttattaccgctctgcagacgtcgtgccaaatcagacgatgatccaatcatcgacttgcaggatgcgaggaagcttgcttgagcagttgggtcggggtgataggcagctgtggctgcagccaagaagccttggcggatggtggtagcggcgcaagaattgatgctggaatctgccgagagaaggtgggcatccgcttggaggatgcggcgcatggcttggtggaaatcttttttttaaaccccaacgaggtgtatttgtattaaataagggggaaacactgtacaatagccaaaaggctaggacttacaaaggaaaaaaaaaggaagagagttgggggcgggggacgggggagcgtccactagaagaacgtgtggagaggcaaaaaaaaattaactacagattatttgttgtgctaccacggtcatctggcattaaagattgaatgctctctgccccgccagctcgccagagccagatttcctcagtcgcccgatcgatgattccgcatggtgttgtctcgatgctttgaaacactcggctattcctctccttccagatttcccaggagaccaggattaggagtgatttgactctccttcttttctcgacaccgagaggacagtgacgatgagccgcgcggttccacggccacgacgagccgtctccatcactgccatcgccgtatgagtcttcaagcagcccgacgagcctgcggacgagtgcatggcggcggcgggatacggcgagccaggcgcggacgaggcggtcggcgtcggggtggccagcggtgagagctccgcactcgagcgccatgtagaggccttcgttgagggcgaagtcgtcgtcgtcgtccccgagtaatctcctcctcttcttcatgcccatgtccgccgggaccgcggtggcggcgacgaggaggtcggcgccggcgacgaacaggtagcgcacggcctaccactccctcaagtcggggaacaagcggacgaggaaggccttcatgccgtcgagcggccgcgccgcaagctcctgcgtggtcgcctggggatcgggcatcgcggaggaggagggggtgagagtgttgatgacgatgttggagaccaacccgaggaggcctaagcagaggcggcggcggcgtggtggtggctgatccgctggaacgcctttgggtagaaggcctcgatcttgcgcagcaaatgcgatttgcaagcagatttttcatcgggcgacgggtacccaccaacacagcatggctcgtatatccggagatccggcagcgagctggacgccagcgccatcgtccgccggcggcgtccagcgagaggggcggcggcggcggcgagtggaaaccggatagaagacgagtatttaccgactacgccgcgcggctctgatttttatttttactagcaaaagtgcccgtgcgttgcaccgggtgattacggagtgtgtatattgaccaaaattgttgtttggtttagcaaaagtgcccgtgcgttgcactgggaagcgcacagatcagtaaaaatatgcaaattaattaaaacacaaattcactgaaatatttggtatttttaagtaggtatgtgtataattaaataaatttacaagtaaagcaagtgcgagaaataaaatgacattgttaaatttaattttattaaactctccatgattagttacgctatttggaattttcagaacttaattgctaattttaataatacaaatattatttaataattatttaattggaaaaagaaagaaaatccttccttttaggtttgcttagaaataaacacatttaataactataattgtaaatgcttctgaaaaaattaagcactaaaaatgaacttctctgtttttttttcggcctgagggacctaatatagacttatttccggcccgagggacccaaaatagacttatttccgtcccttccggtcggcccacggccttatcaaaaccctaaccctccacacccctccccccccccccccccccaactcattctcctccctctcccaccgcgagtcggcgagcggcggcggcggcggcggtagcgaccggcgatctcgcggccgaggcgaggcggcggcatacctgccctaccgcgggcagcgactggtggcgggggaggcgggcgactggggggagggggagaggc

SEQ ID NO: 69431 - DNA, 6669 bp, Oryza sativa
gctccctctccccctctccttcccgtctcgtcggcttggcgcagcgacggcggggtgcggcggagacggcggcgacggccgtccctccccctctctctctctccccgtcggcctcgacggcgacggcgccctcccaacggctgcgatggggtcggcttcatccgcgtgcggatccggcagcggcggctccctccggcggcggtggtggcgtcggcggccgcccttttttttttttttggcaattttttccatggctattgctaaccgaataggattgtgcatggacaaaagatggacgaaaattagatgttacaaccgcaaaaatacgaatatttatattagttatatagattatagatttttagttttagaaacttgggctcggcctgctttggaaattaagaagtccaaccacgatccgaaccaccaaatttttttaaggaaaacatgcaatttaactcccagttgatcttttgtttataataatatctcaaatagatgtgcacgcctgaagtttctctatgaagaacagaagataattcatgcaaatattttatcaatgcactaataatgctagtcagatttctatatatctgtataatagctagcatcatcgttttcaccttttcctaattgtagcttatgcgtagtgaatttccaatacatgaatctacaatctgcatagcaatatttacgtattcacagtcgttaaattttcgttaaattccaattttcgttaaattccgattaagcgtatgtataccaattaatcatttggtggtaccctctccgtcgaacatgtgcattcgtctcttcacaatactagcttaatttgtatccctctaccctatgtcgacccacaaagtattaaaaccaatgagaaatgactccgctgagagtattgacgccagtgccatcgtcgtccggcgaagtccagcgagaggggattcgattggatcggaagcaatttagcaaagcggcggcggcggcggcaatttttacttttgtttttcgtttcgaggaaggaaccaggaaaaacttgggttcggcctgctagtccaaccacgatctgaaccaacaaaatagggaaaaattctaatttgactcccttaaataggtcggtagaacgtagaggtcgagatgggggacaaggcttcagattttgacattaccaaaacttaataggttaacaaaacaaatattatattgctattcaaaccttaacaaaatttggtactttcagaaacttcctcttatacaaaccctaccgaattttaataaggttacaaactaaacgcatccaacactaccaaaatttggtaacaccaaaatgtgccaacttttggcggtgccaaattttggcaaggttgatattttgacaccaaaccaaacaagcttcaattagatgctatagatgaaatggatcattgggatccggtttgacgtcgaaaacgaggcggcgctcggctccaggcgatgccaaacagagcaaagtggcgtgggcgcagagctcggcgtggttcgggccgcatgatagccagcggagaacttggcggatcttgaagggtggcagaacgacgcccaaggatcgtgttccgccgggtcttgacagcaagattggctttggattgctggcggagtgtatgcacgttaggtgcttgatcgacgctccgccatggctccaggaaggagggagcgaagcaaggcatcaaggtgtggttgtggaggtgggtagtggcatgaaacggcggcggcggcgtgccgtggttggcgcccggctggtaaaggttggatcgaagttgggctatggtgagaggttatggatttgggccgtgcattcaggctcactggccggggcagacattgtgtcgaacaccttgtgggtatgaacagtgtagttttcgcattttccagaaaattttcagataattgattagatagaatggaagggtttttttagaactcatgaatggcagggtttactgcccaagacaatgtctcttggttgttgtcaatcggtacaccacagagcacagagaaatctgatgacaaaaggacgacaccccatataatgctgtttggaatatatttactgagcagcagataacttcaaactgatcaaaggagacactcgtatatgctgatggggataagatgtacggaaagacgatatatatccagcacacataattcaaccaaccaaacagaagatcaaaaaagagaagatttgggaaataccattgcaaagatacgtgagttgtaaaatatcatcgtacgtgagaatgacatatggggcctgtacccacatttcagtgacacatgatgtattttctaactctgtgatttttgtgatggtactaggcaaattagcccatcaaaaaattagctaaagtgtggcacaaaagtatgtcaaatgataacaatgttagtatagcatccaaatttttgaaggcaaacacacggttcagaacttcaaacgagcgagaaaaaggggggacaatttctcacaacaagtgaacttcgaaaacgatcaaaattccatgcactaaaggatagtaaatgatgagaaatttaacgatatgccactcaatagaagtggctttaacaaaatgccatcctctagaatgaccttataaaaataccactcaatagatgtggctctttaacataatgtcactttaggctgtttggaagcttttaatcagaaatgatgtgtgaaatgacaaaattacccctagttcctttctcacatgtccagagtagaggaggggccgatgtctgtggggactccttccccggtggcaacaatggtttgcgtgggcggcaacgctgtagtgggggcgaccacgacgccctctccacaagcgccaaggccacctccgaccacctcgctgcatctggttgcggcgacgtccatggccactccctcttcttcttcgctccaccctcgcttctacctctccgccatcgacgaggaccgtccctggtaccaggccgacaacgatgcggcggggctcgaggagctcctcaccgcatgcccctcctcgctaacgggcccacgctgtggtaccagctcgacgacgacgtggcagggctcagggagctcctcgccgcgtgcccctccctcgccgacgagcccgcgccatggtactccttggctcgcggcacggaaccgctaaccccgctcatggtcgccaccgcgtacggctcagtggcttgcctcgacgtgctcctctcgccgccctacctcgtggaccccaaccgcgcctcggcctcatcgctctccaccccactccacctcgccgccgcgggaggggctacctctacccccacatcggtttcccgcctcctcgccgctggcaccgacaatgacaacgacgaggtcgaagagcgacaaggtgaggaaggtgaggaagaggcatttcggtcatttcacgagcgtagtctggaaaaaaaatataaaaaaaagcatcaaaacagcccaaaagtggcattctattaaagagccacctctatggagtggcatttttataaggtcgttctatatgatggcattttgttaaagccacctctattgagtggcttattgttaaatttcttgtaaatgattagggagagctcgaaatctgcaaaaattatcggataattcgggtgaatttgagaggggcagtgtggatttacaaatgatccgatttgaagagctacttgttttttttttctcctttggatttatgggctatttcagtttgttgctacttaaaccttaccaaattttggtatggcaataaactaaacacacttcaaccattactactttaccaaaatttgataattatagaagctttctctcttaaaactctaccaaattttgataaatgcatcaaagcaaacaaagcttatagtattatactatcaaaatttggtaatgctaaaatgtatataaatttgatattaccaatttagtatggttgatttgggaaataaagcgaacaagccctcgtgtgaccacctgtgtgcgctggagagatctggaccgtccgtttgatgctggccgttggatctgagccgtcggaggcctcgtggattaggatatcatcagtgttgttgtcttgtgggttggacagtagactgctgataagaccgggaatctggagtcagaaaacttttcgtccagaaatcaacactggatttttggctttgctctcactcgttgagcttcgttggatggttagtactacttcggtactaacgggttactttgatcttaaggtcttcttttttggcccaatcaatcactgaaaatagagttataaaaaataactaaaaattgctttcttcaatatcagtcctttaaaccacctcaaatactctttccttaaaagaaaaaactagtacttacaattgcaccacagtgtagtccaatttcaacatttcggggagtttctctcggctgacactatttcgtccgaaatttacatagattttctttattttttaatatagtcaagctattcaaatttgataaatatttgattgcttattgtaatattttgaaccgaatttttttaaagggaaataaaccgaaattttcaactctgaagggaggtgatgggatgcgcgacccttctctcatgcacatgggtggccctcactgcacgagctcaatttcagatgatcatgaggagctaagctcgatttctggcgttttcagcatgcctagctcaagaccatacaacgtccctcccctgcacgcgggggtaagattaacagcctcatttcttcgctaatgcttatgcttatcaactaatttttaaatttttaactttaaatttgatgttaattttgagttttttttatcgaagtttatttttcagtctttaattttaaatcgctaagaacacgtatgtaaaatttctattcacaaattatctttcatttataaatatgccgtttgtcttattccatcaataagccgaacaacgggggcctcaggctcaaagcaggtagctagaacacacgctgtactgtgcatttctgtaaatcatttttttttacgaaagaattttttccatcttttagctgaagtacctaaacaagtagagattccaatttcacccattaattacgacgagataaatacaaccatttatgatttatctacgtagataccatacgccctcttgaagcaaagcaatggcgtgaggcagcagcccgggtttgcttcctgaagcaatcctctctgccgtaaaccaggcgtctcaaatacacctgatcaaagaaaaacaacaagaacaacaaatcaggagagcccaaactccaatccggaagacgctagcgtgcgcggaaacatcgcgtgagacgccaagcttttgcctaattgcctcccaggggaggcatccaacgctgtccgtccattctcccctccgcgtttctgatgacgaactgactagcgacaatgatcgccctctgctacaggctacagcagcttaagcacggtgatcatcgaggacaccctagtaatcaatcagtcagccatacacggctaatcaatcagccaaagacataggacttgttttgtttgctaccatgccaaaatattaataatgccaaaccataggtaaatttgatagtgccaaatattttagcaatttatgtgtcttattggtatattttgatagcaaactaaacactagccaaactactattcaaaataccaacgatttagtgagaatttagactattcaccatcaaattcacgtgcctcaacttttttaccacccaatcggcatacccgctataatatgtcattaggactgttaattagtccatttggtaccactttcatgtttttttttactgtgtttctcatttcttaatttcatttgtatatttttttcaagatttgtggacgtttttgcccctgggcccacctgtcataaccaaagagagatatttctctctggatcgatcgatccctccagtctcatccgttcgccgccaaccccgccgcgccactcacctcagcttgccgcctcaccaccgagcgccgcccccaaacgccgcgccatcaccccgccgccgcatcatcacccaggcctggcgccgctgcccaggccaagcgcctcccccgtgcctggagccgccgccaggccgagcagctcccccgtgcagcgagcgcgtttagtaaatgacattgggcacaaacactatatattgattaaacaaggttagtttctcagttcagaagatttagtgaagcgaccaaggtggcaggtaaagctctcacatggtggaagcagtggtagagccagatgagctgcacgtctggaggcggcccagcatcggcgcctccccttccgcggggtggtggcacggcgctcgggggcggcgacctgggggcggcgctcggtggtggggcggcgggctgaggcgagtggcggcggcggcgagctgcggcggcattgggcggcggagtgggggtgctcggcggcggggttggcggtgcccggcggcgaggttggtgctcacggtgacgagactggagggatcgatcgatctagagagaaatatctctctttggttctgacgggtgggcctaggggcaaaaacgtcctcaaatcttgaaaaaatatgcaaatggaattaagaaatgagaaacacagtaaaaaa

SEQ ID NO: 69432 - DNA, 4178 bp, Oryza sativa
ataaaggggtatgcggattgggtggtaaaaaaagttaaggcacgcgaatttaatggtaaatagtctatattctcccgatttagtagaccacattttggcatcaaaccaaaatagaccctctcccagaatttgtaaatggctttgtggttcgtgatatcactgaacctgctgggtgaataaagtaaaaaaaaaaacccataaattggccttctgcaagatctcgtcgtcttgcccaaactatagccttcgatctttccatcaggaccgcatggggggagagcaggggcaagtatgaaatggagttcagattcagattctagaacagtctgaacatgcgacgacgacgatggcgatgtatctgaacaatctggtcctctccctctcctcccgggcgggcttccacgcggctgagtttcaggctcccaatctgcagctcctcccagaaccttactctgattgattggttcatcgtttccatggctccaatgaatgcaacgtgttgttcagattttctgaatcttgttctcaatccggagtacgtgctgtagcagcagcaatctgtccctgatctgagaattttagacactcgtagattcgctgatcaatcattccgttcccttcgagtggtctagattgagcttaatcatcctgctactcgaatcaaatcttcagcaagtgagagctagataattcagaagaaatcaacatattcttcgcgaaaaaaagaaataaccgatgaaaccacggtaattaggttcttcgaatcaccgggagagtaggaaaaaacgagctaaaatcccacataggaggaaacggttaaaaacggccactccgcgtctccgccgcgagactagctctcgccagtccacgtagcccaatccacaaccgccacgtgctccgacaatcccgcccgtccatcgccgcggccccggcctcatctcgaccactcgtttcctcccttcacaccagccacgtggcactctctcgagagctcccgcccgcctatataaacttgttcgcgctcggctcctcctcctcatcgacctccaccccacattgaataattatttttaataattttagttttttttttttggctttagatatattcccaatccccaacctcccaataatccgatctctcccagttctgttcggatcaaggctgtgtcgatcgcaaaaaagaaaaaaaaaacaatttccttttggggtggttcatctgttgatcacttctttgtttcccgcgttttgctggggattcgattttcgggttaagattttctacacgatggccttgaacttggctcaaaacgccgcggcggcagcgtgcttcgcgaccgccggtgatgcgcggcgagctgcttcggtggtcgccatgccgtcgtcgtcgtcgtcggccacgacgagcctgaagatgaagaagcaggcggcgtgcgagccggtggcgtgccgggcggtggccaggcacgtggcggcggcggcggcgagcagcaggaggaacggcgtgccggtgttcgtgatgatgccgctggacacggtgagcaagtgcgggagcgcgctgaaccggaggaaggcggtggcggcgagcctggcggcgctgaagagcgccggcgtggaggggatcatggtggacgtgtggtggggcatcgtggagagcgagggccccggccggtacaacttcgacggctacgtggagctcatggagatggcccgcaagaccggcctcaaggtccaggccgtcatgtccttccaccagtgcggcggcaacgtcggcgactccgtcaagtacgcatctctcgtctccttcctcgatcatctatctcatccttctcctctaacctcttcttgttgttggtgtggcgtgcagcatcccgctcccgaggtgggtggtggaggagatggagaaggacaacgacctcgcctacaccgaccaatggggacgccgcaacttcgagtacatctccctcggctgcgacgccatgcccgtcttcaagggccgcacgcccgtcgagtgctacaccgacttcatgcgcgccttccgcgaccacttcgcctccttcctcggcgacaccatcgtcgtaagtaggaggaaggactcttttgatatcgttgccgtttcgccggcggcgacgacgacgctgatcatccgtgcgtctccttgtgcaggaaatccaagtcggcatgggccccgccggcgagcttcggtacccgtcctacccggagagcaacggcacctggaggttccccggcatcggcgccttccaatgcaacgacagggtaactaatctccgacgagcaaaaactccatttgggtcgtcatggattcgagaaaaactcttatctggataaattttgacgtcctgtggtgcagtacatgcgtagcagcctgaaggcggcggcggaggcgaggggcaagccggagtggggccacggcgggccgacggacgccggcggctacaacaactggccggaagacacggtgttcttccgcggcgactgcggcgggtggagcaccgagtacggcgagttcttcctgtcgtggtattcgcagatgctgttggagcacggcgagcgcgtgctgtcgggcgcgacgtccgtgttcggcgacggcgccggcgccaagatttcggtcaaggtggccggcatccactggcattacggcacgcggtcgcacgcgccggagctcacggcggggtattacaacacgcggcaccgcgacggctacctcccgatcgcgcgcatgctggcgcgccacggcgccgtgctcaacttcacctgcgtggagatgcgcgaccacgagcagccgcaggaggcgcagtgcatgcccgaggcgctcgtcaggcaggtggccgccacggcgcgcgcggcgggggtcgggctcgccggggagaacgcgctgccgcggtacgacggcacggcgcacgaccaggtggtagccgccgccgccgaccgcgcggcggaggaccggatggtcgccttcacctacctccggatggggcccgacctcttccacccggacaactggcgccggttcgtcgccttcgtccgccgcatgtccgagtctggctcgccgcgggaggccgccgagagcgccgcgcacggcgtcgcgcaggccaccggctcgctcgtgcacgaggccgcggtcgcgctccggagctagcacggtcagacgctcatatacaccgtcgcctcgagtcggattccgatgtgggatcattcgatctcccttttttttttcttctttttgccattttgtacagccttttggggagctttggatttgtgctttttgtctcgggaggaaaaccgctctggaggtcgaagagagcgtcattttcctcccgttgaagatcacgaatcatttacgttagagatgatgtaattaagcagggaggggaggggaacacacacacactggcactcaaaagttgttgtcacgcttggggaatatatccatttccagccaaaaaaaaaacgcagaaatgcgttgtgttcttgcgctctggttcgttgctgctgtgggtcagattcagctggtgaaaaaactacagtactactgaaactgaaactactagagcctagagggagattaagctaagttaattgcacgagtaattactccacggttgtgtttagggtctacgtcggcagattttgctttctggtagatccctaaccttatgtttgttgggaattttataaaggagctaagtttgcctattgatttgcaatctacacatatctcttgtgtcacaaaacattggtgccttcacgtctttggtctcccctctaaaaacttgcctggcgaatttcacatgaacttcacacgaagtcgttcatttcttgcaagaagtagggaaaagaatcactgctacaaatggtgtgaagtaattcatttcttgcaagaaataggaaaatttccctgctccaaactaaagagtttacaagaagtagggaaaagaatcactgctacaaatggtgtgaagtaattcatttcttgcaagaaataggaaaatttccctgctccaaacgataagagtttacaagcgtcgaccttgagcggattactatctttggcatgctagtttgtggaaactgaaaggattctgcaacttacagtgtgggactccagtaatatgacgcagcaagttggcaaaatggcaataattcagtgatta

SEQ ID NO: 69433 - DNA, 10044 bp, Oryza sativa
atgaatatccatagataagatgcctggtttgtttgtcttgtgaagtggatgactggagatctgggtatatctctcaattgcatcaattgatgccaaagttggaggaacctgtgagaaaatgtagagaactgttatctcatttcaaaagtaaggtgtaaagatggcaacaaacactgagaaataatgtcctggcgagatgagctagcattcttgagataatcttaactattggataaaaacattaatgcatgttttagaccttgtttgtagcataactatgaatacagatatgtacctgtcgtttcttacgatgcgcagagagcatggtattacactctgttagttcatcaatcatcacagggttgataccaggacgaatcttcttcccgtctggtccaacttcatcttcaaatgctgaatccaacaatgcagaactatgagaaggctgaaattatatgtagaaatttacttcaacaacttcaaacagtcagaaagtaggtacctcttttcccgttggagacaacagctgtaggtgcagctcctgccatcgatgcaggaatctgtctctcagcttgagccaaaagtgctctggcttcatctcgttctttctttaatctagctataacacggcaggcagcatcatgctggaaaagggacataaaacaactaaacagatcagattacaggataatgaatgttcttaaaagcaaaagtgttaactaaaagagcatttcattaaaacggtattcagcatttaacccataatagagctgtttaatcaagcgctgaaaaaaaaatgtagctgtaaagacaagcaatgccttaacaaagcttggtacttcagaccttttcctcaataacttacaagtagttttttaacatatcaacttgcagtaataatacttcattggccctgtttggatccaagggatattttttagccctccctccaatagcccaaatagcccaaaaagatccaaaagggtgagctatttgagggctatttggaaataacccacccaaaaaaaactatcccacccaaggggtgctaattggggctatttcgggtgggggcccactgaaaaagtgtcttctctctatctctctccatgggaagctacattaaaggccaaatagctctcaaaataaccctttgatccaaacaacttagggctattttattggagggctatttccttgtgctaaaaaatagctctcaaaataacttttggctagttctccaaacagggctattgttttcaagctcaaaccagactgcctagagcaaaaaaacaacctaaatatcaccagttatatggtatgcacaagaacccagaacagcatcacacatttctagactggtcagtgaatgattgattttataagcattttttcttcagcttatgaaaatataaattgcagtacaactcgaacaggagcaggaacaaggatagatatttaacagtcaacttaacaatgcccgtacaaaactagtggtcatttgcagattagcgaactttagttagatgggtaaacagatcagggctaacattgttgcccacttcaccacaggattagtgccaggaaataagccaacaactataccttgtacatatgcacaacaagaagcatagaaggaaaaataatctgtaaatcatcattagccatcttcggtactataagtgaaaaggcacaagcaccagcaggataaaaaaaagacaaatgtcaaatacaaaaaaagaagaagaagaaagacgatactccctccgtcccaaaatataaggttttctagagcttttgagggagattaagaaagtaggtggaatttaatgaggtatggctgtaattagtggatatgaggaagtatgtggagatattaaatgagagatggttgtgtgattggttgagatgaaggaataggtgaagttgctatattttggatggagggggtagtttatcaagagtcaaaagagtgactcaagattgggaatcaacagtgctgattacagggataaattcatctagaatcaagagtcaagtagcatttctaaataaaaattcgaatttttattatgtaaggacgttcaacatcctactgcatctgctctaaccatacacaaatacaaaatggccaccagagttcctaaaagagagcactgttccatagcaatctaacatgccccaacaatagacctatggaaaagctcaaaatcctctgagcagatccttcatcagctaaagctgctagcatatgtagaactataataacattcatagtttgtcaaaagaaaagggaagattttgtacttaacatgatacaatatgtaatagaaattctgcataggtaaaagacatacctgatatagcgcatgactaagttcttgtcttgctgtatgaagctgctgctccaaagcaaaactagaaagcatgatagcatcccactcctgtaaaagccatggtattgttctagtgagagctagggtgaatcatgatgggttctcacaagacatttttagttccatgattatttgtggcaaaatcaaggcactgtactatattactcttcctaatagttacatgagatcatttaaactgagggcgatgcaaattttaggaaacaaagaccagaaatttaactctaccacagaatctctgaatctgctttaaacataaccaatgagcaggcagtttgccaagctccaattatgaagattagtttactccctctagtaacctgactatgcttggaaacagcgcattaagttctgtcaaactggctggtgtgcaatggagaaagacgcttaacactgaatcattcccaattattatgcaacgtgtttatctttaattcaaacatcagataaaaagtactttcaggtacagttttaaattaacaaactatacatttaataaacaaaacaatgtgagaactattatcaaagaaaaagaatcagatcttcactgtctataacacagataactatgaagttagtggaaccacttacattttggaacatccccaggagtccgggaatgcttgcagcctgcaattgtctgggcttcacaacctgcaaatagtataacatgattgaggccttgaggattatgcaagtttttcagctaaaaggtatagcaccatcagttacttgtacaaaacataggtaaatccacgccacacgctgctgaagcctgccactccacaataattttctcagcattccagcgaagccttaccttgttggtcttcaccgccacgatgtcgtccatggtgagctcctccttggtgactgggcacttcccatggtcctgcgccatggccacgaccatgaccaccacaagaaacatcagctcaaagcacgacacacaaatgcgacgcgagatctaaacccacggaagctataataaccctaaccgacctcgatgtagcgctcgacgagccgccgctcgaagagaagcccggacttcttcgacaccaccggctcatccggcacctcgccggagacttcacaacaggcggaggccacaaatcagcgcacgcacggagagaacagctagggtttcggagagacagtgagagaagcttacttgcgcagatcatggctgcggcggcggcggcgacggagagtggaggaggggattagcgcgcgcgcgcgcaccgaggctgctcctcccaggcagctctctctctctccggcagtggtggtggcggcggcgccggcggcggcgggggggagcggagcaggtttagccggctagggttttaatccgaagcgggggcgaaaatctcgtcgcttgtgcggctcctccttccgccgtggtccactcgcggtgcctgaaatcggtcgcgcaagttgaaccgtttccattgggtgattgggctttaactgcgtgggccggctaagtttggtgggccgcattttgggtcctggaaaatacttcgtgggctatagatgttgtaggcttgtgaaatatctggccgaacacggctacgtaggcggtacctacgataccgtttctcagcttctcccctcctctaccccacgcacggttctcaatttgctaaagacagttgattttcagcgctttgatgtgaaaattaatttttaatatatatattttcactacaatcaagctaggggtaaaaaaaataaatgaaataccaaggcttatcagtttttatcatgaaacaaacaaataaaactcacactttaattgataagtttatgttaaatatcataagaatgattgataggtttgtaaaaatattgtggaaatgatgtgaggggtgatgattggatttatactatacataatgatttgtagaattaaatagattgtagatgatgttgcatgcttgaatgagattgagtatgtaattattgctagtgggtgataatgtggcatggttgcatattaagcattagagttagtgggttgtaactttatagagagtatagattgtgttttttcaaaaaaaaatctatggaaaaattattaaaatactaatacttagttaattatgtactaatgagtcacatcgttttatatatgagagggattagttttcatcccaaactaccgaacacagccaaaaatcttcaaggagtatcatcgtacaggcttgaagggaatcctatcttactataaagttatcccccactaactccataaccttaacatgcaaagatgccacatcatcatctactaattaacaagatgccacatcatcatccactaacaatcatcacatttaaacatcatgcaaatatgctatatctttatagtttttataatttaagagcttttcaaatacaaaaatgttaaattatcatccaacataattcacataatgtttcaatgtatatatttattatgttttatgatataggtatatagttcatcctcacttagtgcttaaatgattaatctatggtcaaattatcttctccttttttcctctaattaagtcatatcacatcaattgtttttagcctttagataattaatctactgtccaaactatctccatatttttcttcttccataaagtcataccaccttactttttacgtttgaatcaccattctacatactatttaaatttaaattatcataaaccacattaattcacttaatctgatgttatatagctattttacacgttattttttttattgttatcatactaaattctcgcagaaatgcacggagtttcacctagtgatggtaataaacgggacaccatgcatctcgcctccctgcatctcgccctgtcgatgtgcatcgacacctcacagcatgacccacccctaaaggcacaaagtcgcaactgatcctgtgcatccatgttgacatgtacacggcccctctctcacagctgaaacctgaaccgcatcgccatcctgatatctaggcttcacgagatgtagtgccttttggagctaaagtccaaccaaacagtttcagctctatataaagcggagctagatggaacattctcaataaaacaaaacgagatgtgaaactggatttaagctgctctatgaatttactctgtacccaaccatttaagctaaattttagagttgaaactttatcaaatagacccgtagtgctccgtatgggcctgtttagcaggggtggagctggagctcagccaaacagtttcagcttccctaggtggagctctctcacaaaatgaactagagttgttgagctgggtttaggcagctccacaactccactccagacccaactcctagagctaaatttaagagttgaagctgtaccaaacaggtccacatattttccgctcgattttgctatatctcacacgaaagattttttcttatctctcactcgattttctcactcaaatttacagtgcattttcttgtaagttacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatctatcagattttaatctaaagattaaaaatctgtgtgatacgattataaaaatatttcgaaagatgcataggtactcccttttccgctcccgcctacgcacgctcgcgcgggccggcgcacggccttgagccgacatgagtacacgatcgggccgtgccatatatatggccccggcccccatccggccgtgcgcgtgtgcgcgcgcgcgattccaccatgttttgcgcgagaaaaacacaccgcatcaacagctcgcgcgcacacacggctccggaaaaaattttggtggagaccggatgcaagccccttcttctgcagccctgctctggattattgacgcgtggatgatgtatcgatcggactatcggacggggcgctccgctcggctccaggctcacccgagcccgatctatgcgcgtgcggctgatggagctcgaggctcgatccgtcccatcccggcttgatctgggcccgcgcggcttgatcttgtcaccgccacgaccatcggaggatggcggctgctcggggttcttgatctggatgaggtaggacgccttcgaatccacgttcatggcctcccgcggctcgatggcggcgacagcggcgtcggcatcatcgtgacaacgggccggcgaggggagctcgagcttgtagatggatgtgcacgcggtggccgtaccaccgtactcgccgctagcctgtgctgtgtgcggtgtgtcgtcgtgttgttctgaaaatcaaaattcaaaacaacgatgtcagactacatcatagcatcggcatgcacatctgacactgacaccaatcaatttatgattttgagccacaatttggtttacatcaattatcttcgaatgtggtgacgagctcgacgtatccccactccccagtagggccggcagcagtcgcgcaggctcatcttcatcttccccaatccccatcaagaattcaagaacagccggagcagcggctgctcctcgatcgatgttcacctcctgcaatcaacgacagcagcagcttcgaaaatgtccaaaacatctgtaattctccatctttcccttggccagtaatacgagacaacctccttcccatgtccaccttcgcggccgtcatggcttcttgtgtccattgacccattcttgccatagtccggcgcatgcttctcctcgacgccgccgacggtgacaagctgcacatctaacgctacttggtagagcagcggtggtagcctggtaggcggtggcaacccggggtggaggcagaaagcgacaacgactccctcaatatggaggttgaacgaggattgacggcgaacgggcaggcggcgtcctcctgctcatgagccgctcacgctcagatcgagccgggacggatcaagcgccatcagccgcatgcgcatagatcgggctcgggtgagcctggagccgagcggagcgccccgtccgatcaatacatcatccacgcgtcaataatccagagctgggctgtagaagacggggcttgcatccggtctccacaaattatccttagctacccggcctctctacgtggaagaaatccgggaatcgcgcgcgaggatgatcgacgtagcggtgtgtgccggtgttgcggcaaagcggcgacagtcagatcccccggtttggcctatgcacattccatagctagtggtaaagctaacactactcctgcactttcgatctcagacaccatactttcgatcgccttctatacgtttcggcaggcgacagcaaacacaggttcgacgtatgccttactgcattaaacatgctactatacgcaatggtaaaaagctagtgtagtcggcagctggcccacggcgatttggcctattgacgaacggatacaagattcctatcagaggtatatatgtatctacctagctacttgcaaaagggtactagctagcgtgcatggcgttgtgaagaacgttgtgaagaatcacgattgatggatgtgtgttgtgcacgggccgtgcaatgcatggctagctatggcaaagctaagctaagctaagctggaagataagccctcatgggggtgacaagagggggaggaagctgcttttgggggactgatgggcattagttctgtctggtaggctaaggtatagctttatctgttcgatctcatggactaatgtaatatcctttgggtgctaattgttgttgtgttgctgacaggattgatttttaatcttggacattacacgccgccatcgcatccatctcgcgcgtacgtggttcctttgatccttaatcctttcctcacttgcaggtgtgtacagtacacctgcaattaatggtttaatttgttcctagtgtgaagaaatggattagcttaatttgagatcgtacagttgattcacgcttccttcgatccgggttatgatctctaacacacatatgcttgtaatataactcattattgcttgaaaatataactcattagtgtgttgaactcatgtatattatgcagtgcaggtctcctacaccatatagcatggtactctcctactcatggctaaatttagctggagatgcttggctaggtagacaaaagggccgaggcttttctacccaggatcccaacaaatatatctccccgagatcgccagtaatctcacggcggtgaccgcacgaaacgcccgcccggccggatgccgcaacgatgcattcgcatctcagctactcgatcgtctactctgcccggccgcggctacctagcttagctagcttaattagctaccgatccgagagacgacgtacgagtagggagcgcgtgcggcggcttatgcctagtactacactactggtatcgcgtaggagtattcgcgtaggtgatcgacgtgacgagacgcgggcggccgaccggattcccccactggagcagcggcatgtcgatcgatcgtcgtgggcgctggatcatatcgctcgcgctcatcgatcggcacgcacggttagactctgctatatgtacgtgagccggtgatggtgaaaacggtggtgaatcggggggctccgctcggtacataccatttggtgattagattatgcatcgatctctctctctctctctcgatcgatcgaattctcgatggattgacacctgcctaatcagcacgttgatctagttctttggcagattttgcaccgccttaggtgtcgaacactaatgcatagtactctgatatttatgatactagtactctataataaaactggctatatgtaatggtattaggtagtatacaactttccacaattttttgaaaaaatactttcaaatatctatactctttactacttaaaatgttataatagtgggtgtcctttcccacatcatcactaccattgatatgtgggtcccctaatctgtactattacaccatctttatgagtcatctcctattttactattggatctcctcaaatttcaaaatcacctacttgttaataagaaaaatcatcatattacttggtaaataaatgctaattaattgatctaatgaggtagaaactgattttgttttccattgtaacgcacaagcctctaagctagcaactataggtggtgtttggatttagggactaaaactttagtccctgtcacatcggatatttggacactaatttagagtattaaacatatactacttacaaaactaattacataaatgagaactaattcgcgtgacaattttttaagcctaaataatccataattagcacatgtttactatagcatcacataggctaatcatggattaattatgctcaatagattcgtctcgtgaattagttcagggttatgaaataggttttgcatagtctacgtttaatactcctaattagtgtctaaacatccgatgtgacatggactaaaatttttagtcccatccaaacagccccatagtatgagcaattggatagagtgactttctcaaattacag

SEQ ID NO: 69434 - DNA, 1515 bp, Oryza sativa
tataatcgacatatgccaaacgacatggctgataagtgcaagatgggtgatggcacatgcctaacaaattagggcaatgtttatttcaatccatgccaatgtgttacaatatattttaggaccttcttatttcaatttttcgaagtttctatctcctgtctccacttgttcagctaaaacttagcttattttccttggctctgataagggtttgatgataatcattgtcatataaaagagttgtattttactatgataatgtggatgcacgctgtggacgttgaagatacgattttctttccgctgtataatcatgcaattcttcttcctgggcttagcaccaccaccgttatcgactggtgagcttccttggtatagctccggtcgttgttagccatgggcatctactactcattcaatatcaatgcatagctagagagaggagcgttagattgatcgcttgctctcctactctagatagagagccactggcatgcgaattgagcaaagagcattgcggtggagtcccctcccaacgaatggcgaaattcctagcgtcaattgaaaagatgggtctagcccttatctattatgctattttggtcaataattcaatagacattgcttaaagtgaaatttacttttgtatattgacatattcttaacagaagacctcattttttttagcatcgacactgttccatgggaacttgagaaaaggggtttagaattgatgaattttcctagttgaccaatttttttattggagtgatacctcatcacctgttggaacttggaagaggtaacccgtgcatgatcagtagatgcaaccaccgagacgatcgaaatcggcttcatccaacatgcaaccaaccaaattgaatctcgtttaatcctagcccaattgatctaaccaactaagcaacctctcttgcatggttgcgttcatctaatcaggtcaagcctagcatggataagacatacgcgctagaataggagtgcatacacctaaacacgccttttattgttcttactacaaaaaagagatgtgtttacagtgtacatgtgcctctactctacaaaataggaatgaccatgacatttttatgttacttacaaggtactagacatatctcccactaaaagggttcattagtgctttttctttagattagagactaccccacatgtcactcacaacctattgaagtgttgtgtttgactccatgtccattttagtttgggtagagcggaatgcaacaatttctcacatcaagctcaagacgacactagtgatctatcactaagtaaggaagaatcacatttgtgtcaagttgttggtttaaaagccatagaaaaacgaacgaaggaaaaaaagttacgcgtaaaacttatatctatgttattagtggtttaaaattaaagctaaaaatagaatagatgaaaaataacctaaaattacctctaaaattaagttctaaaatataaattttagttgcggctgataagccaaca

SEQ ID NO: 69435 - DNA, 5023 bp, Oryza sativa
  unsure (1)..(5023): unsure at all n locations
nnnnnnnnnnnnnnnnnnnnnnnnnnnnnnnnnnnnnnnntatcccttcaatacctttacctacctaccactcttattacttttttttaatgattaaggatattttagtcattatcgctctccactattttcattttggaatgctaggaatggttttttttttacggagggagtatatatttaaacggttgcagtactctacaacagtgcatctcgtgtgagatttcagacttggaactaaacaagtgatcctagtcaggcttcacctcagaccaaaagctctaaataatttcattcattattaattcgtcaacaagaacagaactgtcattgcagtaagatctccagaagaaatatccatcaagtttaattaaatcagtggtggtgatgctaaattaaagcacatgcatgcatgcccaaattaaagaggataaacacatatctacttagtgacatgatgtcatttatctagtaatcttatgatcttatctgcagtactcacttctaggtataaagtaacacagtaagcatcgcaggaaaacgatggaaagcaaaaaaggaaaaccactaagtgctaaagctaaatctacctacgagatcaaaggggattagctgatgagctgatgactcacccacctgatcggctgattcacagatctcacaaaaggacggccatggtgtggcatcttttaattatgattgggaaattcaaacagaaaacaacggttgtcaaattatccgagagtcaccggcgtccatggcgaaccagcttcgagcaagagatcttaatttcatcagagattcagagagacacacataccaccttaattaacacagctgcagctaagctctgttcagatttcagatatccctacatgaacccaacaacaaaattcgcctaattaagaaaacatgtgctatcaggtctcaagaaaaaaaattaatcactgaatacaataatttcttcagtagtttcatgcttttggcaaccagatatatatgtacgctcaattgttcatgtcactccaaattgacatatacatgtataatacacaaacatcttcagcttcaggcttattatggcaaccgaatatattcatgtgtcacgtacgtatatatacatcccataccatactgtccatacagtatatgtacacaatacatgaacaagagcgtgttaggatcgtagtttctccattaattttgccatcccagatgagcactatgaaaaaaaaacagtagtacaatctaacactaataccacttgcagagttgcaggtagaccagaacaataatctccggtctccagcaatggcagggcgcgcgatctcgggatcgaaccgaatgagctacctagctagagagcctagaagcggtggccggagacgacgaggccgacgccgtcgtcgaagttgcgggagtagctctgcaggtcgtacccgaacctcgccgccgccgcgccgccggcgtgcctcttcgacgacgaccgcaacctcgacctcagcttccagtacagctgcctcaccggccgcggcgccgccaccgccgacgacgaccgccgcctccctgctacgccggcgcccttcgctgtcgccatcctcctccggctgccgtacagtccgtccagaaacgccatctcttctcactgacaaaattaagatcactctctcgatcgacttgctgtactcgagatcaaacacaagcctaggagtttttgcaaatcttgtttcgccgcgctgctgtgagctaagctagcgtccctcacctgcggcttatataaagctcgcaggatggctgggcatcatcgccggtggcggggcccgccggccactcaccggccggccggaatggtccgggctaaagtggatttcaggtatctttttttctctctctctctcccattgccgctgtggtcaaggacagaaacaatggatggagatagccaagaaagaggaggagagcatcgtagatataggctaagccttttgctttagaggtattcctccgtttttaatgttacaagacattttaactttgattaaaattaaactgctttaagtttgactaaatttatagaaaataataataatattttcaactcaacataaatttattatgagaatatattcaattgttgatttaatgaaactaatttgttattataaatattactatatttgtgtatagacttagttaaatttaaaggagtttaacattgatcaaagttaaaacattttataatttaaaacagagggagtagctaattaacctaggtagcgtgagcagtgaggtgggaaatggcgatcgaacgcggccgtctccatcgcagcataaattaaaggagagcaaaagctatgttgatcgatcggaataatcgatcgtttggagatagatcagtcggcgtgtcgaggcgcgatcgatcgatgctcgctgccgtcctgaaatgttgtagtggacggcgaaagcggaagcagccagatgcatgcgtggatacgtggccgagatcgcgatcgaactgctgccgaattgaaatgttgtgcgtgaaacttagggtttgaaagtccggccggaatgaaatttcggaccccatacattattatttcggccgatttttttaatttttttaatttgataatattttgttcaaatttgaccaacatttgttcaaaatttcagaaatttcggatcaaaattttagaaatttggtatatccgtgacctccgatagaatcggtcaaaccgaaaaattaaaccccgtgaaagatatctatgcagatcgatgtagtcattatattcccggccgtacgtaggcatctgagcgccactagctagcgtctgaggcatattacacatctacacgttttacaattgacacagcaaaacgtgggggaaatataatgtcacatgaacaatgagagagcttgcagctacagtgagggttgtacaatggtcgagtttaggcgagatatctggatgttgccatgctacgacagggcttaatttatgcccgtttggctgacatgacggtgtggccgtgtctcttgttcaaacgacgacaatctgtgtgttcagttcagatatcgcgtggtcggtcgttgctgcgaacgaatgcactccaaacagggccgtgcacatgggcatgcggcccatgcgaccgtatagacctccaaatttttagggcctcagaaaatcagcccaactgaataaggcccatgcatttgtgtgaggccagagcgccataaccctgttcgagtccgcgcgtgtctccgcgcggcgacttcgcgtgcgtggcgcttcgtattctcaactccgagccccgagaccccacggcgttttgtattctctttcgtttttcgtatctgtgacttattcagttcgtctcgagtctcgacgtcttgtctcctccgagcagcaagccaccagccggctcatccaatttcaaattttcattcaaccagcgaatagcaacttagcaagcaaccaacaagtaaggcactaggcagcaagccagcaacaacaacgaacattctccattttcaatttgacagtttctgattatgcaaaacaagtgataaaaaatatactattcttgatatatcgcatttgctctgcagtatatatattattttagttatagtttgtatcctcacttagtgttttgtacagggcctacaaatttaacggcccggccctgacttcaaacagctagctaggaccatggctgtccacgttgccgatcgagaaaggttttggtgatgaaactgaattagtacagtaaagcataactgcataagcactctgcactcgttggagcaatatgcatgacagacgatgatatataggcagagagctaggaaagacaatcgcgatgaggaggaaagtgtaggaaggtgactagggttcaccataccaccggtaaccgcgtggttaccgcagttaccgggtttaccgcgtttaccgtggaggtatggtaatgtaaataccgcggtaaccttcttaaatttaaaaaataatttaaatttttgatgaattttacacggttttttacggttaccgcgataaccgtgcttaccgctggggcgcggtaaccctggccccggcggtttgggaaaccctaaaggtgactgcatcaaggcgctttacgcgcgtgattgaatattgatggatggttactgcttcctctggccggtgtatttgacgtttagggagaatctatctatctattatattattaaacagctttgaaaggaggcaccacgttcgctgtggaggctagaaattcccacattaatcggagaaaaagaaaaaaaagaaaaggagagtccaagtagaaatacaatttaaaaaaagctgaaattcggaattaaaagtaagcaatattgaaagaagtttctatataggaacccaatacgagattaatcaaaattcgaaataaaaataaaataaaatccgaaattagcgaaaaaaaagagtctaagtaggaatacaatttaaaaatagctgaaattcggaattaaaataaggaatattaaaagaagagtccatacaataacccaatatgagattaattaaaattcgaaataaaaaaaataaaaaaatcgaaattagaaaaaggaaaagaaaagaagagttcaagtaagaatataatttaaaaattaactaaaattcagaattaaatataagcaatattgaaataagagtacatataagaacccaatagtagattaactaaaattcagaataaaaaataaaatataatctgaaattaggcaaattaaaaagagagttaaagtagaaatacaattttaaaacaactgatattcaaaataaaaataaaaaaatctaaagaacacaatacgaaaaataaaataaattctgaaattagaaaaagaaaaataagatatcagctagaaatacaatttataaataactaaaattggtgataaaaaaataaagattactaaaagaaaagaccatctgaaacacatgacgagattaattaagtaacatgcctatataggaga

SEQ ID NO: 69436 - DNA, 12122 bp, Oryza sativa
gcaatattgaaagaagagtccatataggaacgcaatacaagattaatcaaaattcagaataaaaataaaataaaatccgaaattagcaaaagaaaaaagagagtctaagtaggaatataatctaaaaatagctgaaattcggaattaaaaataaggaatattgaaagaagagtccatataggaacccaatacgagattaatcaaaattcggaataaaaataaaataaaatcggaaattagccaaaaaaaaagagtccaagtaggattacaatttaaaaatagcagaaattcggaattaaaaataagaaatattgaaagaagagtcatataagaatccaatacgagattaattaaatttcggaataaaaaataaaaaaaatcaaaattagaaaaaggaaaagaaaagaagagttcaagtaggaatataatttaaaattaactaaaattcagaattaaatataagcaatattaaaatataagcagagtagtggcagttgatgggacatctaaaaactattaataaaacaccaaatacaatcctaatgatgactaaaaagaagtacaacgggcaggtcgtgaagcaatcggtcaaggtaggtggcaggacttctagaaagtaaaaaaataaacccaatgataatcatattagatttttaaaatctcaataataataaaatgagaggcagcggccgggtcgtataggagtacaatggcaaagtcgccgatggttggtgggtcttctataaagtaaaaaaaatgaattccaatgatagttatgtttgacttttacaatcctaataaagagtatgcggcggacgggtcatagaggagtatagtggtaacgtttgatgggatttctaaaaattataaaataaaaatgaaacccaacaagataataaactccaatttttaaaggttcgggcttctaaaaagtaaaaaaaataaaccccaatgataatcctgtttgattttaaaatctcaatgacaataaagaagggcggcagcgggtgagccgtagagtagtatagtgacaaagtcgctgacgttttggagaaacttctagaaagtaaaaaaataaacctaaaggataattatgttcgatttttaaaatagcaatgacaataaagagaagatgcaatggacgaacatagatgagtataatgatagtgtttgacgggacttctagaaattataaaaaagatgcccaataggacaataaactctaaaacatataaagattctaaggagaatgaatagaaaacggtggtagatcgagcaagcaaataaagaataatatgacagaagtaaggggtagcagttgttgtgactttagaaactaaggaaattagaaacacgaggataataaggtttagtctttaaaaatcttaagacaacgagataactatttaataaatttgaagtaaaatcatattaaaaatatataattttatatgggtgctagccgcgcaattgcgcgagccacccagctagtttatttttaaacaaagaaattcagaaattattggtggccaaagttttaaaattaagtttgattaaatcctattttaaacgttaaatatttataacttttagagggagtacgtcctagcgtcctactaagctcaagctgctagctatgacgtaaaaacacttctgtttaattatagtgctatagagtgataacataaccacacatcaacggtcggatttcagacttctggcaaaggaattatacgcagctagtacaactaaacagttccaatttcaggccaattgctgctggaactgtttgaggcctagtgcctagcttttatgttttgttattcgaaacctatattgcgagcttaaatactcagactatgtatctttggggctgcgtatatcctgctgcaggatgtataggtcgggttttaatccattattaaaaaaaattagttatattcattcgtcagcaagaacaacacattcagccgttgcagagtgtacatatctgcttagtgacatgatgacatttatctagcctttccttacgatcttatctactcataattaacaaatttctaggtcgtagtagtgagcatctcaggaaagcgaaaaaaggaaaaccactaagccctaaagctaaatctagctacgagatcaaagtgacattagatgatgagctgatgactcaccgacctgatcggctgattcacagatctcacaaaaggacgacggatggccggcagctttaggattaggaaagtatagttaaaaagcacaagtcaaattatccgagtcacttggcgatcagcttcgagcatggcgatcagattcgagcatgacatctttcttaagctcatcagattcacagaagctgccaccttaacagcaacatttatatctgatcagatagcaccacatgactacaacaacaaacaatagcaatggtgctagttaatcctatgggatttgtatgggtttttttttaccaatttacttatgcattatgcaggatctgtatgcattctatgttctaaacagatcattaaagtttgctaaagcatttatctggcatgtcatatatgatttcactttttttgaatctctcattttcctctgagcctgttggacggaccgagattggtgcagtccttactataagccctatcattttgcttattcgacgatatatttacaaacaaaaaatagtttgtgaataattttttattgtatatgttcttaacaatttaaaagcaaaggctaaaaaataaactatgataaaaaatcataaaaataaactttaaatttaaggttaaaattttaaattttggttgataagcataagcataagtgaaaagatgaacccatataactacaactttagcagttgcaccgcaactgatggatcaaaaaccaacggcttagatcataaaaaaaatattgttcatgaattactgtagcaaatctacaacggtgttgctataattatgtcaacacattttgtgagtaatcacagtcgatttcttgttcaattgatctcccttgagattcgtgctacaattgcaataccatgtgcattgaacgtctttacatatttcgtgttgcatcgtgaagccaatcaatttaaatttctcatctcgtcagcatgtgttttcatgaaaaaactactacatatataatttcaggacttagatatgtaattttagaacttacattataaatatactaaaattacatatgtaatttagagacttacatatataattttagaatttacattgtaaatacactaaaattacatatgtaatttagggacttacaatgtaaatacatgctgactattttttggtgaaaaatatggcgacataaatataaatatagttactcccaatctacaatgtaccgattactgtagcatcgatggtgcggcatgatggcagagcaaatccgagccgttggttccatcgatccaacagttattatgtgctccttgcagtcattactactacagcaccgatctcagttcctctcgacactgatggatcattcacatagccaaagccactttagggctaagtactgttcctagtaatctaggcccaattaaaactctaacattagcagtaaatgggccgcatattgagccgaaagcccaaagcccaaaggcccacatgcctctcgccttataagtagccgaggcagtgaagccctagccgggtcctcgtctcctcgcgccgccgccgccgccgcggacgccgccatgtcgaagcgaggtacgtgcgagccacctctctccccacctccgctccgtctccttcctccgccgctgcttctgcgtcgctgatctggtcttcgcgcgtgtcggaaatggtggcgcagggaggggtgggtcggcggggaacaagttccggatgtcgctgggtctgccggtggcggcgacggtgaactgcgccgacaacaccggcgccaagaacctctacatcatctccgtgaagggcatcaaggggaggctcaaccggctgccgtcggcctgcgtcggcgacatggtcatggccaccgtcaagaaggggaagcccgacctccggaagaaggtcatgcccgccgtcatcgtccgccagcgcaagccgtggcgccgcaaggacggcgtctacatgtacttcgaaggtacgcggaagctgcacccaatttcgcccatgccgatctgtgaaatcgtgatgctctctagtgtcttgatgattagtgttgcattatgacgtgttatgagctgcgttaagtttggtttctaagtattttagtgtgatcttttagtccacctgcataaattagtgtcaatttcattatgggttacacgatttaccatattgagaatgctgatcagttgtggctgctacgattggagcaatgctctatttttttatgcttacgtcattacgtgattaagttacacattcttatgagctacagtgagcttgttttgggggctaggctttaggttgattttacttgaactatcatcaaatctaccagaaaacaccaaatatgttagcaggttttttttagtttggtgaattatttttaagcaaaaatttatgtgtttgcttattgtgagtttgtaacatggcataaaagagggtacaaatattcttctatattttactgtcttcactaggaagatgttttagatggggccttttggttgggaacatgatctttattgcctgacatggtgctggtcctacttttaataactatggtgttctcaaaatatttttcaactggaagatggctggcattacttatctgattgcgctgtataggccaattgctgaattttgttcgttggagcttgttctgttattttatttgcactgccgtaggaaatacacagtgacgggaggactgcaaggttcttcagctttttctggagcaaacttatatacatgtttgcatattcctaagtaaacgtcacaaacaaagcattgttggatgtagaggttttcttataaagattttatcttcataagagttcctccatctggaagcggtcacatattccattgccctaggtagtggcatcgccgctatgaaactttgggactggccatgtgacatatatttttgtcttctgatgccataaatataatacattagcttttattcattctacatgttttgtgtgcttttattctttggtctcttttacattttgagcagcatttcatttgtacactattcccttggctattttgtcattggttttatcatttggagctgccatgtggtctatcgaattaataccggttatgaaatttgatgtgcagacaatgctggggtgattgtgaatcccaagggtgagatgaaaggtatggcgagaacactactatactcccatatgttatgtgttattgtattttctctcgaagcctaccaggcaataatttactcactgtgtattcttttccaggttctgctatcactggacccattggtaaggagtgcgccgacctctggccaaggattgctagcgcagcaaatgccattgtctagagcttgtttggagtagtagttttcagttctgtgccggatgtgataatgtgctccagttcttttttgtttccaaccaagtttaacctgaacttgaagcaaaccttcagttaaattttcagtgcggattgtgtccttgatgaatggaaaatggcatgtttgcttgtttaccttgctccttttaatcagttcacagtcagcaaccagatcgtattctggagaaactagctgaatgaacatcaatctcacctttctgccacctgaagctgcctgaagatttaggctttgttctatgcttccctacctaatctctactcgctcattttcaatgtgccgctgcacaacctctgcgatcagcgacggcccatttgactcctttctatgtacgttctgacgttatgtgatgttctaggatgatttcctctggggttaattggattcatgccactacaaatatgctaaattagaaaaatagcactactatttgtgatatcggttgggtgccactagaatttggagaaattagaaccgtgttactccgttggttttccatccactcctcgttaatttcccaacttcagtgcttggcctcgatgcggcagcgaaggaacttcggtgcttggcctcgatgcggtagcgaaggagctcggtggcagggaaagcgatgacagccttcaagcatgacagtgacaatgacgtttcccaactctggcggcgagcggagcttcggcgacgagcgactagagcggcggtaacttgggtacgcggggaaggcggcgctcggccttgatgtggcgaaggagctcggcggcaggaaaagcagcgacggccttctccgctctcaaggggcacgatggcgaagcacgccgagagggcgaagcggcggcgacgggccatggctgtgcgcggcaagagggcgaggtgatggcgaagggtctctaggggcacaatggcaaagcacgccaagagggcgaggcagcggcaacgggccatggctgtacgcgggcggcgagaggtcaaggtgacggcggcgggtctcaagggggatgatggcgaagcatgccgagagggcgaagcggcggcgacgggccatggttgtgcgcgggcggcgagagggtgaggtgatggcggcgggttgtgactctgtgtcggaggggagaaggagaggcggcggcggactgtggctgtgagtgggtggcgagagggcgaggtgatggcagcgggccgaggctatgtgtaggcggggagagcgtaaggctgcgccggttagtggggcgagggcaaggcggctcggttgtgcagggaaggcggtgctcggcctcgatgcgcgatggtgatggtggggagtttcgacgatggtggaggagatggcagcactcggcacaaacgaaagatggtggcgccaatggggagtagataacgcgacggagtggcatggatccaatttccccaaattttagcggtactagtcgatatcacgaatagtagcgatatttttctaatttggcatatttgtaatggtgaatagtagcgatatttttctaatttggcatatttgtaatggtatggatacaattaacccttttcctgtagcatagtaagagcatcactaacagtccttatattgttcccaaaactgatttttatgtttttaaaactgatttttatgtttttaggtgaaaaatcggatccaacataaccccacacacgttttagagttccttcaccatactgattgtaagggttttaaagtgaaaaatcggatccaacacacgtttcagagttcccttcaccgtactgattgtaagggttttaaagtgaaaaatcggatccaacagatcatctacacacggatataacagaaccctgtttcttccaaaactgattttaatggttttaggtgaaaaatcggatccaacatatccccacacacgttttagagttcctttaacttactgattttaatggtttttaagtgaaaaaatggattcagcagatcccctacacacggatctaacatatctcagtttcttcgtgatctattcttataaaatttaggttttctatgagagagatcagtttttttttctattttcagtttagaaaaccaaaaacaaaattttctattttcaatttagaaaaaaaaattgggagaagattattcgtaatgtcttgatgatgctctaagttcctcttgcgtaattttccaatattctcaatggatgtgcattgttacgacgataaatggtaataactgttaaaatttctgccaacaggattttcaaaagattcagcctttggtaaggaatttcttttttttatctgattctttttttagatagtcgtgtttttagatgccacagatttcattggtccctcacttgtatttcctaatgaagtaatgatatatctggagaacttttgggtcatttttttattttttatttgtgatctttttgggaccttaattagttgattgtttgaatcaggcattctgtgtaaacaaggtttgcataacagttttattcggtgtgcttctacttagcttaattttattcagccgcttatattttgactgaatagattaggtttcttgttcccaattacacgacatgtagaaattactttgacacgcaaaaggtttgcgcgttcgcgaaaaaagacatatagaaattacttcatccgtattcaaatatatgatgttgttaactttatttagtttgttttcagaaaagaaaaagaactttattcagtcaaacttttgaaagcttgatcattaatagctctcataatatttagtttgaaaaataccgtatgtgtagatttttctttactggagcatttacaataatacagttttgttagatagttttgttgtattctaatttaaaaaaaagtactgctcagacttgaacactagagaaggaataaagtcaatagtataatatattcatatagaggtattataccgtcaaacatttgcaaatatatccttttcctttacaccctcagattgctaaaggcctaaatctatattgattttccctgctccaattttctcaaccgtttccaggaccacctcaaaacatactaggcatttcaaaatgccttctaacatcgttaagtacacacgacatttgtatctatacaaattatgcaaattaactctatctatttcattcacctgcaagaatgacaaacaagtgaaaagcagattgatatgacaacagaccgaccctacagcaactccagctgatcaacatacatcaaatttctacaaaattattcagaggtttgaagtaaaggaccggttaaatctgcacaaaatagggtggaaaaaaaaagaaaaagcaattcgagagagtttctcagtgctgtgtcgtatgagtttatatccaggattccactgtgtgattgtacatgtatgagctcatcccgctgatatgcgctagagcgtcagaatcaagcatgtcttctcccttcacgccgccctgcaaattcaagacaaaaaaaaaaggacaaaaagtcctcaaatcattgccaaatttcacttcgtaaatataatcccaagtttcaaaccgataatatcactttgttttaaagatttttttgagggcgttcttggcatttgaatgcttacaatttgttcatactcttcgtgattctgcgagccgatcgacctggatgcctcgcagtagtcgtcgttcttggcgaacctaccacggacgcgaggccggctatccgcgagggtttttctgcaagcgtactgcagattttttttttaaaaaaaaaatctgagatgtcagtaacgtggtcggcggtgaggtgaaattcgtttgaaatatgggttgggggggggggtgatattttgaatttgaatttgaataatttggaagttcttgcctcaccttgatcttcttgctgaaattcctctcgttcctcttcttgatgtacctgtggatcttttccttcctctcctcgttggagaggcggacggtcttgaagctcgtgtcctccaagctcgtcgtctccgtcgtccccgtcgccggcagccgcgctgggctactcccgcctccgcccatctgtggcaccacgaccaccatggtgaaacggtcatggcgtcatgctgcgcgtgcgcgagaggttcttgcatggcggcaatgtcctacctgcaactctgcggcggcggcgttgccgaaggccatgtcggcgccgtcggcggcgtgggtggcgccgagaagcgcgccgccgcattccatcatccgctggtactcgccgatctcgtccattcccatcatcgacatcaccatgcttccgccgccgccgccggccgcggcgaagaaggcggcctgcgccgcgtgcgcgtccttgctgaagaacgcctcgccggcggcggcggcggcggcggggagcatcgcgccggaatgctgctgctgcgggcagagcgggtcgtccaggcccatgtaccctcccgccccagctccggctccagcggccaacgccgccgcgaagacctcgtcggtgaacccggcgtactgcatcagctcggtggcggtgctgctcagctgcgcctgcagcgccgggtgctccgccgccgcgccgcccatcaccgggagaggcatctgggtgaattgctgctgctgctgatgctccggtggtggtggtggctgcgtctcgtcgacggcggagaacgcgtagtcgtcgatggggaggaggagctcgccgtcggcgccgggcggctcgtcttgctcgaggagagccgagagcgtggagtccagcgacggcagcggcggcgacagggtgtcgccgccgccggcgatgggcgcggtggccgtcgacgacgacgaggcggacgcgtcctccgaggaggccgtgaacatgtccgaccctgccgccgccgccgcgttcaccgccgcgaagaggtcgccgccgttgccgtcgtcgcagaagtcatagatgtgctgcgctatcgggctcgagatgccatcctgcaaaaacaaaaacaaaattcagacaaaaaccatcaaaccaccaactcgtaaccatttctttcttcagaaaaaaaaactgtattcttctacaggcctgtgcaatgcaaacattcatcgccaaaatcctgaattgacaaaacggtgatttacagatttgtattaggctatttaaacccatttctatgattcttttataatctctttttttgcaaggaatcaaatgccatactgttgtatttgcaaattatactgttctatctgaaatctgaaatctctgaagatgtcaagaacagtagaggtataggtccgtatgccgtatgctggggggaatgttactgttaggatcaggcaactaatcaaaaattccaatgcgcaatgtcataaagctcgtggagattaggaagcagaaactatcaagtcgaggcatcgattcccatctgtactgcaagaggtccaaaaagcagaaagattttcgcaggatctggtgcccctttccgctttagtatgatagccacctaacaattattgctctagcaaaatctgatcagagcattagcatttgccaattgccattgctatggaatcctaatatgcatgggcaagcagaatgcaaaataaattatcagaccatatgcatgcagaataacaacagcagaaactgctgaaaacaaccatgctgaaactgactgaagcttgcaaataactgcagaattgagcctaatttgctttcaggagatttacggcgaaaggctcgtcgtcgacgtcgtcgagcatgatggatcttgcaccaaggaatgctctaaattgatactgagaaggtagaggctcatcaacggaatgggaatttgaagaggagaaaagctcacgacccatgctaatggcagtgtgttctatttataagcccatgaacaagaagaccaagcaataatccaggctaattatagagccataagagccggagacctaacaagaactagatgcgaagtaaccgtagcacttaattaggacaaaggacaaatatatttacatgtcacatggtgaaaatgtaagtacatatgcccaaagctaaagaagaaaaaaaaaggggaaaacacctatttttgtgcatgttctatgccgtaattcggctcctaacgaacaattaaaccgccctttgtctctccaagattagtttccccttactcctagatcagtttttgaccgagacgtcgtaattttcttttgcgagaaaaaagggatattgctatctagttgattcaacacatgaacacatgatcattaagagataacagtatgtgatatatataggttttcatttttttaaaaaaaaagaatgaaagagttcatggtcgcacaagatataggattccagttcctattgtctttctttgtaattctgttcgtttgcgatgtactcaaacacctcattacgtcttaatgatgcgtattcgccaaaaaaaagaatgtaagagttttgcctgatatattgtttttttatctctgcaatactgactcgatctcagaaattgtactccctccgtcccataatataagggattttgagtttttacttgtaatgtttgaccacttgtcttattcaatttt

SEQ ID NO: 69437 - DNA, 7414 bp, Oryza sativa
tgaaagatcacactgccgaggttagcaattgcgtggatattcttctgcaaaataacttcacattctttgccattttatgtttttggatattggaattacagattgctggatagctggtattcttcttgcatgcatacagtcatatttcctttctgtggcttctaaatttctgttacagtaaaattgaaaatatttatgaaatttctatctatcaaggatttgtcacaaatatgattataacacattttggcatgttgagctatgatactcaaaactcaagtcatactgcaaatgcagttctttcatcaaattttctttatcatttgtaccgttagctactctggtccattcatgtttcacagttacaaaacatgtgaaaatgccccaccattgtccttaaaggccctcttcacagttacaaaacatgtgaacatgccccatcattgcccttaaggcccttgttctttacagattattctctgcactggattattgaaatggattatttgctatatactttggaaaatacatcttctcaaaaaaatttcttttgctgcatttcttagataacttattttaagctatttattgagtttatttttaaaaatatttaatttatatagataatccatggtaataactcagtaatataaatcaaacagggcaacttttaccatattttatattgtaatatttcaattggtaatataaaatgtttcaattcaaattctattgtttcaaacttatttgttttacaaaaatctgtcaggttgaagctgttacagtccatgcgactcagaagtactttgtgactgcttccaaggataatacttggtgcttctacgatattccatcaggatcttgcctcacacaggtttactccattatctttctcatgtaacctgctcccattcatccatgtacttatacatgctttgtctgttagctcccaagatgtttatgagttaatgaataccttttctttactcaggttggcgagtcttcaggacaagagggatatacatctgcatctttccacccagatggtcttatcctggggacagggaccactgaagctgttgtcaaaatttgggatgtgaagacgcaggtgtgatactccggcaactcattcaagttcttttttcaggtgttcatgcatgtctgctcttgaaataccttgctaacaatcatcttttttctctagtcaaatgttgcaaagtttgaggggcatgttggaccagtgactgctatgtccttctctgaaaatggttacttccttgcggtatgaatctctccatagtgcaatctgcaaaatgttgaatttcttttttattctgatatatgtatcatcactgtacagactgctgctctcgatggagtcaagctttgggatcttcgaaaattaagaaactttaggacgatatcaccttatgactcagacacgccaacaaattctggtaaggaactttgcgcatgctccacactcacagtaaattgtgaatggtgcatgtgcttcgatgtgtgtatagatatagccaacaagcgagattatgttgatcattcaccctagatatatcttgctttctaggattttgattgtagctggaaggacatctcattccatttttgttatttgtactggagttccattaatcatatgatgcatgaatgtttttttgtttatcttacagtggaatttgactttagcggaagttatctagctgttggtggttcagatacaaggtattttctcaaaacctgcaagtctgaccttttggtgcaaatgttataccgtaaacttttatatttgatacctcctctgtttggccttcagggtttaccaagtagcaaatgttaagcttgaatggaatcttgtcaagaccttaccagatttgtcaggcacaggttcgtccctttcttatggcccacattctcggttcgtgattggcatctgtgcttgcacttaactaatttggtttctgtggcgtacacttttctcagggaaagtgacaaacgtcaagtttggcaccgatgcgaagtacattgccgtaggttctatggatcgtaacctacggatatttgggcatccgggagaagatgatcaaatggacgacgcaaagccatcggaagagtgatgaaaccaattgtacttcatttggcctgcgtaaattgctccctgtttgtgtgttttgacggtggatgagctggctgagattggaggcacataacaacgggagacgagaagttccttgcaggagcaatttggtgggctttggtcgatgtaaacaaatttgacattgttattgtatttgtaggccttactacctaatgaggatacggtttgttttggagatgaatacaatgctgaagtgctcgacttgcggacatgccaatgaaatctagaatgtgtttaaatttgtggttacgtaatgtccatgcactaacgctcgtttattcatttctcaaagttgctggcgcgatattaaggaatggtttgatggttaactaattagtcgtctaatctgagaaatctggcagcatccgaattaccttgaacagtacatcaaggcagactaagtatattgaggacctttccgtgccaccgacaagcgtggtcacataagctcactgaaatgtgggcaaagagggtaaatcctcaatttcaaacaaaagaataatgaggactctcccgtgccactaacatgtggggtcataacaagctcaatgaaatgtgggccaggaaggtaaatccttatatgtgatcaaattttaattcaaagatcaaactatggccgttggatataaatcggatggtgatgaaatatgttctggcatgggctgaaattgtcgagtggatcagtaatgggcctcgtgtgggcctcaactaaaaccctaacaaagagagaggcgcagccatcccactcacagacacacaacaagtcgattcgatccatcccggaggatcctccgccgccgccgtcccggagcgccgccgccgccgccgtcgtaccggaggtaccactccctcccctctcacatagcagccccccttcccgtcttcacctaggtcggattagctcgtggtgctctccctctctcctcgttggttctagttactctggtggtttagggcgtagagggtgtggaggggatcgggttggttgattgcgcttttttttctgtgatgtttttccttctgtgctccgtatcaaatagattgaagtgataatatgtgattcttgtggaaatgggtatggttgaaaccgctatgtccttaagagagagattggtaaggaactctgaaaccgctgtgccttaagagaattgatatgaatatataattgaagtgctaaaataaggatagtttgtagctttctttctttcaaacagctcatcattttcagggtttcggtgctgatttacctttctatagtgaagtcccttgtataatgcagcatagaggtgacaggagacgatgaaagtactcctttctgaagttttaactcctgagaggcattagaagctgtgtaaattaatgacaagttttttcattcaataatagagaagttctctaggagaatgccaacaataaactcccttgtataatagaagtctgatgttgcgttcgagttatcaacaaatatttctctgacttctctttcatgttatttcctgctggtttttgttgaacattaatggttttgatggagggtcttgtttcggttcagatcttcataagcctacggcatggcaaccactctgaaagatgcagttgcacggaagcctgtgttggcaacaatccgccttatcgttccagctggtgccgcccgccctgcgccaccagttggtccagcgctaggtttctacaggctgaacctgatggcgttctgcaaggatttcaatgccaggactcagaagtataaggcagaaactcctatgcaggttaccttaactgcctacaaggacagcacattcgagtttgtagtcaagtcaccatctgtctcatggttcctcaagaaggccgccgggattgagacagccagcggccgtccagggcacactgtagtgtcatccctttcacttcgccatgtctacgagatcgcgaaattgaagcaatctgatccctactgcaagcacatgtcactcgaggcgctgtgcaagtcaatcattggcacagccaactccatgggcattgagattgttaaagatctatgagctgcttggccccatctttgtcatgaggggagttggtgagttgcttaatgattttgtgtattactaatttttagttggggaagtaaattgtgtcctggtttattgagcagagatcttgagagttccatgcctctgaaattgccttcagcacagccttttttctctctgcaattctgatctgaaacatgtagttcccacaaatcgttctcaccgatgtcaatttgttcaatgtggtgatggtacaatgaaaataatagatttctctgatgatggactcatcaagtctgggtgaacctttgagtgaacaacctgtaatgcagcatttgctcatataagcaggatagttttccagttaatctgtgattcttccggaaatctggtcataagattcatctagcttgccttccactgcccattatgatgtgcttgcagtttcaactttaatccaaatcttcacgctgttttactacaaagaactcaatgagtaggttgtcgggtttttccaggtttttctttcttttttttttttaaaaaaaatcctccattctacaacctacattcattgttcatcttgctgtccaagtgagtttaagagaaaccgagcaaatttattttttgttcatgtgagttgaagagaaaccgagcaaaaattactttttgttcttctttgaaaagtcatcttgctgtccaagtgagttcaagagaaaccaagcaaatttaatttttgttcatatgagttgaagagaaaccgtgcaaaaattactttttgttcttttttgaaaaggaaatcgaacaaatttactttttgttcacctagtgagttgaagaccgaacaaaattactttctgttattttctaaaaaaaggaaatcgagcaaaaattacttggtagaaaacattcactgggagatcaaacgaatgtattccccagaagttcaaattcgtatacattaatctgactgccctttatctgagataaaaatgaactagaagaacagaatctattcacccagtagcggcttgttttcgggttggctctaattcataaatagacatacattcaattaaggatgcagttctcgtttacaatgaacacatttgtgccagttgaaattgatactcttcgtgcataccaaactagctggaacagtctttttttctgcttctccaaggttatgattgtacatgtttgggtactgggaccaaacagtagaaaatatgatctatccattgctgatatgttcaagcacaagatattgcagtgctattgagtacttggctgctcttccttccctggacccacaatctgaactgctaatgctcttgagtatgtaggatccatgcccatcacctaaggaagccaaattaaatcgtgcaaacataacgggaagaaacaaaaagatttagattgatagccatgaactatcatagactagaaactgacatagcacaaagaaatgaaacaaataaagtgaatcagtcatttacagttttggacaatttagttggtattcatagcagtctcatcaaacaaaactttctaagacggatacaaactaaaatgagaagtatcttgactgtcatgccatctatgtaagtgcagtgaatgaaaccaagagggtatctcatctatatattttgttactacagtgaatgaaccaagagggtacctcatcaaataagatttcaaagatggatataaaatgcaacgagtaaatgtccaaactaaaaagaattatatgcaagcacaagatgttctctgttaatgtgaaacaaagagccgatgaatagcaatagaaacaaaaggtttacttaacaaaatatgggtgaacaataaaatgacaaccggcactgtacatcagatatcttgtaagatttaccttggattgtatatattgaacttatccacctcttgtaaatgaacatggatcttggggtgtcaccttgatgaacatcagagagcaagagattacaagacccagggactccgagctttgtgctaggatagagattgagatgtttattctcaggaacataggaacatgcagaagtttaaagatctggcattgaatttatcactcactttgcatgcgcaacagcattttgacacagagctaatatgcgaaccactgctagatcccgagccctagcatttccatatctttgctgacagctcctatagtttcagtattgtcagaactagtcataccaaaaattgggaatgcacaccatacataattcaagtcaattactatagtgtataaagttctcgctttgatgatgtagatcaaacctagttttctcagaaagatcagaaaatccctaaaataaatttgtgcagcaggtggtctaatgcatcattcagtagaacaactaatagccatatcataatggagcatacagacctaacagaagtctacaccaaacattctgcacgtaaggacttggatcatcattatcacaactacaggtgcccagaattctcagctgagattattgagaccaaaaaaaaaaaaatctagaatgatcaagcaggacgacaagacaaaattaaaaacacacctttctgagaagaaatctgcaaaatcatcaataattactgcagcagggaagctgccaagcagatgaaatgccgcgaagtactttctgatgccctcatcatcttcaatgtatctacaagcacggagtacataaattagagcataaatccccatctttttgtcatgaagtaacacaaataggcatttcaatacgatcacagaccatatgcttagctgacaatagcatgcaaatctcacaaatcatcaatagtaaataaaatgtaactagagagatctcatacttgatatggattctctgaagcacgctgtgtgatagatcaataccctgaaagaaagaaataagagtaagatttagcttcacaaatgaggagcaggtgagattttgtaacccaagattccagagcacgagtagagaacaatcgctcacctgggacaagaacggggggctattctccagtctccccttcctgcagatgaacaccacgcctcgtccactctccgtcgcgcggtttatcgcgaactggaagagaagcgacgtcttcccgctgttctagcaccaggagaggcggcgaaatcggagcaagagcggagtgagccaagccgcagcatcggggatgggacacggaacgcacgggattc

SEQ ID NO: 69438 - DNA, 10543 bp, Oryza sativa
taaattttttgtaaaaaaagtaatccgagcatgtgtttaattgatttggcacaaactattgacttttgaaatgaacatcattattatgtgcttcctccgtcatataatataagggattttgactttttcttacactatttgaccactcgtcttattctaaaaatttgtgcaaatataaaaaagaaaaattgtgcttaaagtattttggataataaagtaagtcacaaataaaataaataataattctaaatgtttttaaataagacgaatggtcaaacaatataagcaaaaagtcaaaatcccttatattatggaacggaggaaataccaacactacatgtttgtcttattgaccaaagtctaagctgtgaattataaaccactctaataattcttttgtatatgctaaaaaatgaaaataaaactaaaaccattgaagtaaaagaatgacacgttcacttaaaagtaataaaggaataaagtaaatactttacgtattggttacttctctatagctctataacccatttgagaaaaatatattttacagatctaaaaattaagataagatacacaaatgaaagtctaaaaatttatatattatagatctaattgcgtttgatttgctcaggtcatctcgactaaaatttttactctctacgattaaatctaagagtaaaaagatttactcaagataatatggataaatcttaaacacccatttacatatctagaagtagttttcggatttacaatatatgtatatatgtatagtttgcatcatatattttcctcatttaggatgagcctcatcggccaacatattatacgttttgtgttgagttaaaaagagaccggatgcttataaaagctactaaggatgaaaaaaataactaaaaacataaaaaagcagtagagtggctgccgctacaagcctacaaccaatgatatgctactatggttgccgaatatgatcctttttactatggttggtgcccaaactatgagctcacggaattttcatcactactccttccattctaaaatatgaacacttctggcatttaaaatttacactaaaatataaatacttcaagcgctatttagagtattttctccaccgattatatccctctcaaatatgttcttatggtttcttaaaaaaatatatgttcttatgttgaatcctaatcattatgtcatttcataaatctatcaaaatattttctacttaagcataaattctactcccttcgtttttaaaatataacaacttaataacaaattcaacaatcttactactacggatgagattacaaaaaaaaatagattttagaacagatgaagtattgtattaatataaatttcttaccctcaaaaacttgtcgatccttctctattagtacaaccagcagcctacatttctagatgagtaaagtccatcaccggtccctaaacttgtaccgctgtgtcatcccggtccctaaactcgtaaaatcgaccattcagatcctcagacttgttcgactgtatcatcccagtccctaaacttacagatcactcgtttaggtcctccaacttgttcagttgtgttaccccggtccctaaacaggacggtctaaaaattttatatcaaaaaataattcataactttttcatgtgaactctaatgaagacaatctttatatcaaaattgtagctctagacgtgacctacaactttatagttgaaaagtttttgaattaaaactgtttagggtcccaaaatattgttgcatgtttatatattttgaaattttaattttaaaattacattttgggacaaaaaatgacttaaaataaaaaaaatcaactacaaagttgtagatcgcgtcgaggactgtaagtttgatataaagtttatcttcattagaattcacatgaaaaagttataaattatttttaaatataaagtttttagacagttctatttgacccagatgatattcaaatacaagtttagggactggggtgacacaactgaataagttagagtatttaaacgagtgatctgcaaatttagggaccaggataatactgtcgaacaagtttgagaacctgaacagtcgatttgctagtttagggaccgagatgatacaacggtggaccggtgatggactttactctttctatattctaactgctcctaattgattatgcaactacaccatcttttatattggattctcggatgatattcatcctaatatccaatatccactcattagcagtttagcaccgagactttgagattaggccaagtcaaagcggatccatctgctcatcccggaaatgaatccaaccctctaaacccggaaaccctaaaccctctaagagcacgaatgcacgatgccatttccactcggtaaaaaaaaaagaaaaaaagaaaaaaaaaagagcaaagcaaagcaacggcttttcgcccatcggaaaaccaagcacgacgacgtataaaatccacgtttttgagcgcgagaaattaatttctctcggtattttcttctttcttctctctatactccagtactccaccctccaggagcagttagcttctccccctgctttctgctcctgacgcgagagcaagaagaagaaaaggccatggcggagaagagggcttcttcttgaggtgaggttggttgctcgcttctcttctcttctcttcctcctgctgccgattcggttggcgattttgctcgagacttttttttttcttcttctttgttgcgagtcttcgcgccgctttaatccggagagcatttggagtctgacttggcttccactcgcgcgcggtttaatccccttttttttttctatttttttcttcacttctgatgatgatttcgtgctcttctccctcatcacgatttcttggcttgcaggcagctgcttcgctttcctcaccccccaaatcgcgccagaattcgatcttttccggcggcggctggtggagcgcaagatcgcgctgcgcgtttgatgggcaaggcgtgttcttggtggagtttcttgggagccgcctctcgtcctggatccgtggcggccggcgacatcctgggccggggagggtttctcggatccggttcttgctaatccgatcggaatccgagcggatggggtcagcgatggatgtggtggacatcagctccgacgaggagggcttcgccgcggcggcggtggcggtggcgacgacgaccaagaaggcgtccgtcgactccctcgggtggattgcggaccttcttagagaggaggatgagagggctttgtcggatgagttcgatgatctggaggtgatgagtgagctgtcggcgccgccggtgatggcgcagcagaaggggggcaagcccgattgcggcggcgaggaagacgacgatgattgcgtggtgctggatggggatcctgatgatgttgtcgctgtcgcgggggagaaagggagtgagggagatggcagctcggatgaattgcagatcgtcgcagagaaaggcccggtattttggcttaattgcttattactaaaattttgatctgtatttattgcattctgtgcatgaaataggagcagctcaattgttatgtttgtaggctatgtatatagagatgaaatgttctcgtaattgggggaaactgttcgtaataagtcattttgttatgatctgaactttgaattactatattgttctgatttcatttgaaggcttatttactcattgcatagtttagtttgatctcctttgttcagtgatgtggaattcagattcaaatacattggatagcgtggaagtggtttgatttaagtgcatgtgtttctttccccatctgtacttgcctatttgtctatgaatacatgtacctctagttcatgtcacttgtaataacgaaatgataaatttcatgctagctttttaacagaaaccacagtgtggagtggacatgtagtagcattcatttcttttgttattttccttaactagtagttgtctatttatccacaggtagcatgcagggacttccctcattcccgccatttatgttctaacttgcccttcagcaccacttctcatgtgaagtattgtagcatggtaagtaagaaataattttccctccagtgaatctactagaggagcagcttatagattttgttttgacacgatttccatgttcgcttttcaaatgcagtgccactgttttgtatgtgacactccagccccatgcaattattggggtaagggcaccgagatttatgatcattgtcatgctacagataaggaaaaaaagtggaaagcaatgagacatacattcaagagcaaaggtctgccaacatctcatccagaaaagcgccagaatgtcgtatacccaacaacaacgtcatttgtacagcaagatacacagtgcgaaatttcactcatacaatcgcatatgactacttactttcccaaccaaagtcatcttgcgaatgttgtgaaccaggggttaactcaaacaagacatacatcagtaagagtctcaccgagtgtagggagaactgtcagtgcaacaagaacaactcctgcaacaagggctggaagaggtatgagcaatgctcccagcattcagattcctcaatcacgcacaagattcaaacgagtaggggctacttctccaggcatagtaactctaaatgataaccagtttggttctgctgctccgaacaatacccagttgcaccagccatcctcgccacatgcatcccagccagctcaagttgcaccaagaacattgtttggtactgttcagaaaaatccccctcagagatcgctaagtgccccaatagcgcttcaagggcaacaagatcagtcggcgtcgtcctatcaggctgcctcaaacggaacacacggtacaggaccacaattttctcggtgcatttctcttacggctcagagaacacaattactgcctgaaccagcattggatgtttacagcaaaagctggcaagacataattgatagtctggcatctgatctggaggtaccagattacaatatgggcgctgcagagtctcagcagccagacaggactatttctcaacctcttgattccattacattccagggggtaggtcttcacagtgagcctgttgtggcattggcgaacttgatgccttgtaatgggcagaatgtggccaatggcatgataggcagcaattgtcttgcacaaacaacacaaattttgcctcacctcaatcaccagcctagccttgttcccaatgaatcccatcttaataattcagtaagttccactgcggacggattactaatggaagctgctcatcagagagacacgcaaggatcggattctctagatcttctatttgactttgagtttgaggattgggattcagcagagccctgacaaacaacctccgcatttctgaaccccaaggacaataaaatctggcgtcaccgacaagctggttcgttagcttccttcctaggaagaggaagagatgttccttgtacattctgtaggttcagtggtagaaatgttttttttttccttccatgggtgcttgtttacagtagcggctatacaggccttctaggccttagattagcagttatcgctctgaagttttagggatgaagttcaattcccaaactgttgttgatcatatatctatgggccataactccataatcctatatctatggtccataactccataatccaattgccagaatgcatgtttcaggtagcatagcactgaagcaaaatcttctgagcactggtgtggattggctctagtaactgctgatccagcgaagcaatgtatagtttttgcttgataatggcaaagagtgatctgctcttgaaaagccttaagctttccttgcaatgtgaaatttgtgttacaaatagctgagttggctatgcagaataccaaggcaaggaggaagaaaccaatgcttgcgttgttctacctccattgaggtaaaaatctttccttttcctcttatcgtagagatttgtcatttatatgacatgagttactccggctataaatatttgataaaattaagtcaaaaatttgaaattgtgaccgtcaataatttttctccaatacttattagttactttgaaaagtactgccataatatcataaacttatttaaatgtaaaaccgatggccaaagttttaaaagtgtaatcgaatctcattctaaactcaaatactccatttatgaccagttaaccacagggagagtacacaattccttttgttaagagtcagtaataaaatcagcatgtagaggggataataatttctttggtggccccacttgtcaggaagggtcgaaggcgtagtgcatgtccacggcggcggcgatgtgccaggtgcaccgtgtgcccttggggaagacgacgatgtcgccggcgccgaactcgacgcgccgcccattctccggcgagccctccgccgccgacgccgccgccgtcgccgtcgccgtcaccttccctctcacgatgtagcacgtctgccgcgcgccgtagctcagcgccatcctccccggaccaccgccccacctacaacacaagtacatatatacggtacaatacgtgtattttgtacaccgtataaaatacgcgtatgatgtatcggagggagatttatacttgggccaggacctggcgccgagctctgacaggcgagactccggcgggctcctctcgacggcgatgccgccgccggcggccaccgtgcacggcggcggcggcgacgagctcgaagccatggacaatggacgatgcagtggtttggattcgccaggtcctcttcttcggagaagttgcaatctcttgccggaaacaagacatagtagcatactttccgacgacttgctgctgtcgtggaccgcacctcgacatgtcggcagcggccgccggcggcggcggtggcagaggacatgtcggccgcagcctgcaggtggcgcttggtcagccacgttgaccggctgccagctggctgatgacgtggcgacgcagcactgggcataaataaatgtgtatgatgctgatgccgttgatttttcgcatagcatttggccatttgttttatttgaaaatttagtataaatatataaaagtataagttaagattatattttatttgatgataaaatatgtgctaacaaaataaataacattcatataatttttagtaagacaaatggttaaacattacgtcaaaagtcaacaatgtcatacattaaaaaaaacgagaaaattgacattttaccatcatcaaaaaggggtttcgcccaaataccactatgcaattgggattcaccaaaataccattctcaattgaggggcttcacccatatgccattttcttccaattctctctttcctctcatcattattgaccaaaatggccctagttgaatcaatttaagtatatcaaaatacgtagattataaagtaaatacgctaaaatatttttacatgctatttttttcttacacagtatgcatcgtattatatccataacataaaaaaaaagacactatcaacggaaactctcataaaaaatacgtaattatttttttatttatgctgtggagatagtgtcttatactctgtaatttggtgtaaagaaaaaaatatattgcatgtcaagatatttggacgatatgtactttgtctgtaatctacatatttgctttacttgaattaattcaactaggggcattttggtcagcaaagatgaaaggaaagagagaattggaagaaaatggtgtttcggcgaagcccctcaattgagaatgatattttggcgaatcccaactgcatagtggtatttgggcgaaacctgttttgacgatggtattatgccaattttctcgatttttgtagttgttaacccttgctatgaaaaatctgaactttgacaacggttattcaacccattcattcaactgaaagtccttaaattcagcagggagctgaagacttttgtttctgattggttttgttaaaccaaacataatgctctagaacttcaaatgatagctccaagggaagaaatcacaagtccaatccttgacctggtagtctatgactctatgttacaaagagatcaccatgtcccaacctgtcgacttttgaacaatagctgaagcatggatcttttttttttttgaaagtagaaacatggatcatttattcaatgacaatcttttttttgtccctcgcaatttcgacaaggtctaacacaggtacttagtcaggcgtggatcggattgccatggtaggccagatcgtgcgccgattgctctacatttgatgcctgcctgaagcatgaacaggaaatatcccaatcaaggtaagaagtgaagaacaaaaaaactagtagtatttttgtttcatttctgtaaatgaaggaagttgttataccacttggcaagcaaaaggcagcatcttttctggaggcatctctgtggatagtcctaagtatattcaatagaggaaacattgaggtcacaataaataattaatgataggcgatagctaactggattttaatatttagttaaaacaaaaatacttgaatagcatcatatatataagaatcatattcttgagcaaagaagtagtaatcttaataactgtttatgtcgaattcccgtctcctcagggagacataatgaagaaagtaaatagttattctggaagaagttaatggctcaccatgaagtactgctcctatgaatgcatcaccacaaccagttgtatcaacaagctctgaagctggaatactttctgctgttcctatgagcagccttgcaaatatattcccagaccctcttgcagtaagtctcatgaactagaaagtaaaatggaaaaaggttaggtaaagcagtaaaagagatccaaagcagtcatcaaattactcacatttctgatgacataacaatgtaaacgattttgattgccagaaatatctcataccttagatgatacacaagttggcaggatatcatctttatctactttcagccttaaggactcagcgacattctctatatctactggctcagtttcataattttcacctatttaagagtggaactgcagataaataggttgaagtcacaaaggcaaaacttatacacaaactttatccagcatgtaattaaaattgtctggacaagatcaaaactaaccatctttgcccctctcaagcatcatgcatccattttctccaagggttacaactgcgaagcatgcacgaggatattgcagaaggatttctagtagtgcagagggaatagatgggactgatgtccatttctgtaggtaaagagtcactgtaaatagtgagtgggaaaaaaaactaatgcagctttactaaagcatgccttttaaaaccattcatgcctgtcaaaatgtatcacaaacctctggaaatttcccattacagactatgtaacttgctaggctgagcaaacctcccaattcttcccttgttctttctggttcggcatcaaccaaaataggaatcttcatctgatcagcctgtacatttctggttttaatcaagcaacaaatcaaaatatgatctaattctctacaggtttatgatactgttactgtaaaacaaaggtcatttacattattgaaatttacctagacagtactaactactaagatgtatgaagattggacaacctagactacatggtgaaagcattacatgatacatgaatggattaatgttgcacactccaaacgaacttacctgcttagcaactgccaaggccatctcatctgaatatccatctaagtatagtaagcttacgtcttgcagtgcagctgacaaacttgacattctcaagtcactaggtatcattggagggtaccctgatgtgattatacacgtacgagtttttctgcaaatgtaaatggcccttctatgaatatgcacagaaacttgctatgatgccagaaagtgttattgtaaaaaagcaataattgagtaagtgtggctaaataaccatattgcttagacaagcttaacagcttcaaccatataaaggatgttcagtaaccagcaaaacaaaaaagtagtgaccaaacatcaaaatggtcaagtataaagggtcagttggagggtaaaatttttatccttatttacatgtatctactaaatgcatatatgccctatttccatgcatttttttcctttatctgatctagatgcccagtcctttagaataactgagcgaacggtgtacgcgccgaaagggaagtttataatgaagtgagaaccatgatttataaaagcaccttgtttttatatataaaaaggtaagtcaggttactctaatataaataggtgtaacaaaactaaaaattggttgaacttcattcgaaatgtacctgattgagtgtgcaaggtgaccagaaaattcatttggaatatttcagaaatgcttatcattacaacctaggagcatgcctttaattgt

SEQ ID NO: 69439 - DNA, 2795 bp, Oryza sativa
tgatgaaaaaaaaaagagaacatcagcacttcagcagggttgtacttgtaaataggcaatgctgtacaaatagatgactcaatttgacaattcagtaaatgctgcactgtaaatgctaatttcaaaatgactctaaattcaatttaccttggagatgagcctcgtgttgaggcccaggcgggcggctcctgtcagcgcgttcccggcgttgccacctccagacacctgcaacaatggcgaaaccccaagaaatcgccaggagcgaaacgtcaatcttttccccatgtttcttggtgaagaactaaagaagtggggggtttggtttggtgtggtgtgtcacctgcagctcgccgctgcggatcttgtcgtcgggccgcgggtacgcgtccaccgtggcgaggtagtccagcgtcaccagcccgcaacccagctgcaagaagaagaacacctcacgccaggagtcaggtcaggtcagaccaaccaaaggcagcgggagagcagagggcgcaaatcacagtagctcaccacgacgcggcctgcggcggcgggagcagcggccggcgccccggcggcgcagcggagaggagggagccgctgcggcggcgcgggagcagaggcggtgacgccgccggcgagcagcccaggaggagcggcatggtgagagcgagtgattaccgctcgctgctgccggtggagccgacgagagttgtttggtgggtagttggatggatcatggatggctcccgttgtcattgtcgcgtcgtcacctctgattgcgtcattccatttccatggattgctcgatcagttcagacattttcgagttgaagaaaaagtttagaaactttcacctcaaagaggggagaattccatctcaaagaaagaatttccgaaactttcagtgcctgtaatttttatttaccggcatccaaatcccaagaactgatgttcttatcagtgaagtttgcagacctatcttagacatgcatggttcttagaaaaactgaacacatatgtcgaaaattttttgggactcttgcctttttaatttcaagtaggattgagctaacaatgatgccagtacagcaacaaaaaaatgcaaatatatttctttcacacctcaagttcactttataacttaaaaacacacaaagaaaggaaagaagagccctcacatttgcaactttattctgcagaaaagcccctcatttggatcgcacagaaagaatggctgagagccagacgaagacgaacagctcatgggccttaattcgggatgtactatagactttgtttcatggaccataaaaggcccacattgcgagcccagcccaactccgccacggcaagacgcaaacctaagcttaaaccgcaactataaaatgcagcactatctccaaaccctcgcgaaccctagcgccgcacacacgctcaccccacctcttcacccgccgccgccgccgccgccgcgcgaagggaagcaggaggaggagccgccaggatgccggcgggccacgggctgcgtgcgcggacgcgcgacctgttcgcgcggccgttcaggaagaaggggtacatcccgctcaccacctacctccgcacctacaagatcggcgagcacgtcgacgtcaaggtgaacggcgccgtgcacaaggggatgccgcacaagttctaccacggccgcaccggccgcgtctggaacgtcaccaagcgcgccatcggcgtcgagatcaacaagcaggtataacccccgatccccaaacaccccggcggcggcgccgcctctttgtcatagatctgtggttgtgtcgcttaagtgacttggtgtcatgtttttgccccaagtgactttggaatcatgtagtttagttgtgccaatatgaaatttcatttttgcagttgcaggaatgggaagccattgcatactcttgcatggttgtgtaagatctgataaatagtgtagtctagatggtttactggttatatttactggtaacatttgtgcgattttactttgtgctttagtatttggattttgttttctctttaaatgtattgagaatgttgtgtactgaagtagagctattgtgattgtggctttggttcatttcatttctaggtttccattcgtccaagtaggatagtggcaaatcaatcctcaagtttacgtcgattgtattgttatcggttatgtggaaagtttaaccgtttggttttatgatgtagttatgagaagtgcatttaaagatatacttctgattgttcatttaatcctgtgtgcatgtgtagttatatgtttcaatcatataacatgctaccgtctaaacacattctgttggtgtagataaattggatagatatgtagttagctgtcggcatgtgtaatgttcagtcatgtggatatgtagtcttcgggattatttaatttttgaaatcatgtatctgttttactgattgtttgttaatctcttggtaggttgggaaccgcattatcagaagaggatccatgtccgtgtggagcatgtgcagccatccaggtgcactgaggagttccgcctgaggaagatcaagaacgaccagttcaaggcagatgccaaggctcgtggtgaggtcatcagcacgaagaggcagccgcagggtcttaagcccggcttcatggttgagggtgcaacactggagactgtcacccccatcccgtagatgtggtcaatgatttcaagggtggttactaggattttcaatctatctgcctgcgctaccaattttaaatccctgtcactctaatgagtagaagtttg

SEQ ID NO: 69440 - DNA, 13912 bp, Oryza sativa
  unsure (1)..(13912): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggttttatgacctattgaaaaaaaaggatgaatttgagtattccactttagcaaacaatgaaagattaaatcatgcaaaacagtaaatgattgaacttcaagcaactattagttccaaagagaacagataacagtgcatttaaggattctgatatacccaaaattttctgtacctgcttttgacttttaaagtctgatacatcccacagacgaatagatccatcttctgatgacgtcagtatggtttcttttgacttgggattccattcaccaccggtaagcccagaaatgtgcccttttgtattcttcagatctcggatatacatgtcacccttaataaactcacctagtgtgagcccgtcccgatcatatatctgattacaagcataattccaaacatcaatacaattttcaagtcatagggagtgcacttttgggaacttacagaagactataaaggcagattaccttggcctgagctgaaccagtaacacataagaaccgatccgatgttgggctccaacttaagctgcgaacttggtgcccctcaaagggttctaactgcctgaatgattgcagctttgagttcataccttggaagtcatacatacatacagtgtagtcatagcttccagagagcactcgggatcctgtatggtcaacagcgagggctgagacaacctgcaaagaaaatcatttaattgttaaccagtaaatacaatatgtgtatctagtaatctcataacaaagacaaaaaaaatggttctggaattaacctatccctcacttgtgtacctcaactagattaagcaatcaacaaaaccaagtaaacaactaagcacgcaaagttgcagaaatcccttaatggcaccaccaggagaccaaacctttgagggccatctcaagaaagcaccatttgatttattccttttcaaaactaaaatttaccatgcccttcatctagctaagatcaccaacaattctctttctttggacttgccaagtcgctcaattaggccaaataagtcaccagtaatactcaatcataaatatatcttctctggaacctagcctacaacaatactacagacaacaaaatgtgtaggaattctggtttgtctaattcagctaaataactgctaatgaaaccaacttagctgagctaaattattcacaaaatgatacaaatgtaaatggcacaataaatatccagaaatttgagcacacaaactttagcaaggacaaacagataatatcggcgagttgcttatgggctaccttggtgtgcccccgcagaacaacttcgttgctgagaggaatccgattgtaacgctcgccgtcatcctccatctcgtcgtcgctgtcatccccatcgtcgtcgtcgtcatcctcgtcctcctcgtcatcatccttcaccggtggcggccgaggcggcccaatcatgccgccatccgcgtcctccccctcaccgcgagaggacgaccgcggcggcggccgaggtggcccaatcatcaccccgccgccctcctcgtcgtcctccccctcgccgccgccagcgggctggggcgggggccgagggggcccgaccatgggcccttcgtcgtcgtcgtcgtcgtcgtcgtcgtcgtcgtcgcccgcggcggcggcggcggcagcggaggaggtggagggcttggcgctagggttttggggcggcttgcggagggtggaggcgtgcgcggaggcggcggcgccggcgcgcgtgggcgccttgccgaaggacatcgggaagaaggcccgcatggcctcctcgtccatctccccgccgtccgccatcggccgctcgccgctcgccgccgccgcgccgacgtcctgtgcgctgtgcgcgagacgcgcgctctgtttttcttttctttttttttttccgagcgggtcggtgcgtgttccagcacgggcggggagaggcgtggtgcctttcggagaaactggtcgagtcggttcgtcgcgttaacttagggcccactagaaaaactgcgtggcagccacgtatggtaaagtgaacccagctcattcgactttagtggagtatctaattaggaccccttaacttgaaagaaaaatatagaaacttttattctgtatagaataatattttttttctatatgattatttgaaccaaaggattattgaaaactatcgaatcttatcaaatttctaaggaatgcccaaattcatataagttttggagtatttttaacatgaggtccaatatcatgcaaagtcttttatgagtttatctctatcatccaattcttgcatttttcgtacggtccaatcaaatggtgatttcatatattttttatgtgttttataattctttgttttgcgcttgattttttgttagaattgtatgtttttcctattcatccctcgatcttccttccaaagtagcccttacaagacatatataggttgcatttgactgagggagaaaagagaaaggggcaattttgtttgtacccctactttaatatccaataccgattttaccctatattttagggttgttgttttttgcccaatttttttaaaacggatgaggcatttacctttttttttacggaaatgagtgggatcggacttaatgcggtaaagaattagagaaagaaagagataacgatatttaaattattgattgacccttttacccctagaaaatatccaagtaacgcttgggctgtgtttgaaaccatgagttcccaacccctctccctcgttttccgcacgcacgcttttcaaactgctaaacggtacgttttttgcaaaaagtttctatacgaaagttgcttaaaaaaatcaaattaatccattttttaaaaaaatagctaatatttaattaatcatgcactaatagatcgctccgttttccgtgtgggagggtaacgttccaatccatggctagcgaacacagccttggtgtactttcaggcttgggcacttggcatcgactattcccttcccaaacccgaatctccgttgtgaaacagtggcggcagtgttcgtgggccggccaggcaacggggatgactcggccagatgcaggccacccaacccagttgcagcgtgcaggagggggctaggcattgcgcaagaggacgtgatagggaggaggacaatggcggctgctgtagttcagcgcagggagaaggcgtagctgctcgacgtgtcgaggagacgacagggaggaggacaacgggtcaacggcggtggcggtggctcgatgagaggaggaggcgacaacagtggcttagcgcggggaggtgatggtagcagctcgacgtgaggaggaggcgacggcggcggcggttcgtgagaggaggaggcaacaatgacagcttggcacatgtaggcaatagatttgcttgacttgtctatttgttttttttttcaagatgtcaaatttttaagcaatttttttgttgatatttctatcaaaattattatattggtaaaagtatatcaaaattgcaaggttcatgtgctaaatgtggtgcaaattctcaatcatgaataaaaacaggggaagttgcaacatgagtaagagtattgaatgccttctcactgaagatttaacatcgttaatctatccatcaaaagtaggggcaaaatttatcttaatttaaaaaaccatgggcaaaaataaaaccctaaaatattgggcaacatcaatattaaacatcaaagtagaagaaagaatgaaattgccccaaagagaaaaggtcctatgatttcggtagaggaaaacacatgaaagaaataatataaatcacatgaatacggatacaaaataaaaggatggatgtttgcaacttaggaattttagtgggtgatttgattacatcctgttaatcctcttttagtctctaaccaaagtatgtattattacttctttaatcctcaatatccggtggtaggaggaagcaatagctgcctgagctttgccagctgtacggcggcaacgcgactacgcgggaaatcacatagcctacagtgcccccatggacctaagagtaggtaaaatagcaggctataagccagctgcaaacatattttaagaagataaatgaggagagagaagggcagcgagctacagatttgtagccagctgcagcacggactccaagacgcggtgtgtgtatgacgggtgggaccagatattaatagtgtagtatgtaactattgtatgaatgagctattagattcgctatagatgaattgaagccagtagtgggctatactattaaacttgctctaattgctccatcgatagaaacttccggacgaccttcttgacaactgttgcacgcacgcacacgagcgtttcacgctgcacgcgcgcaagcaggaacgagccgttccgcgaaaccggtgttgccacgtggcacaattcttctttggatttttttgcatggaattcgtattataagattggttattcacatgattggaaaaacacataaataggaaaaacataggattttaagtggtaggatttttaaattctatggaaaagaaaacagagcaaaatgtaagaagatcctttaacagaggcatagggaaaacaaagaaatttacacatcacttcatttccaagaggtctgacctctttttagtttcctttgaaatccactcataaaaatgcaatcctatggaatttatacttgcctttcctataaatcaaagaggcttgaaggaaaaaatcctttggaatcccattcctccgaaaatcctttggcattcctttaaatcaaagaggcccattattactacttcatctcggttttggtttgttacaatgccaaaatattaacaatactaaacccaaattttaatagcgccaaatattttaggggttgttcagattgatgccattttcaaccatactattttttggtaaagttgccaaaaaatgtctatgtttaatttattgccaaatttggtagatacataagaaatcttgccaaaattttggtaatattaattttggcaatattgctaacttgctaaaatttggtaacgtttattttttatacaatctgaacaggcgcttagcaacttattatattatattgggcattggcacattttggtagtaaatcaaacactagccaaattattattcaaaatttcaacaatcaggtgtcgacgtttgatgtcgcgattccggtatttgcatactatggggatcgttggtactaggatatacgtgagattgagataaaagagatggagacatggatttttatacaggttcgggcccctgaattgtcaggtattaaccctacatcctgttggccaaagccgatattgctcttattcaccataatcacaccagtacaatatttggggtagcctatctaactgttgttgacatggcggtctgaagttctgactcgtagtcaacaacagggtagtcttcctcctcgagttcgtgcccggcgagatcagagacatcgctagatccctacggccggcctctgtaggtaccggatagggtcgatccaggcatatctctgatgtcgatatacggcgccttgtcttgcgtatgttggcttgtatgttgatctgttctcttgatctattatctgtgtccccctctcctcctagggtgtcttgtatttatactcataggtgtccccttgtccaaatanaactagtgaanacaatatggatccatctgagtagtacttgtcgtttccatgtataactctagttgtctttccttatccaaaactccctccatatccgaggtcagttttcatataagacatggtatatggtgggtcctgtcaagatttaatcaactactattaggtatatggtatctataaccctgacatctgttagggcatattttgacatcaaaccaaaatgtcctccgtcttcattctatctctcaatttatcccaatataaatttagtttatagtagttgttgcatcgtagtttgtaaaagtagataataattatattaaataagataatgaactcacctaactattacggctaaatagtaaatgtacaagattgtaagtataggttcctttatggctattggattttgctcaaagtatattcgagaagtactaattcgcgcgtacgcgcatgatatcttaccagcgcacggacacatgtcactcgtgaagcgtaggagcgcacggtgctataggataaaatcggaaacaaaaaatgattagtacggttgtcgacgtttgttgtcgtgattccgatatttgcatagtatgagaatcgttggtactaggatatatgcgagattgtagtaaaagagatggggacgaggatttttatataggttcgggcccctaaattgtcaggtaataaccctactcctgttggccgaagccggtcattgctcttattcaccataatcacaccagtataatatttggggtagcctatctaattgttgtcgacttggtgtatgttgtcttgtatgttgatcttgtgtcttgatctattattttgtgtcccctctcctcctagggtgtcttgtatttatacccataggtgtccccttgtccaagtagaactagggaaaatcaatatggatacaatctgagtagtccttgtcgtttccatgtataactccggttgtctttccttatccaaaactccctccatatccgaggtcagtttccgtataagacatgatatgtggtgggtcctgccgagatttaatcaactactattagatatgtggtatccataaccctgacaacggtgattagaacgattagtacggcgattaggggattattgtgattagttcagatctttttgtttcttttcgaataattataccgtattcagcgttgcttctttttaacttttcaaatataagttagatctttcaaataaaattttgaaaaactctacccaaaatttaagacatcatatcccaaatttaaaactttcaactcatatttgaaaacattcaattaaattttttttttcaacatatacttttcatctcaaatttgaaaaactttcaactcaaatttaaaacttttagttcagatttgaaaactttcaacccagattggaaaactttcaagtcaaatttgaaaactttcaactcaaatttaaaaacttttaactcaaaatttgaaaacttttaactcaaatttgaaactttctaacacaaaatttgaatcctttcaagtcaagatttgaaatcttttaagtcaaaattaaaaactttcaattgtatatttgtaaagagttgtgcgaaagattgaaaaaaattggaaagaagcggcacctgcccttttttatccaatgtggaatcgacgacctatgtataaaaaaaggagaaagtttttgaagaaaaacaccacgccaaaatcggacgaaaaaaatgaaacgcgtgaaaaaaagggcgccaggagggggcccaactgacgcgcgcgacagttaaattgctagcgcgtatgtgcgtgctggaactgtatcctctgatattacacactaatgtcacggtgtgatattcttgaatccagaccatccaaactaaatcaatggctatagattaattggcatacaagtaatcaaattaattagcagattatgtagttaaatattaccatacttaatgagtaggaaatttttttagcactaaagtagtcccttcatgttcattaacatgagcccaccaacttgtagattaagagaattgtctttttcttatggaagatgtggcaacacaaagaaaattgatgcacgagattcattccttaacaggttcatatgctaatcattgcgtctaataggtaagttaaacctaattatcgtcatgtgctagttacttgccgattcctgtagcatttagcgatatttgcctccttgataatatatttggtctactggaatttgtttaactacataatctactaattagtttgattaattgcatgctaaataatctatgaccgtatttagaatggatggtgtggatcaaaggaatgtcacaccgtgacattagagcatctccaacagcctctccaaatcgaactctccaaacacccacatagccaaccctccatctgatttggctagtcaaactagttgttcacttcaacagtctctccatctaccctctctattacaactctattacaaatgggacccttatgtttcttcctccctccagctggactactgcattctctccggcggagaacagcgagcggcggcggcgctgtgcggaggccggcggccgtagcgagcggaggcggcgagcggcggcgccacgcagaggccggcggccgcggtgagccgaggcggcgagcggcgccgcgcggggcggcgggcggcggtgccgcgcggaggccggggaccgcgaccagccgaggcggcaggcggtggtgccgcgcgcaggccggcggccgagtcagagcggaggcagcgggcggcgccgccgcgcggaggccggcaagcgaaggcggctagaggcaccgcgcggtggccggcgccggcgactggcttggtgcggcggcgagagaaggccggcggtcgccgtgctcgtcctcgtttccgtgctcctctcgcgcctatccctggttgcctcgtgtggggatggagccatggaggagtttggctgtgtgggacccaccattggccagccaaatagaatggccaaatttagctagtgaggagagggttttggccagccaatcggggttagccatccggttagagaggctgttgaagcacgttttttgggtgaatagctaaaatttggcttggagagtgggatggagaggctgttggagatgctcttagtgtgtaatgttagaggatacggttccacgcgggctagggttccccaagtatattttcaatcctaaatataaaattggttattttttcctaacttttaaaaccaaacaaatagcatctatttcttttattagttttgattggaaatggggttggttttcgtaatatattattatgcatgttttgttacatgtagatgccaattaaaacttacctaattgaaactgcaaacaaagtttcgtaattaagggagtataagtaatcaggattatttgtgcatccttaaagtgcagcggtggggatatttattccattattaaaaagcagcaaatttgcaatactacaatcgacgtcgcgagaaccccaacgcgtacacatcagcaaaacacatttcccggtgacataacacaaacacgcccggttattattatttggaaattaatgaaattgatccagagagctcgatcgagatgatcatgcgtcggcggcgcaggcgaggccgcagcgctcgccggcgacggcggcgtgcagcagcagcacgtagaggagctgcgtgaacgccagcgtcacggtgagcccctccagcgcgcgcatccgccacccgcgcgcggcgccggcgggccccgccgcggcggcgtcgtggatctccctgcacgccaccccgaacgccagcgcggtggccgcccacgcggcggtgccgagcgacgccgcggcggcgagcccctgcggccgccacgacgcgcccgagcggccgccgtggtacgccgcggacgccttcgccgcgacgcccagcgcccccgccagcgccgcgaacgttgcgaggtggaacctcgaggcgaaccacgcgctctggcggtagtacggcgaccacggctgctccccccagccgacgccgacgtcggcgccggcgttcttgatggagctgttgagcgcccacccggcgaaccccagcaagaagacgtacatgaggaggttcagcagcagcagcgaccccgccacgttcctcctcccgagatgctccaacgccatggctgctaattaacacagcttgatcgaactgttcgattgacgaagacgagcggtgtcgcgtgtacttgaagagggtttcgtgtgcgtgtgcgcgcttcgctcgcggtcgatcgctcgtcgccgcacgcgggctcttcccatggcggagacggcagcgcgcgcgtcacgacgggcgtcggcgtcatcaccggggcggctttagcttcgtctcggcgttcacggcgagcaaaagatgagaagaggccaaaaaaagcacaaaaggcaacggatcgaggagcaagcgatcgaagctctcgatcgccaagttgctgcttccgggtggcaaaacgcgactactactgacaaagaggctttggcctgatttgtgtgttgccgtgggagaagctttgccgtttgccgtgtgccctcgcaactgacaatgagcaatatcgtgttttctcgagttccttgtgaaggttgtgaaactgttctcgtagctggtaaccaacaataaccgagctttatttgctttctacccctccatccaaaaagaatccaattctagctatgagcctaaacatatgcgtgtccaggttcgtagctaggatttgcatttttctagaatggagtagtactttatagtatatctttatacacactgtaatgaaataccaatctcaatgcatattagaaaagttaattcagaacgttagatagacagcctaagcttcacatggtcagagccacaacacacgtgcaaattttcagacatcttgtgcattccattctaggagtaggtgaccatttgagaagatagtagttggctgcttctaactcaactttctgacgaacatagacccttactggtattctcattgtagtcaagagcatgttccaagtattcatggaacataatgcagcagtacaagcacaagaacagtagtgctctttctgcatcaacaacgctgcgaaagagaattcttcatgtctttcacttcacaacgttgaatcacttggaatctatcactgactggttcccgttagcagaattgtcctccttcaaggaatttcttaggtacggcgagtctttatacttggcgtataatggtaaattcagggccttatctgatatccttgcatcctcgtgaatcctctctatcaagctctcaagtgaaggaaagttggcctaggcattttcataacaacgtgacaagtcaggaacatgcatcaacatatagtgggatggcttctgcagtataaatagtctggtcctaaattacctcgggtcgtatgtaaccaacaataacaaggcgcagctcctctccgtaaaagtcttcaccaaaatcgtgaagcaaccatggttcctgtgaccaatgtcttttagaataaactaatatactgaagtactaaacatgaaaggggatgtattgagaaacactcacaatagtcttctccgtgttatcaaaataagggttccagccaatgctcatgaccatcttaaatatacctcgcgttgaaagtccagcccagccaaagtatacccctgatgtatgctctgatagtacgtcggagaagttttctgcaggtaagttggctgcaaggaaaatatatagctatcagtgctcacaatggaaattcggcatgctagcattgaaaaaatgaatcggctgagtactttgacatggtccagcaaataaagagagtaacacaccatatgagaaaaatcattcttgcaattcatagaatgtaaaaccacaaaagccgtagagctcataaattactctctagttatatgctccaccatacctgttggaattcctagtactttagaaccacggccaaatcctttaatcacaggtccaccaataaaccatggttctattggtaaggtatcatcgatccctgcataagaaatatgtcagtagataagttaaagatgcccagaattttctaacagaagtagtcccaagagttagagcatacaatcactaaatggtggcaatccccatttttcaggctttacgtcaaggagggaattgatcacctcatcagcagaactgaattcagcagtccttttggggactgaaggtacagctatgacatgcattcctgcagcttttccagctgcaacacctggtctagcacaatcaataacttacagtattaaaggtaaagttgtgaagagaaaagtagaatatgcacagttatgtttaagtgtagatcaagataaaatgtacacagctaatcatgcagtgcaaatttgcacacaggagaaccatacataacaggaaaaaaacttacaaggagtcctcgattactaagcaatttggaggatttgtattcattcgttttgcagcttccaaaaatcttgaatatcaacaccccagcagttttaaggaatgtcggaacaaaagcagatcaaagcaaaggaaatgatatgagatgagttcaaaagatccataaagtaccagtaacgaaaatgctacatagcacacagccttacatatctggggatggcttccccttctctacttcatcaccaccaacaattgcggagaacgactctttccatcctaaacatggtgagaatacagtaattaatatatgatatatctgtccacaaaatcaaagaaaatagcatgcaaattcaggaaaaaattttaccctaaagtatgagagggttaccttgatggcaggaaattttgcgtcaatgtttgatcttggtgagttggaagccaaagcagctggtactccattactcttcaaatgttttatcaaccgattagctccaggaagagcttttatgttgcaccatctgcaatatgaaattcattatgagaacacgatattttttccctttttctatacaatcttctttgcacattacaacatgaaaattttatcttttgaacaatacaatctttccaaaacttcagtttaaaataaaatctgcataaagggctttactatgttacacattgaacaattcttctccatttatataaagtacttctctgcaccatacggaagttcagtttcatgttcaacttgaatcgaaggagcttaacaaaccagatattataagaaatccggctatttagtgacagcatacgtagtttcttacacagtgacttacaaagtgaaacttgcatttcattatttcaaacaaatgctatacaaaaaaacagacatacttcctacttggcattgacattttgacatggttccataacaactagatgcttgttcatagagtaaggtagaaaaattggaatccatgctaataaactatagaggaatgtgtaaggccaacctactggtgacattttatattactattatttccatgaatcatttggcaccaaattcatcagagcatggcgtgtcgatgcatattatgtgcagatgcaaacataggtgatttaggtgcaccaaaggaagagatgatttaagatttctcgaggcaacattttgggggatactgttgagaagtggtctataaaggacacatgtcagtaatttaaaatatccaaagagaaatgtacaaagattctccattgaggtagcacggcagtatgcaatttacaaaatgcaagttatatgagtgttaagaagtttcagcaacagtactgctcattgaacattggagtaagcattgagagaaattcttctgttgagtaagggagtccataatcttctaaaacaacagctgctgcctcataaggtgtctttccaactaatttatgagctttcttgctgtcccactttttcccatttttgactagaaatggtttcagcacttgacttacaacacagtctgccaaatggtta

SEQ ID NO: 69441 - DNA, 5470 bp, Oryza sativa
atgttcttataactaaattagtaagaaatcagaattaaaagcaaggttttcaagctttgatggaaaatgagtactgttcacaggcaatcagtatacatacatattaagcaatgtttagggtgatcatgaaacaattggaacaattaaatgcttcatatttccatatacgcgggcttgctattttgttgtaaaattggaactttgtttcaagctgagattgtgtttaaaattgctcctttggctgtcctcaactggtcacataagttcactcggtttatactaattaaggttacgaactaaatgatgaggccatgtcatcagcactagactgaattctacaagatggcaaaggcaaaatactggcatgacgcacaataaccctccagcccatgctaccaaggtgagctgaaccgtccgcaaccagcagcaacagattgctgcgagacagcctcagacttggcatgaagccaaattcgcccgcttggggcgcccggctcaaccccaccacactagggcatttcaccgaacagctaccgcgcagaggtgaggcgactctatacgtctgagcaacaagggcgatcccgcaatctaatccaatccccccacccgcctttgtcgttcccgtagctacccgagcacgcacccgccaacgcacgcgaaccaaccccgctgctcggggaaggcatcaacggcgatgtacgccccaccccccgggcgcgcctggcggaggggaggaccggacgagcgaagcgaccacggtggaggtgaggttcaggagggctgcggcttaccccgcatgtgtccggcgacggcgtccttccctgcagctgcctccggcgacgggtccggcggccttggcggagggaggccggggaggaggggggataagccgaggggacggtgggacttgggacggaatgattcgggtggaaacggtgagtgggtgggagacgtgggagtggggatggggagcgacccggagagagacgggctcgaatccgacccgcagaggcggcgatcggggattttttttaaactttttatttttttaatatttataaaaatattattccgataaaaatatttacataagtaaaccctgcagccactaacggccgctgagcgggcatacgaattttgcatgcgatgaaaattgcgtttcgacaagggacctcaatgcaaaatacgcacacggcgccgtgtgccgcactgccacgtcaccttgttgctcttcacttgggcgggtctatttctgtaaatattaaaaaaaattaaaaatgaaaaaaaatcgcgatcgagcagctcgagaagtgggcctcacgcgatgcgcggaggcgggcctggccgtgtgatactaagcggccgacgatgaggcccaacacctggcatgcagagtcaattaaatagttctaataaatttaaataattaataagatgggttagtattatatatcactccataatctaattttaaattcgaattcaacaaattataaaaaataaatttgactatgaattcaaatggttgtttttttggttaaagaatggaattgctagaaacttttgcaagttttttctcccaaaacttccagatttgtggccatcgaatcatctcaagatttatgcatgaaggaaaaaattgctacaaagaaatttttacacatataagcgtaagatcccggtgctagccaatcaaaccatagtcgaatataagttatatcgtagttatagtgcaactatagggcatgtttgggggagcttctagccgctgtagcttctcctagaatcagaagctcccctaacagtttagcttttggttcagattctgagaagctgtagttatagctagaaaataaactagaagccaaaagctgggaaactcaatttttccaaattctcagaaattggttaccaactagctgcttcttaaaattttaagctccccaaataggcccataatatagttacaatataattatactttagttattctatacttacatttgaaagttttttactcaaaattacattctatcattcttaagtgactagctaagggcctgttcactttgatgctaaaaaaaaccttaccacttgccaaaattttggtagtatttcttatatagttaccaaaatttggcagcaaactaaatgtagttattttttggcaactttaccaaaatttggtaaggttaaaaatggcatcaaagtgaacaggccctaaatacccatgcgttccaatgggatttacaataaagcccaaaaagaaaaaaaatcccaacctctaatcatcatatcatatattcatatttggtatgcttctaatcggtcgtccaatccaaacataaaaatcggacagctcttgactgccttgctctgacatttgtgaccgcacatcagcacatgcgatgcatgccacctttgccagtgacttgctactgcatacctattgctactctctctcttctctctccactccatgcttgcatgcatacatttcataatattcaaaacgatttttctcctaaattacttatccaatctacaattcgatcacaccattgtattcgttgtaatgaaatcttcacaacaaaatgtcacatgattatattataataaaaaataattatatgtttcaatctgttaacattctttgtttcatacgtaatagcgatatgtttcaatgtgtgtattcaacatgtttcgcaaaatttccaaaactaactgcactactctctctccacctcatccatacatgcatgcatgcattttaacaagtttcaaaatactttttctcctaaactaattatccaatctacgatccgatcccatcgttgtattcattttaacaagatatggcttgattatattttgataaaaaaatagcgtatgttttaatccgttaatacttgttgtttcatatgtgacagcgacatgttttaacgtgtatcttcaccatgtttcataaaatattcaaatgtttcagttgctagttttttgtttcaccatatataacttaatgtttcacttgttggttaactgcaacatttgaccgtccgatattttttggggcattggacgtccgatgggtagattcctcctacccatcggacgtttaatgtttcacttgttggttaactgcaacatttgaccgtccgatattttttggggcattggacgtccgatgggtagattcctcctgtacgttgagctactcaattgatcgtagagagtaacaattgatataaattatccatattgtattttagtgtatctatattattgtatttgatttatagagtgaacattgacatcatgggcccacatgaaagtggtggcggtggtggcagaaccatcactacgactatagaaatactaaaaaaatacatattaatatatattttcctcaaaaaatacatattaatttagggttaggatttatcttataattcttttaaaaaatgtatttttttataaattagcgtggacatacactcaaagtgattagaatctctctccgagctcatctcgctttgatttgcctagctagattatttctttatttacactataacttacttccattagattagatatatgattgtatattttttttcccttataatcgatatatttttctgatcatatgctatcacgttcttttattttagaacgtacagcaccttaatgatcatgtggtaggcaataaccacgcgtccatgccaatgttagaaggatatcatagccctaagaaaaacttcctaacaaaagtttgatcaccatttgacaaccatcctctgcaccaaccaaaccatgtcctgatgtcatgtgaccctcggtataagactgacccaacggtcggtaaactgaaaaaaacctcactgcaacgaacgagaaagatacatgaaacgaacgaaacaatggcttccatatggttctctcccacctagtactagctaagctagcttctgcttcacaagttattattagctactgcattcggcgttgccatggcgcgcgcgaacatcacgaacgccgcccggggaacgacatggccggcctcaccgagcggcgccgcagctgcgacggcggcggcggcggcgacagcgacagggacggcgccggtagcggcgccgagcggctcatcgccacgacgacctccggctggagcgtctgcgagcgctgcagcatgtcgaccatgaagggcgtctggtaggtatggatgacgctggtgagctccgtcgagtcgccgcgcgccgtggcgcgctgccacgagtgggagctcaggccggcgagcatgtaggcgcggccggactcctcgtaccgctccgcgtctccaccctgtcatgcatctccatcaggtccgccgccagcgccacggactgcgggtcgtcgtccgcccgcgactcgagcacgccgcggcgctcgtcgaggatggcggcggccagctcgaagtcgccccgctccgcggcggcgcgcgcggcggccatgtcctccgtggcctggacgcgatgcagctcccgctcgacctccggcgacatgccgtcgtagcccacgggggcgtccaccgtgcgagggacggtcaccgtgtcgcccccgacgcggacggtctccatggtggccgtgctccggtaggtgcagctcggcgtgatcagggcggacaccccgcgcgccgccgggacgcgcacggtgacgaggaagtccctctcctcgtcggcgtagaggtcgccgacgtgacgaagccgccgcggccgtcgccgtccacgtggctcgcgtagccgcccgacctgacggaggtcagcagcacgccgtcgtcgccgcactcgacgctcagccgcagctcctgcgccaccacgctgagtaggccgccgatgcactgggcgaacgcgtcctggatcgagcccgccgcgtcgatgaacgagaacgtgccgccggacatctcagcgatggagtgcatcgccggcgagtcgtggtcggcgccgaagccgaaggcgtggacctgcacgtggcgcgccgacccgcccccgggaaggagccagctcccgaccagcagcgcgcagtccggctggtcgccgcccccgccgccgccgcgcggcaccgggacggtgtaggtgtcccggccgtcggagaggaggacgatgctgcacacggggttcctctccctcctgtcctccatcaccctcgccgccttcctcagcgcgtcggcgatgttggtgccgccgtcggcgacgagcgagctcaccctctgcaacgcgcgctgccgcccggactccgtcatcttcctcagcgggaacagcctcctcgccgacgacgagaacgtgacgacggacagccggtcgccggggccgagcgcctggatcacgaagctcatggcgcgcttcagcagcgccagcttcgtcccggccatgctccagctcacgtcgagcacggtgacgaggtcgatgggcgcgcgggaggtcaccgtcgccgg

SEQ ID NO: 69442 - DNA, 2770 bp, Oryza sativa
ttcagcaggatgaagatccaactgttcatcgtcatcgaaaatgccgccatccagcgtacgaaagatcgggagctgccattgccgggtcacgctgtctccgcgagacagcctgcggacaacggccattcgctgatgctgatgcctgtcatccagtgggtgagggttcactcgagctgttccaagaagactagcatctgctgctgctgctgcagggagagggccctggaacggcagctccttccacacggcgcggcaaatcgggcagacggtgttgccgtggcgaacgctggaggagatgcagtggaagtggaacttgtgggagcattccgcggtgaacaaggcttggccattgcctgaacacattcctccgaggcaaatggcacatatcttctgaaaaaagtaaccaagaaaagcaacagaagatagttagtaactgcagatcgatatagcaatcggcagagtggagtttctttgaaaaaaaaacaccaattgaagttaaataaaaaatatgatccagattcatgctaacatgtaaagctttgttccctagaatgaactgtacttatttcacattacaaaatgaaggaatgagttgttttcaagagcatcagatattagcaatgactgaaaagagggaagggagcctaaataatagccaaattgtatgctcctagtgagtcttagagaaaactatagtagtatcaacaatgtcaactgtcatcagcatcagcacaagaggctaatgtccagtccaagtcatgcaatccaagtatacaaggcagactgtaagtcgtaaactactactattattaattaaacatcaagcaaaatagtcaactcatgcagccggaccctgatattatccagatgctgatagaagacacgaaatcgaattagatgcagctagtaaaacattacaaaagcacatcaatcgatgacattgatgtcagctatctgtgtgtctatcctttcattattcagctcacccctttctggaaaagtatgaagcacacagtatatggggcagagcacatatactctgaattataccatatgggccaatctttcaagaagcatccacatattctcaaatacatgctgtttgcagcagaggatcacttgaccaattattgataaccagaaaaggatgctggtctccccctctgatcctctccctgtctttagatcaatgttgatatctaagtcaaaccaaccaagatgctttgcagatcaattttaactatagcatgataaggcacataattagagatgacattcgtgcatgtgaaatcatgaagtggattgatttaattgccaattgctgaggtaaatcttatccagtaaactatgttgaccaaatgtcattttatttcaagtatattttagaagctccattggaatattaggacaacatgttatatgataaatataacaggctacctcatcacatactactacttgggaatatttgtttgttaaaacgatccagtgttttgctcatcagagtgatgtcaagagctgaatttcctaaaaaaaaaaggtttctgtaagccttatctcgtacatggcatcacccaactgatcaaagaaaaaacatgggctggaaagggaaagaaaacagtaggcttcaaaagatgaggagagagttggtgaacaagagaggtgtcctgcccttcctcggaattgcacacataattatacaacagaacaagcaatcaaaattttcgtccttttctagtcctaaataattaagaaactattgcatacttctccggttgcttactagcacacaacgcgctacattcatgataatttcaatggataaaaaaataaaaaaaacaaacataaaagtattaaacacgcgcaagaaattcaaatgcaagaatcaacccaaagaccaaaaaaatacagagaaaaggtccatgcaagcaaccgggcaagcagaattccctagaagtaaaaacaactaattcttttagatggcaatgtaccaatcaaagcagaaaggtattgcatggtagtacgatgttaagtagcaacgacgttttctccaggtttttggcacagtttaacatcgttggcatgatatggtgttgatctacaagacgatcaacgaaatcaggtaccccgacaaaaaccctgtctcagatgaaacacaagtagcacaagcttgggtatcataatgaaacaaaggatctgttgatttcggtgaaagatggcaaagggagcaaaataatgcagaacaacaattgtattcggcatcatctctactactttggaagtcatccttctccttcaccactacaattcaccatcatagttcctcatgtaaacaaaccaactctctaaaaaaaatctccccacccaaaaaccattgttttcacgcgaagattaacctgaaaatccagataggacgtagcactattcttttttaaaaaaagatcaggcaaaagtttggccttcaggatcactgcagtttttctttttgtgacaaaaggcatatatcagcataagatggatatccctttacaaaaagaaatctgactaagtttcacaatgattccaaattgcagatatgattaaaatccccgcttacgtgcggggaacaaaaagaactagcgaacactgattaaagtgccgtgtttccttacctaaaccctacaaagttatgctaatctaaacggatgcagccctcttgatcatgaatcattcgaacaaaaatatcgtatcaactttccccaggcgtgtcctagaactactatcagatttc

SEQ ID NO: 69443 - DNA, 1446 bp, Oryza sativa
ccccaaccccccatatccttcttgggctgcctaccaccacatccaatttgcaattagcccataaataagcagcccaactgtccaattttaatcctgcgtatgtgatgctttcctgagtcaattcctcgacactactcacccccgtcccctactatagttaggtgcctaatgtttttctctctctctcccttctaagcaaaataataattatcttattctgggtatgcgatatcttttcatatatttattttttaaaagatatctatcaactatgctttctgaattgactcatatttacaaattgatatgtttactagtatctttttatgtatgatgaatatggcgcaaaaattattactttattttaatatcatttttgttttttgtttgccttaatttattgattatactatatgtttatataacatataattacaacataaatatggtattttttgcgtttagttgttcttattgagaatagcatcttcgccccccatctttattttaatcctgcgtccgccactgattatccgtatctgatggaaacccaggtaccatatccgtattaatttgtatctgggagaaaatatccgtatttgtatccacatccgaactatccgagaaatatccaatctgaaaggtatcatatccgatcggaatatccgttttcatccctacccccaaaaatctctgccgcacgcagtgactcgtgcgtataaatggtttcacgtgtttaggagtgtgatgcgaggctgaaaacactctgtataaatggttgatactatatttttttagctgtactgacgttactattcaaactttctactaccactgtccattctagttctgtatcacatgtatgctttacactacatttttgggaccgatgtagtacttttttaggtataccgactgatagcactaactgcacataacggaggattggtattgagtagctcattgtcaagaattttatatatatatgtttttagcgatttaattgtatggtaaaaaataaatttcgataaaagtttttaatattttaattctggcaacggctgatgttaagtagcagtatttgcaaacgggagagatttttagaaggggtgacaggccgagatggggtcgtgccggcacggtgggccgtggaacaaaaggacttgtgcgcacaagttatgggctgtattttggagttggtccaaatggagtagcaaagctggcatggcgtctccctaggagttaaggtcggtagaactaataagtacggttccgactcggacctgcactgcagcctagctacgtgtctactcctatataacctgtcacgatatagcacgggatcagcgcgatacgaattacgaaagcagaggagggaacccgattaatcaccgtgacacgtgggtagaacagaagacgggttcagagcgcagcatgtcatcacac

SEQ ID NO: 69444 - DNA, 9419 bp, Oryza sativa
  unsure (1)..(9419): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcatttactctctttgtaattcttgcactttcaccgcctgctgaccatatgccttctcatttttctccatgtcttccatcatgatatcatgcatgtcatgtactgatgtgcatattttcccccaaataaaacatgaacatttcaaagtttacacaaggttttgctagcttccacttatgtttagtaattagtacaatttgaaagtttccttggcgcagcataagtcaattgaagttcgctgtcagcaagcttttactccatatcgatttcagtcaatttatatcttccatgtattatggtagagaagaatagtatccatataacttgctcctgtaagttcataaccaataactcttgctaatgacattttgaaaggttgtttttaactgtatatgcaaaattttgcggtcacagtttgttgtcacctatatgggtatatgatagcagaccacatattcggaaatatagctggctactctcaaaagtaaaactcaatgtgcatctttcgttttgccattccgcaccttttaacactataatcctttgttgtcgctataatatcaaatggaactttaccagtggcctgcaaatgagattattataagatactccctccgtttcgcaatgtaagtcattctagtatttctcacatttatattgatgttaatgaatctagacatatatattcattaacatcaatataaatgtggaaaatgctagaatgacttaacattgcgaaacggaggaagtatatatttattatttatcgttttattattcttttatttttgacaggtaacaagccttttaacttcttcagttaatcaggaccaagtgcagctttggtagtttctttggattggccatcaagaatcacatgcacattcgcgtatgcatgtggagttccaaaaccaatgttgcatgattacgtaccgatctctgtaaatcaaaatgatggcataccgagtttggtgttatgtatacattgtcgtgcatgatcgtatacagatttttgccgtatcaaagagatatttttttcttgcattgtcggtacgcacgcgtttcttgctagtttcgctcacccactgacggcgtttgtttggatgaaaaatacccctcttggggctgcctacctcgaatttttttatttataattttttttattaaaagttttacaaaaataattttccattttaaaaattgacggaagtagtcgcctaccgccctctgggagggcgagagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgaggggggcatggaattttgcaggcggcccccttgccgccctgggggagggcgattttatactgtgctctaaatttttttataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttctattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgaatcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaattttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcatcgtagaactggctagtaggaccagtcctaccggcgtgagacgaagaggccccagtaccgaagatcccggctgcaaatcctgctggacaaggaccatcagtttcgtacaagtatttaacagtggtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgtgctcgaaggcagacgaggtcctgcgatgaggaaacgtgcagttaaaacatagtgacatattcgtgcaaaagctgaaacaaaaatgaactaatatctgggctgaactgtaccgtgcgaaaccggtgttgtaggtcgcactgctccgaagctaggggcactcgaaggcaaacgaggtcctgcgaggatggaacatcaagttacgacggggtgatgttttcgtagaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatctggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcagcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccaatcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaagaccatcggcaggatggtgagccagtaagcctggtcgcgtgtgcacaaggacgaaattcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaattttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcatgcaacctgtatagagcaaacttcaaacataagtacgacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatactaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttttgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggggatgaagcttcggttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcttcttaaagagctccataagatgcttgttcttgaattgcttgtagaaatttgcacccatgtgacgcatgcaccactgactccgaacatcaggccanttagatggaagtcctttctcatcccaaccgttctgcaagtagtcaatagcccgcaacatacttgcatgacgatcatgtataaggcaaacgttgggcttcatacgcaccaatgcaatgtgcactctctttaggaaccagtaccagctttcagtgttctcactctctacaaatcaaaagccataggtagaacctggttgttcccatcacacccaattgctgtcaatatctgacttcggtatttacctgtcataaaagttccatctatgcatagaacaggtcgacaatgcacaaaagcattgatgcaagcacccaatgagaaaaaggctctttgcaacacactctttgttcgatcatcaaccgatgtaaatgtatgtaggtcatagtatgtattattattcctctgggcaatggtggctaacaaacgaggcaaattatcataagaagcttcaaatgtgccatatctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgttgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttaacattgtgcctgatgaaaacaataactgcgttaacctcgcatttctgtactacgccctaagttacattctctacaatattgttctctaaatttctaaaattcgttacattctccagatcaaactaaactacatcttacaattaacactactgtctatgtctcaattcatactattatattctatgctctggatctacacatatgtgttgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctcctcttctgctgccctcccctctctctctttcgttttttttggatttttagtgaatataatgaaatttcacagaggagggactgggctttataggggggaggcaaaaatcgccctcccccgcacagtataaaatcgccctagcggaggacggcaagggggccgcctgcaaatttcgttgacggccgtctgtcacgtcattttcgccgccctctgagagggcgatttttaaaaatcgccctcccagagggtggtaggggactacttccgtcaattttcaaaatggaaaattatttttgtaaaacttttaataaaaaaaattataaataaaaaaaattctgcctacctccagccaacccccctcctcccagggataaaaattgagcggacacggaccgataatgcttgtaccatattcgttttcattttttttatcggatatgaaaacgaatacggatagttcgaatacggaaacaaatacggattatctcgaatatgaataagaatcgaatataatcggacatgaatacggaaacaattttttctcgaaacacgaaaaccaactcaacttctaatagaaacaaatatcaacatatataattagctcattttatatatgaagtataatttataaatattttttagaatttaaataatattaatagtacactagtgttaagagataaactactattaaaatatataaatgttatagagttaaaaagaaatggggtatgtctcatggcttatgtggatatccaaatagcattgttcaccggatatccgaattattatctacagaagcggtaccacccattaggcggggttgg

SEQ ID NO: 69445 - DNA, 20115 bp, Oryza sativa
agttggtaagagaaaatgtacctttatagctttggttccttggttgaatcaccactgtttccacaggactcaggacagtagtacaaatggttaaatacggtatcacctcaacaagaataaggtgcaagaagcaatgaaacattgaaggttgaagcagattatccaaaattcagaataattaacctacatatgccaaagcggaaaagccaaatagcagttctaatacaccatatcagcacaatgaaactaaaccagagttctcagtttctcaactctcacaagtcttggacaaaataagcatagtagaggaaacagaggtagccattaagcaagcaaaattgatatcattacatcaatcatcaaggattgagtcaatcttcatcctcctggtcataaactttagttggaacgatctcatccttgtcagactcaaagtcaataccctcttcattggcctcatcttcttctccagaattgaaatcatcttcatgaagctccctcactctagcactcctacgaggttgcatggctttagtagccccacttgcttcatagatgagactgaatggaagtcctgaaatgggatcaatatcttcctcatctccaccatcagtgatccacccttgcgcatggaatgcatctgtagctaggagcacatctttgttatttttccattgcgtttctcagcccttttcagcaaccttgcattgaattgaacatagactaagttgtttaggcgaccagccccaagcctatttctcttctttgtatgaacctatgattcagaagtgacgaagtaaatacttaattgaaagtagcaactaaacaaagtgctaactgcatctgcatgtaaggttgacaagttaccatatcaaaaatactccaattcctttcacaaccagaggaactatatgtcaaggagaggatccttatggccatcttttgcaaattaggaacatggcatccatatgctgcccaccagtcagctataagaagtatgatttatcatttaacaaatagtgaaataacgagttaatgacacagcaatgcaacatggaacaaatataatgcagattgtagttgcagcagaaaattaccaggagaaatgcgatttttgacatccagttccgcagcaggtttcccaaatgcccctagctagtccttaaacttgggaagttcattgatcacttgagcttgaagatcatcatcaccacataaaaggtttcaatacaatcaaagaaaccatccatgatagaaggatccaaaaagatagattgatcatggtaagtgtaataaggaatcaatatatatgctgtcaaatgcagtggagcatcaagcctaccctccatctttttagcaatatgttcaaagatgggattgtaggtgttctccaagttttttgcagctaccatgatttccttctttgcctctagaatttgtccacagatgaaggtcaggatagaccatcactattaaccatgtgaagtactttgactaatggctcaaaaacctgcaagagatgaaatagcacatgtcaattatgcaaatattgattgatcaacatgcaggacagcacatggtataaggttaggatgcttgtattaccttcaaacactgagaaacatcattccaaaaggtcctactcattagtgtagaggtagctatcttgccttttgctttttttagtgcgggtgcattgttcccacaatcccactccacactaagcgccattgcccttagctcacgcttcttctcaatcaagctttgcaaggttagaaatgctaaagcaaatctagtcacacccggccttatggtatctctcttcttcgtgtgcttcctcatcaaggccaatgtcttgtgatgtgaatagactttgcatggtataatgtggccaatatgttctttgatcctgcattttgtgaccacataataagcattggaccctatctttgtttgattcattgaatgttttgcctcattcccatcccatgtcattggagttcctctaatgaggatagggtacttctgttaccccagtaacactggtggttgatgagacaatttgcatatacaggaggaccaaaattagtaaattattgaacatctaaatctgagattatatcaatttcatcacacaattgactgattgagacactttctgaggttgtacgatgcatatcttgatttcatgccacagatgacagatcactaaatacttacatagtcaaatgaccccccccccctcccttcttcccaaacatacacagcagcaacaagcatccacccaaaaccaccagccaatccaccaccacaaatagcatgtccagcacgaagcaagcaagcacaagcattccagcaaggcagcaagaaagcattgtaatgcaagcaatcaacaccaatccaccaccaccagccacacccacaacaaaaacaagagcaatttgtacaagaacatttagatcaagtaaatactaaagaagtaaagagtagagtaacagagcatagcacatagtaatactagaatattgagatttgagacgagctcagaggagtagagggtagagagcagcaaagcaaagagaatggcttacttgctcgattcgccagtgttcaccatggtggtgctggtgtcggcagcttggagcagaacacggtggttggcaggaaggatgggggcagagcagagcacctgagcacctgagcagagtcatcgacgagtcgaggcacaactgcgcaagcacgaccgtgtgaaaaagaacagaggatggtaggctagtcgcttggtcgcggagagaagcagagcagctgagctgccggcggatcaaactactatggcggctgcgcctgcgcctgcgcctgcgcaccgtcctaaggcagctccaaaccctagccgccccttcacgcactctgattttgggattaagtcaagcagccaggatgcacccaccttatatacccgccacagcagcccgcatagctagctcagtcggccgcctcgtcgactagtcgccaccgtgcctaggccgcctaggcgccgaggtggaccgatgttgaccgtcgcggcagggcagccgccgaactcgccaccgaggggctaatcacggcgccgaggtgccgcctaatggcgatttttagaacactgtttatatagttggaaagaaaaaaactgagcagcaataatggtggacagaatgaaagtcttcactgagataaatgaaatattaatgaatgaagaatgctaccaaatattagatgagcaataacatactacatcaacattgatgtgaagctgaagcatgcatgcagtatatctgcttcaagcagatgcaaacaacacatcattgccaatcgagaagataagattacaaaatgaaataactgaacagagataatggcaaatagtggtacagacttctttggagctaagtagctaatataaatatgtaagcatggaaatttcaggaaatatagtagatggacaaccataaaccacatggaaattggtgtggaacatacctgtaatttatgcgcttggagcatatagcacacatcagtgaaaggaacacagtacagcagcatataaaaaactcctttgatgtacattcaagaggcaagccatgtgtacttgcagcttccaaaactgtctgaatatgaaaatacgccctgcagcacaaatggtaacaaataaacctatcaacattatcgttttgccctccaaagttgtatatgcaattcctaactgaaataaataatcgcagcatagagaaatgtgagtagcagtgtgcattgtttcaaactaaacagtttgatcacacatgacagtgttgaagtacatgccgagggaaatttctctgcacaacctacacactgtaactaaatcatgccttacacacattataagcaaatcaaggttgtaatcgtcatcaagaactaaggtccagccacttccttctcatggcactgagctagaaccaaaaaggaaaaaggagagcaggaacgaccaggtagccgtcgttgccgacgccgagccgcggctgtcttcgtcgcggtcgtggccgagtcggcgctctcccctcccttctcaccttctgtcaaggtcgatgagtcagacggtccccgagccatattacaccgcactgatcgaggcgtagaggtctagggcgagggaggcagtggcgtggcagggatgagagaggagaaagggcggcagcgccggcggctctcgtccctccctgcggcgccggatacaccggcgaggagaccggggtcaccggatctggcggcccgggcctactcactgggagatccggctgctcggtgggagggacaggcagcagctggagtagggcgagggagtggagcaggagggagctgcggcggcggcggcgacggcgcgaggtggggcgaggcggcgcgcgtggtggtgggggagcggtgtggaaaggccgtcacagtgagacacatggacggtaagatcgaacctaccgcgagatcggacggtggacgtagagccgtagcggggacctggtgcggaattaactgaacgagcggggttcttttgcaaaaggtggactgacgtggcgcattaaatcttcacaaatcctaccaaattcgattttagagaggttaatatttgttagttttgaccgaaagtaattaagggctttgtttggttattgtgctactaaattcttgtaacttcaatagtagtaaatacatatttggtttgctacccaaatttttaccataaagtttaatcttaatactactcaatttgttagtgccaaaacttaccaagcttatgacactaccaagattgtagtaaagtaaaagttggcttcaaaccaaacaagccctaagccttctggcttttcccgttactctattagcagtgtaaaaaggacacaaatgaaaaggtacaataagataatacgtgatttgatatttaaataacactgttggtcaaatccatgcctaaaaaataaatgagtaaattgtagtttaaaccactctttattgttaaataaagtttttctttgaaccacccaattctatgtctaccatctatttatggtgaaaatacagcctgtatagggatgtagaagttcatctgtgtttaattaagtttttttgggtggtccaaactaaaaaaaacacagttatccaatccaaaaataataaggttagtttaaaggtagtgcaaaatataactttagcaataaaatgtggcccaaattacaattcacttaaattaaaactaacaagcatcggtaaccatatgctacaatgacattgtgattttatactccatccatcccaaaataactcaacataggatgggatgtgacccatcctaggacaacgaatctgaagaataaatgatgagtcgcatcccatactaaattgagttattttggaaaggaggaagtatgtgataggattgttttaactttttcaagcatctcctgaatgtaagttaaatctatagtagcccttgtgttgaggtcggtggttcaacgccaagtggtatggcgtacacccatttgctacgttgacccgataacgagacgaggtagccacggcggtggtatggacttagcacaatgttttcttattagtgaagacttagcacaatgttaacctgttggatctcagcgccattagggctggttgcgaggttacacttcttttttttatcaatacaattctttttatgaaaaaagtttttattgaagaggcaaatttccaaactttcggtgcaaatcgtgttcccgcaatacacaacaaacgaacggtacagccgtacagataacgcgagcactataaatttaacaatatgccactctataggtgtagctttaacaggatgccaccccataggatgtccttataaaaataccactttatagaggtggcttcttaatgaaataccactttgaggtgatttgaggcttttaatcacactttggggtgattagaggttttaacaggattctctcggccgttccaccttccttggccgccgaggcgcctgcgacgcgagccaaaggagagccacctcggtgtcctcgagcgccgcggggaggcggtgctctggaacgaggtggtagttggacgcgatgacgacgggcctagctcgacggcgagggcggcgtcagggcgttgtaccgaggcctccccgcgatggcgctcggcaccggccccgcccacgccgtctacttcttcacgttcccactcacccaccacctcgccgtcgacctttccgaccctgtctccctcgcctgcgcgctcgccggggtcgaggccgtctgcccatcttccacatggtccccacctcggccaacgcgcgacgggtcctccttcctgtccctgcactgccttgccgtggagagcacgaggtgacgaggcggctccttgccgcctgttgccggagctgacgtggtggtcgccggccgcctgctccacgtctctcggcccttcccaccactccttcctcccttcttcgcttgtgctgccgccgttgccctcgcgttcgccgaatactcccacgcccgcctcggcgccgggctgcgcggagccggcaagcgagatgtggcccgccgccgcatccctccacctgggagccgacgccggcgggcgcgcggatgggtgacgactgagcggaagggcgtaaactggcaagcggcggcgagaaggaggaggagcagcaggcggagcatagcggcgaggcggcgagaggcgaggcagaaggaagacgaggcggcgggaggcgaggcagagggtctcggtgacggcggcgacggaagcggggtcggggaggttgaagaggagataggggatggaggggggaagcaggaggaggtcgtcgtggtcagcggcgaggtgggcgacaaccgtgtggaagggtgagaaggggcgaaggcgtaaacctgtgagccccttctctccctctccgcccaccggcgatagcaatgcgtccccatcacggcggcggcggcggcgaggaggaggaggaagagcagcgggtggagcacggcggcggcgaggaggaggaggaagagcagcgggtggagcacggcggcgaggcggcgggaggcgaggcagaggggctcggcgacagcggcgatgaaagcggaggaggtcgtcgtggtcagcggcgaggtggttagaaggcgatggttcggttaaaaagtgtgctaatcacccaaagtatgattaaaagcctctaatcatcctaaagtggcatttcattaagaagccacatctacgaagtggcgtttttataaggtcatcctatgaggtggcatcatgttaaagtcacacctatagagtggcatattgttaaatttctccgcgagcacgggaaagagagtaggacgctgcggtgatgctaaggactcaaccgccaaataagaaagtttctaaggatccagaaataaaaagccaaaaaagagaagacccttatgtggcagtttgaagaagtcgaaggataagattgcaaaattggcaaacagctgtcaactgggaggcaaatatcttcatcgtgttcgtcatttttcctttttcttcctcctctcccctttcttcttcctcacttcaccattttttttttcttctctcctcaccccttcaccacagcgggcgccggcgagcggcgaggccgggccggatctcgccgccgcccaccgcttgacctccctccgtggcgctgcctccagtaagtctctggctcgagatacacctttggggatagagattatttttcttcagcttttgcagctctagcaacttgcaataacacaaatcttgccaactttaggacgaaaatctagcttcaaggagcactaggaaatcctgcaccattcattacttgcaaatttcgtgatatttctctcacgtagtaaactagtacttatgctgatggtatttggtggttcttactaaagctcgttggttcttgtttgtgggattgcataatgtgctttgagtaccagctagttgtatctaattttgttatttagatgtactatgagtttgatatttggtactagaagaaggcaatcaggctgcccgctgcccttaattttaatttatttcgccgggccagcgagaatgcggccgaagtttattaaggtgggggaaaaaacgttccacaaatttacaggactcgaagaactacagcacgagagccgccgagagactcgagctggcgccacagagcacatcaccagcccagcacatatatacaactcaagccagatacgcagcgacacagcgttactttcgccaatcgccaccccattgcgcttccgtcgtcattctgggcgtttagcagaccagcttcctgccatgtcttccatttgtcctccatatatagccgcacagagcgcccggcctgtactgacagcgcctttccattgaaaatccgtgtgtttcgtactttcgttccttccgcaccagccatgtaaccaatggcggaccctggaaaaaatcatagttatggcggagacgaatgaatcgtctaagagcatttcaatccaaccacaggaaaaacatttaaatgcccatattgtatttatgaaataagcagatacatactaaccgagtgatttcgaatcaacatctactgtgaaaatgcaaacacggaaaatataaactcagtacatacaagaaaataccaagctaatgtactgtatatcacagtttgagactcttgttttagtcctctaaacaagatgaaacaataatgaagaaccagccaaataaacaaagtagctaggtggattatacttagtagttgatgctttctaaaagaaaatgaagttaaaagactcactaagcactagttttggttgtcttggccattgtcactgttgcttacttgctttccctattgcctgggaacaatcgcagacgcacggcgaccagcttcgctgttgccgtgtctcgagcagccgcctccttgttgtccttgtcggctgccattgctacaatcaggcccacctacacggcttgacgagctagtcagctaggtgctcctcttcctgctatagatcaaagctgaggtaatgaccagtcgtccatcgtcacatgcgccacctatgatttgctccgccgcgcgccatttgacgcctacctgagccaccaatccgccggcaacctcaaacacgccaagctctaattaatcaagcagctagcagccaatgcccaccactccatcagccctagcacgacgaatcggtgatggggaattggggattgaggaaaatgagtaggctatgggccagctaacctagcacattaacacgtacaaccattccctctcacacccccatctctatccattaacacaccaagtcatcttcctcacgagtccaaagcttctaatgctactctaggagaccattcgagcattccttgtggtagtagccatccctgggaagctgagggtgagggtgctctctacgaaggttagctatggcatgcaccacaacatgctatagtggtaggtctgccctgcatgtaatcagaatcataacagcgtcaaacacttctcttccttcttggcaacactcttgcatgcctcgcaccaccaggacgggaagtcagggtctggtgaagggcattgaagcacaagtttccgaatatagcatttgttgtaattcggaaatatagcatcgaagcacaagtttcgtctaccatgttgtagaggtggtagatgaaggcaagctgccactcacgccgctgaagattgtccgtcatgaggcaggccccttgcattgctatgaacatgaagaatttgcatcaagacagggccatggacttccatattatctttccgaggcgacatttcgtcttggcggcgcataggaggcgtaggtggagcggattgagaacaagccatccaccgttggagcccaatagaccttatcgtcgatgtcatcagcaagctgcacccttgacaccatttctgataccatgaagtacttcgccagaccttgaggagatagagcccctgtgatgtcagccactcaggcattatcatgtagagctgttgccaccctacgagatcgcttcttaacgaaggaggcgaggattagagcacaattaacaatcgagccctctttaggtaaccagttatcagtccagaagaatgtccccttgccgttccccacaatcaccgtgctactttcttttatatcgagagagtgatgtccatggtcgttctggctgcgctttgcgtagccgggccaacgtgcccgcaatgcgacccccgcaagctacaggtttcggatccctaatcccccatattccaccggcaaacagagtttgtcccagaccaccaagttgtgttcccccgatgcttttccgtcgcccttccacaagaaaccgcaacatttttttcactctttgccgtgtgcttcgttagtcggtctatcattggttgaacttgtgctttggttggtttgcgcacggagaacaacaaaccaaggtaggttagaggcaaatccttcacctggcagctgaggatcgttgcgacctcgactatttggtcgtctgagcagtggataatagtcatggagctcttggctagattagttaccaaaccagagacacgacccattagctgcaggatgaactaccacaacatcttgagtcgaggggtggaagaaaaggatggtgtcatttgcatacaaggacacttgcaagggcatcacgtcgtcaactagtggagaaagcacccctcgttgcaccggcgtggagcagagtgccccaaacgcctccatcacgaggacgaaaagcaggggaaacaatatggatctccctactgcaatccccattgtgagcccgatgcctttttgcgttgtagctgttgatggagattattgttgacgcccttcccagcatgatggcaatgccatccctgcattttttcccccaaaacccaagtgactatcaaatgccttggtgatattgagcttgagcaggatggttggtcactttcgaccaatgtagcagcccgatcgcccttgaacataaatgaagttctcctggatgtgcctcttcttgatgaaagccgattacgctggtccaactagctcacccatttgtgcagccaatctggtagccatgattttagaaaaaatcttcgcaaaactatggataaggctcattgggttgtaattcgagagttgtatcgagtcttctttcttggggaagagtgcaatcaatagatgtaagtgctaggaattcacttgcaacacaagggctagaattgtgagcaggtctcctttgatcaactccgaacacctcttataaaattcattggtgaacccatctggccctgatgctcagtccgttggcatttccaagaccgccttcttcacatcttcagcgaactcaatatctagctttgataggtcaaagtgaggcaagtcaatgccgtctagatcaatgcttgatgaaggagaggaaggcgccccatgatgtcaaggaagaagtcgtgaaccaatctcagcttgttgctttctgttgtcacccattcgccgacgtgacataatattggaattgctttcttgtgttgtcgtgcattgatcttgggttagaagaattgagtgctggtgctactatgcttgaggaaacatagccaagcccgttgactcagcctgattcaatccagcgacgcaagtgctagacaacggcctttaagcgacgtgcggaggaggcgctacgggatgtcctgcgccttgtttagctggatgatgatctagtgcgccgctgccaattgcatcatgcgggcactaattctgtttgatccccaggttcttagcatcgacgccgctgaccgaagcttgaaatggaaggcactaatcgcgttggaagttggaacttggtcgagctgaattccatgcttgctgcacaacctcatcgaagcactccatccgggtccagaaggcctcgaatttgaactttcggtgctggtgcatcggctgatcacaagtcaatagaagcgagcagtgatccggggcttaggagttgagggcttgcaggtgtgcatccttgtatacttcctcgattcctcccaatcagcattcactaccaccttatcgatcttggaaagagtcagtcgttctcgctcgctgctccatgtatagcgccgaccaaaaaggtacagctccctaagctccaaagcattcatgacatccctgaacttgcctatcagccttctactaacattgccattgtttttatcagattccgctgccaaaaggttgaagttcccgacaatacaccaggccccttgcacaaactcttgcccgaccgatagtaccttttccaggaatgacaatttgcctttgcaccaaccgtggcccatacatcctcccccttccccctcccccttagggatggctattttgcccatgggtccgggtaaccgcggatacccgactcgatgggcacgggcatgggtgtaacattttacctatgggcatgcccacccgatgcttgaagatatagtgggcaatagccgggttttgaattttacccgtgagtaacctatgcccgaccagatacatgtacataatatatatatatatatatatatatatatatatatatattagctattttttgcccatctcttaattctcatccccttcttcttagtccatttggcccattaacagagacacatatactcactcactaaactctaacctaattccccacccccacctctcccgtctacctctctccctagtccggcggcggcgcaacaagcggcggcggcaactcatgcaggcggcaatgagttcactgctgccgctgccgtcgctcacctgactgcatctggtgtttgctgttgctagatctggtgagagagcgcacgccgccaccgctccttgcctcttccattgcactgctgctaccgctccgctcccttctcaccgttgtggcggcggctcagggccacgatggcggcgatggcgtcttagcgtgatgcatacaatggtggctcagggcgacgacattgacgacaatggtgagccagcgacggcaggcggcagcaacggcaggcggaaggcgtgcccactgggtatccaccgggcatacctgtgcccgtcgggcataggtatgggcatagagttttgcccgctaaccctattgggtagagttcgggtgggcaaagttgggtgtcgggtcaggcatggttttgctctacccgtgcccgactcgatccattgccatccctactcccccccttccgcccttaaaaattggtagaacacaagctcagtgaccaagttccttttctgacacgagacaacgaatcgattgcttcgctaggctgtgaagagacaccctcccccttccatcgcaccatcagtcggcaggaaatcgaacacatcaaaaccgatactacaggactacaggacttggcgataaacaccttaccaacaacaactaatttggattctgataattgataatggacacatgggcattttgaaccacttcagcgactagggacctcttccttacctgattgagcccccttacattccacaccaacatacaacacgatgacataagaaatagaagtccatgacgggcacaaacttaatagatgcttaccgagcttctatagcagcatgcgcctgcaaatcacacaaggtagcaagggcctaaacatgcgacggagcgagaggactcttgaatagccctaggtatcaaaggatatcatgttcatccaccttgttctcatccgccatgatgcccaaactcttcattatggatcattgcgccttggtcgtcgtgtgcacttgcttgtcgccgttcttcacttctatacgcccattgtggtgtggtgtgaacaagaccgctagcttgttctaaaccaacgcgcggggctgactaccaagaatgctggagactgcatgacgtccgccattgcttaaacaaccaatggggtgctgccttgtgaagaacacgccgcctttgtagctgatggcggttgggcagaaacggtgacgaggattgctgcagagtgggtagccctagctttatcacttggagccctcgacgacatgtcgttctgggccaccttgcaacctctgtcaccttaggttggcttaggttgagatgctcaaccagcccattagcctggcccgccgatcgatccagatcaaccaccctcctggccctcgcgtcgtgcggggctgcgcgcctagagaaggtcgtaattaggctggagaagcgcttgcttggcccaagcatgttgtcgcctcctgatggtttggaacttctcgtctcctacttggctgtaaaaaagagcaaagcagtggttgtctcaggcggggaagcagctgaggttactggctaggaattcactggctccataaatgcagcattgccatggagatcctgaggaagatcttgaaagcataattttttttagtggtgaagcacgccgaggcgaatgccggacatgataactccttggaagaaaaaggcgccacgtcatcccggtgccatgtcatgcgaaacgatacgcctcccccctccctcgtcatgtcctgcctagcaccggcctagggttggtgccgtcaatctagccaagggaggtgttgtacgtgtgcaagcagggtgtcaggaggtgggggcaccgggtcgaccgtctccaagatgaggaggccgaatgtcaagcacggctttaaggagtgggcgtggcggtgtttacactgatagcgcctaacatgtcaaggtggtcgtcctctggtggttcccaccattccaccatcagttctggacaaccaccattccaccatcagttctgagatgtccagaggcggctccttagggatcagagaatgatttactgcccaggcaagcaccttgaacgtgcatgcatccgctggctcaaagtgctcgataagctagcggttgagcttgttgaggatgtgcttgagggcctctggctcacaggtatgagcaggtaggccctcaattgctagcctgatgacgtatggcatcctggtattccttgtgttggtagagtggctcaaagtgctcgataagctagcggttgagcttgttgaggatgtgcttgagggcctctggctcacaggtatgagcaggtaggccctcaattgctagcctgatgacgtatggcatcctggtactccttgtgttggtagagtggtgccaccggcaaaagacaaccaggtattgtctacctggaagtggctggattgtgtgccgcaccattgtgcagtccccgtaaagttagagggcctcatcaccaactctaacgttagcccacaggatgccacaggaacggcccaacgcgtcaatcacctgttaacggcaaaatttggtaagattctttagtggattcggttaaagaaagagcagtcagtcgacagaaacttatccagaaaagaccgagtttaagaaggaatcgtgaagactacggcatggtgacttaattctatctactccctccgtttcaggttataagatgttttgactttggtcaaagtcaagctgcttcaagtttgactaagtttatagacaaataaagtaatatttacattaccaaattagttttattaaattaataattaaatatatttttataatgaatttatcttgggttgaaaatataactatttttttctataaacttggtcaaacttgaagcaatttgactttgaccaaagtcaaaacatcttataacctgaaacggagggagtattaattaggtaggatgtagtaatttccttttatctttaggaaatgtttatttagtgtccgatcaagacttttatctttccttttatctttagaaaatatatgacgtgttcgatatggactagtatctacccatgggtataaatatgtacacttggggtttttgtaatctatctctcaatcaatagaactttggcgcatcgccaccctttttattttcgtctttctcgatgagttcttgtttcaagttgggttgcatcggcttcaatctccgacaaggggtaagactaattatggttgtttgtattggcggggctagggcctcgacactaattgtgtcggcgtaaacacctatttatcatatatcttagttaatctaagtcgatgtctcaatttacctttataggacagatcttttctagggttttgttggtatcagctaaattgttttatcaatttagattagctaaggtatccaccaccttgaaaattagtctaagacttgattgtttagactttatgtttcttttcatatttagaactgcatcaattggatttgacctactaagtcgtgcttagaatcataaaaactaagctgcctttgattgccaataagggtttcattgcgatttcagtcgatgagttatctggacattgcattggcttacaaggattacatacaagttggttttagccgattgcaacaaaggtttcattgattatcgaatcttatggatttaatttaaccttcggatcaagcaattattctatcatatcattattgactaattggtttctattgaattatatattattttattacattatcatcagttgattatctttatatcattattcattcaagagtcagactctacattggacatatagccgattgctcaaaaccccatcagcatcgactggtatcaacatcggctagtatcactatatcggctcgtcagccgatcggctttttgatatgctgttcttgtcagttgcaggatcaaactgaatggcatgcccgcatctcatcaattttaggacctacactggagctaagcaaatctcccaagccatcgtatgtttgtcgacacggttcgcgtcaacacagattcattatcatcggctggacgcggatttttcatcaacaccaccatggccaaggagatctctcagcgccccatcaagacggatgcctccaaagcctgcttgcacagacgctgctcgatctccaccatcccttgggtccaagagaggacacaaaagccatagggtgggtacatggaaggatcgccaacacctatatcatcgtcgcaatccatcttatgagtgggtacaacagccgtcgtagcagcccccctcttccgcgtgcacgagagagagtggtagccataatgagcgcaaaggacatcgccaccgcagcgtggcaaggatgggagccgtcagctacaggggagcgcttgtgctcttctttgttaaacttgcagaaatgctcaacatggccaaggtaccagcaacgataacatccgatgttccccttgcaatctaccttaagatggcctatccctagacaccggaagcacctcacctggagccaacgcaggatagggcgagctggctacacagaacgagtaaatgcggttgttggccagatggcagcgaacccttctttacaccttgtgttgcaccagatgccaaaccggcttcaatatccacctacgatagggtaggagggcaggcgctgaccggcggggcctgtacaacgtccgcccgggacaaggacgattcaataggggctttatctagccagtgaccgttatagcagttgatcgctgagcggggtgggtggtaggtagacgcttcatctcttatctctctccggctcataagccctagaccataatgttaatagtgtttccccgccgccctttacatttgctttctttggcaaatgaagactttgagagtcaaatgtattttcttgtaattttttttttcttttagtcccttttgatctagcatgcttttagcaccttgaaattctaggtgaactaattatttgtctgattggttagccttattcagtacatatatttgagttcctgtaaaatctaggattttacatgcattataaagttgggtttcccaagtgaaattctttctgggatggtcttaatctgatgttggcgcattcataactaacaataattatgcatgcattggagatctttgtagtgcatctattgttgacctaaatgttagtcatgtcaatctagaagataattatatgctgatttaatccatttgttgatttgatttaacaggccaaatctctaaaagctcgggaagaaaataacaaaagcagcaatggacgtcgatttttggggtttgtttcctctttccaatttagtgtatttaaataacaactgtctcattaagattaaaaaaaaacaactttgtgattaatgttattgtttattaggagtggtaattgagccgtgcaataagaaggagatcttttgtcctgaggataccctgtatcatctaacatcggtatgttctactccctccatctcagaatatagcaacctaggattgtaataagttgggttctaggttgctatattctaggatggagacagagggagtacttgttatctctcatattatcaattttcttaccaggtctcattatttatagtgatgtctcatcttactgttataacttaaatcgcaggtagcccttgatgaggcttacgggctaaaagactccaatgtgaaagtatttgtcgaagttaatgatgagaagtttgcgattgggacgctttcctccaaaaggcatccgcatatcaaggttgacttctgtttcaagaagaactttcaactattccacacctcactaatcagcaaagttgccttttgtggctatcaagtaaagaatttgggaaaattcactgattctgaaggtaaattggtcatctctaatgtttcccctacacttggcttcatgataatcacaattcttgagatgtgatgtttcaggtgatgaatctgatgaggaggttccaccaggtattcgtctataccccaagttagatggtatatgctttgctaatcataataattactttataagccttaagaacgcttaccttttttatagaatactacgctaattcaacttccataaagtgtatgtggcgtgaccatggctaccatagatacaaccatagttcacattagctcaactggaagacatcgcgatcaagtcgcagaagttctggattccaattcggtcacctacaacagtgctgattcccaatgtgtgtatacgagctccgtttttagcccgtgagtactcgatggaaagctcttcgagtcttcttcccaacggaactagtctcatctccaaattccatctcagtcggtcgcaatcacagaaactaggtgttgcatcacctataatgggcctatgggtttataacttcgtctgggaccccggtccaagtagggcccatgtggggtgcgccccaacttgatggaacatgactttagggaccccatggtcatcctcccacctccttaaatagctaggtaccccttcaggttttttcgggttttgtttagattaaagtttagcttttctactttgccgtgtaatcccgtgatttgttagatcgtctgtttgctcgttacggaatcccaaattatcatttatattcaattgctatttgtaatttagattggttttattttgttcttgcttgttttttttttatttgcttgcaggaataaggttaatctataccggcaagatcaacaacccacgaaaaggtgtatcgatcgttaaggcgtaacacaacaacgtctcgtacggttgtagtcaggtcgtaaacgtttctcccatatcgtacgggtgtagatcaaccttgttcccgcaagcaaatcgaagaaacaagcaagagcgagataaaaagcaatgtaaattgcaaataagaattgaatacaaataacaagttagaattccgtaacgatctaacaagtcacgagattatatggcaaagtagcaaagctaaactttaatctaaacaaaacctgaaaaaccctgaagaggtacctagttatttaaagaggtgggaggacgaccatggggtctctagagtcgtgctccaccaggttgggcacatcccacttgggtcgagccctaaatgaagttacaagcctatacgtccattatagatgacgcaacacctagtttctgtgatctcgcggtcgaccgagatggaatttggagatgagactagattagttggaaataagactccaagagctttccatcaagtactcatgggccaaaaa

SEQ ID NO: 69446 - DNA, 21385 bp, Oryza sativa
  unsure (1)..(21385): unsure at all n locations
tgaacgataccgtgatatttcagtagttggtgaatctactggtaatgaggtacgtaacagtgacattattaaannaaatgagcagtcatgaattgtgttggatatattataatcctgcgatacatttgtatgatatgattgacaaataggattcaagtgatgatgctgattatgaaggtaagagttctgatgaagaagagactactgcaaaggaaggtgagagtactgatgaaaaagagactcctgcaaaggaaggtgagagttctgatgaagaagagactcctgcaaaggtatgtgtagattgatttgggaattggggaatgattggcctcaccactgaccagtacccccacacatgcatatatttatttaacagaattacaagcaggtccctgataaagttgcatattacaccaacactccccctcaagatgggcaaaagatatcgatcatgcccatcttgttacaaaataactcattcacttgggcctaatccctttgttagacaatcagctagttgttcacaagatttagtatactctaggctaagcactccactatcaattttctctttgatgaacaacctatcaatttcgatatgctttatgtgatcatgctgaaccggattgtttgcaatgctgataactgatttattatcacaatggagcaccatagtgccatcccttcaagtatcttaggattctatgagctgcctccaaaagaccagacctaggatcatgcatatatctatttaccacactcactacataagagatatcaggtcttgtatggcacagatatatcaagcgtcctacaagcctccttgtcaactggatcacctgtctgagcacatagttgatgatttttatcaattggtgtagcacttgaacgacatccaagcattcatgtttctgccaatagatcaaggatatatttcccttgggagagaacgattccctttgacgaccgagcaatctcaatcccaaggaagtatcgaagaggtccaagatccttcacctcaaaggtctttccaaacatttccttcaagcacctaatttcttcccccatcatcaccggtgatcactatatcatcagcatacactgccaagatggtaatacatgaacccttatgtgtataaaaaaccgtgtgatctccattgcattgggaatatcccatctcacatagtgcacgcctaaatctatcaaaccatgcacgtgagactgcttcaaaccatataatgatctcttgagtttacatacctttcctaccgtttggttatttccaaatccaaggggaatctccatatagacctcttgtagatcaccataaaggaaagcatttttcacatccagctgatgtagaggccatccaaagttaactgcagaagacaccaaagctctcactatacccatcttggccacaggagcaaatgtttcatcatagtcaatcccataagtttgactataaccttttgcaattgatcttgctttgtatctatccaccttcccttcaggagtttgctttactgtaaatactcacttacatcttactgctctttttcctggtggaagtctcacaagttcccatgtcttgttctcctgaagggcatgaagctcctccttcattgcatctttccacctaggatcttgcttggcacatctccagtctttcggaacaggcactgcttgtaatgatgcaatgaaagttttgtatgcaggtgaaatgtgggagtatgagatataatttgcaatgtcatgcttagagctaatatgttcaaagccaagacgtataggaggtttcccagcattacttctagtttccctacgttgtgtaagaggtaattctacttgttcaagtatagggggaacatcaccagacgtttcaatgaggggcaagggagttggaggagagaggcacggggaggattcttggactggatgctcaggttgttcagactcttcaacttgctcccgtgcaaattccctaatttggtccccatcattcttccttgtcatctccacaagatatgcgattaataagatatgcagcagtcatcacttccacaagtatttgggtacattcatctgaaacataagtgaacgtgccacctccaacaaatgtcggttcttcctctcagctacaccattttgaggaggggttccaggacaagtggtttgatgtatgatcccttgatccaagacataagagacaaattcgttgttgatatactcagtcccattatcagttcgaatgattcgaacatttgcatcaaactgatttgaatttatgaaaatcttggaagcatcgaagaacatcattcttgtgcttaagtacataaatccaagtcattcgagtgtaacaatcaatgaaggaaacaaaccacttaaatccactcactaaagtaactggccatggtccccaaacatcataatgtattaatataaagggttcataactacggaggccactcccaacatatggggtccgtgtatgtttgccaaattcgcaagcgtcacagacaagtctacttttgttcactccattaaagagaattggatatagcttacttacgttatcaaatgatggatgtcctaaccggcaatgaagcaaaataatctcctcagcatttcctgcaactgcagccaatcctacttcttcattattgatgtaccacaacccattgcgcctgactccagtcccaatcctcctcccagtccccctctcatagtgatccaaatctgcccataattgttgcaactcactagcatattcttgaacagttcttccctcttgcttcaagttctccaccttgtcttgagcctcaaccatcatcattgcattgtcttcccctgagtacattttgctcaatgtcttccacacagttgatgcattagaaattgtctccaccatcctcgcaatggatggagccactgaggtcattaaccatgttgccaccgtagagttggtggaattccacaccttccagtccacactaagcttgtcatctggttcaatacaagtttcctccaaatagtgttctaccccttttgccctcaacatcaatcttgtccttctagaccagctcaagtaattttggctctcctccaacttaacttcattcggcatttgctctagctttatttcaggtgatgcccctcctattctaggccccatcatcccagtagctatcaagtcttgtagtaggcttttcatctcgcctttagtgaccagcgatgattcctcaacccctttcaatggatccatctcctagagcgatgccaactaacactccttgctgcccgtgttcaccacaatcacggcaactcttattccatcaagttttcagcaagcaaagaacgggaacatatcctcgcttgtgctcttagcaacccaaatcacataactggaccaggcttcttcccgcacctgtcaacaaagaaacagaaataaacttgctctctttcccacaacaagctcacaaatcagtcccaaatccaactcccaaaacagtaccgtcttttcttcctcctagcttgcgcacacagagctcctctcctccaggaagcccacgaacctgagggcctcgcgtgcgcgcagcggggctgctaccagcgcgccgagtggcgcggcggcgctgctgctgccccgcacgccggtgctgctcctgctgctaccttctcccgccttcctgctgctgctgcctaacgcctgagagaggggtggaatgagcttgttggcctcaccaccgatcagcacccccacacatacatatctttattcaacagaattacaagtaggtccctcataaagttgcatattacaccaacagtatgagatacttaagtggatgatagtttctgatgcttaatttctcagaaaccttgtaacttttttgttgttgttgtttccttgatctcccagaatactaaagaggaaaatgaaccagtggtaacacccttgaagacatttccacatgagatggcaaagatagaagcaccaattacggacaacaaaactggttggaatttgtttcttttgatttgtttttgttgaactcacaattttttcgtcatgaagattgcaaattcatacttcttgttgatcttgtgtgcaggtactaatactagcaagagaggtagtcatcttcaagttacaaaccctcacccagcaaaacaggcaaagaggacgcccataaagaacgacacgcctaagcgttctgctagctatgtctgcaactcatgcaaaaagtaaattattgttccttttacttaatgatttaccattgaaatattgctatatcctcacataggcacttgctaacttgctcaggactttcaactcctctggtgctctgaaggatcattcaaaggcgaaacaccctgcaaccaattgatacgagataacactagtctgtgttagattgttagtcataggtaactgaatttttttttttcgccgggagagagagagaatatttttgaagcagctatttcctagcctcatctgaaacaatattaggattcgagacgatggtctcttcaacataattttggaacactttatgtgaaaagattctggaacgtagataccacagtttctttatgaatgagtgctgaacggtttcattgttctggggatggaacacattttctttatgaatgagtgctgaacggtttcattgttctggggatggaacacggacataggtatgtgcctcagcgttgcacttctgatcggtggcttgcgttactcattggtcagctccagggactccgatccgttgagttggataatagggcctgaatgcttatgggagttatcttgtagacttgtacactaacgatttcggaatgaaccttgataacaatggggcaggatagtatttccaatgtgaaaatccctgcaggatcccggcgaaaaaaaaacctgcagcagatggcaaataactgtctatgttcttaatttaaattaactactgttacggttaaacatatattgattggatgattaaacgttgaaaaaatacgatgctacagttctttttaccgatgcattctgataaatttggctgccaaatgtacatgttctacacttttcttctatattccagagcgacttcgctatatttttttagtgatgcgatgtccacgggataggattatacgctagtcaacctctctgatctctgcaagtactagtatagcttgcatttaccaacttcttgactagacaactcttgagcccttctttccttgttcatttaggttcccagttcaacacatgctgaaactttcttcccttttctaccttggatttcaatgcctaaatcggataaactagtactaacaatcactggtccagtccaacacggaaggttttcaggaactctgaatctgctgtcacttgccatttgccaccaaatccgttgatcaagtccacatggatgatggatcaactcacactgcatccatcaccgttcccaaaagctttgtaaagctaggcaaagctcctccaagggagccagcctcctatcaacaatcagtcgaccaatcagatagatcctgatggcttctgataacgacagaaaagttcacaagtttatccacagcctcttatcttctttttaagattttgcaggtagggtatagtatttatcaagctaaagcccctgcctttcaggaaaatcagagctcttatccaaaagtcacttgtgtccattgaccactcttttggcttaactaggacacagcctcactttcctgtggttccacacacaaaatggccagattctgccattagctgcagtgtgcatttcatccataaactttattccatccacttatgtatccattcaagccccctgcaaaccacagtccacactccacagtgagttcaacgtctgatccacctgaaggaatccagtaaacagaaagatcctgctactgcctgaagactgagattcgttgtgtcatgtggcaaatgatttgctaagcagttattccagagtcttagttaagtaccttttgcagactgaattaatccagcttaaagttggtcaacaaactccacagattaatcccctacattcccttgcctgcagagtgttcagcacaatacagttatactccctaagccataagaaatccagtgcctcccctccaccacatgtcatgctatcttcagcatgttacccacatgcacctgcttgcaatatctgagacctgagccaccaaggatcccaagtccaatgcatgggagaaacatacagttaggagggaagggtgcaagattcgacaatgcagcaattctcatacctcaaagccattggcctgtgcctgcctcctcctcccaatagtgagtttttcgatctctttttttttttttaatcttgagagatgccccatggtgagagttgggagtagaaaaacaggagcatgatgtactgcagagaaatcaagattggtccatgaaagatagagcatttattccaagcaggcagagaaggttcctccagtttttaaacaccccatgagggcttcctccactcactttcatgtacagctcactttcttggcctccttcctttccagctcggtttgctaactcatggtctcctcctcctactcatcatcatcgtcttcttcttcttgcccaactccatatctctgcatggctccatgcctctccatggcgcctatgtatagcctctcctagtcctatctctcgtctcatcatcgtacacaaacagtagtacatgatgcaggacctgttctcggtgccgtcctgcttctcctccggcgagaagctgccggacatcccgagctccggcacggcggcggcggccgcggcggccaggcagagcgcggtgacgctggtctaccgggcggagatctccggccaccgccggcttgtcaccgtgacgtggtgcaggaacctgctcacgcacggcctgtcggtgtcgatcgaagggtcggcgggcaacggcaaggacaagatcggcagggagtacggcgaggccgccgtcgccgccacggcggcggacggcggtggcggcggcggcggcggcaagagctgcagcgcgtgcaaggtggagatgcgccgtggcacttctggcggaagtacggggcgaagcagttccaggtggacggcaacgccatcgacgtggtgtgggacctgaggagcgcgaggttctccgatgagccggagccgctgtccgactactacgtcgcggtggtcgccggcgaggaggtcgtcctcctcctcggcaacctcaagaatgacgcgttccggcggacggggtcacggccgtcgctgcaagacgcggtgctggtgtgcaagaaggagcacgtcttcagcaagaagaggttcgtgaccaaggccaggttcagcgacagggggaagctgcacgacatcagcatcgagtgcagcagcagcaacctcaccggcggcacggacgtcgacatggcgatcaagatcgacggctgcgtcagcgtcctcgtcaggcacctccagtggaagttcagaggcaacgagtgcatctccatcaacaagctcaaggtgcaggtgtactgggacgcccatgactggctcttcggcacagggatgaggcatgccttgttcatcttcaagcccgagccgccgtcgccgtcgccgccgggagcgagctctgaattcagcaccgatgaatattcagatttctgcctgtttctgtacgcatggaaggttgaatgagcctacacactttgttactgcgatacgggcggacgtttttttttttttaaccatgctatgaactggtaattcagatcatgtaatggattggaagatagaagaagaagaagagggaagaaattattgatgccattttgtatttcctctcccatggagagggtgttgggcacatggaagattgcattagaggggcacgcacaggatagtcctgggagtaggaacaggctggtcctgatagagaaacatagggggtggtgacaggtaggattcacaatggcactgcctttcccaatcatgcattcatgcttatttatccagagaaactccagctaatggctggtggctggtccctcctatctagtactatgctctgctcctcctctctcatttttctattactcatttactttgaccctagtttcttctcctatcctcaagtaaaggaagagtagattggggtgcaaacccctgatagtacaacacttgtataattcagatgtacttttgttaaaggcaactagtcaaggagtgcatacttttcatcatggttttcggtaacacatttggaccatgtagctttggtaccaccacaattccagttaagatttcaatcatataatgattaaacattacaagtaattgaaaaaagctggaagaaatgagttagcatatgtcatacaggatgcaggaaaaagaaaacagaatcctggaagacaactgagttcataaagttctgttcctgatgtttttttaatcatcatgtcctcattagttgacatccggattgaaaataggaatgccagaaatataccaaggaagtgctcttctcagaatcccaaaaatacaataaaggaagtgctctttcccaatagtttgaccatggaaaaactattttctggtagtaaaaattaaaatatgtaaccatggaaaatatattaatttgaccaaaattgctagttccaatagttttcatatatagtgctcttttcacaataatatataatgaggacaataaataagttatctaaaattatacttcctcaacattgtgacaaatcatgaattctcaacatgtaaatcaaatgaatagtcgaattaatagaagtgaaagcatgctattttgatatgaattagtataagtcaaaacatgctattttgatccaaaaccaaaccattttgctaagaaatatttgttcttcccacggggagtttcatctgaggtctttccaccattcccgtgcaccggtctctgattatctgcaatgcaaaacagttgccaccaaattagcaagagtataccacataccaaagttgaatgttttttttcttttaagaaatttgcattattattttttaaaaaaaggtgtgcgggagggctgcctaaagttgcattggctatgaattgactttggaatttcgcttagtcttagtggtatattagatgtaaaatccccagggttcaatatttgatataatcacgccgaagccatcgcttgtattttcctttcttaagtcatggtcaaaccagcaaagtgtgacctcatcattaactgtgaattgctcaactatttacagacaatctacttgtcaaataatactggaggcgctagaaaaaattacttgaattgggcttcttagcatcttgggatgaccctgatgctgaaactgaatgtttctggtccaggggactgttcccttcacctaatatgaacaacagaatggaattatgtcaggaataacaagaaacaggcaacacgtgttaagtaaaaataaagggacatatacgacgatgacagtaagtcagcattatacttgaatcaaagctatcttagtgatagaatataacccagcaggaggagctatcagatatttcatcctagtcatgaaggttgtaagaagtgaaatgggtattgaagttactacaagaatattttgccctaatagcatgagctgttgcataccaacgctgtttaaatttttaagaagaattgggacaaacagtgaaatttgtctttaacataaatgtacatacatccagttaataaaattgtacagaaggatttcagaatctatttaaatatagtatgaataaaagctcaccttttgtggacggctctctgtagttgttcttcaagtactcgacaaaagaatgatcattgtgatcaagaagcactgaacaagagaacagcaaaagcaagttacgaatggaaattactacatatttttgctacttcttgattctatactcataaataaatatagtatgaatgaagaagactactatattacattgttgaaacaattcgtgcctcatatgctcagaggtaccaaacaagagcagttgcactgcctctgaatctctgtttgagcacatgttggaaagatttttcgtatctaacaggatacctgcaagctgagggggaacccagaaaacatggtcagaacattccactaaattatgcataacagtctcttttatgtatagcaaatgcactaaccagaagtttctttatgtccaggctctgaagtagactataagcatcttcacaataattattggtgaggattgtgcaaactgagcccatctaggggacaaaatcgagcatgcttattaagtaaaagctggaatcatatacattaacctcggcaagagtcttgagaagtaccagtacaactgtacaagtacataacattaccttatcgtttggtttcagaacatcctgccccaccactaccaagctgactcgcttatccatcattagcccctccatgtcaacctaagtcggattatgaaaatcagtatcataaacattttaccattactcacagcgtgcttgatcacggttgttcctttcaaattggagaaacatatgtgttatatgaccataaaacaggagatagtttgaaggaaatgaatggtgtgcttgcatcttgattgttcctttcaaagtggagaacctgacatgttatatgcccataaaactggaaacagtttgaaggaaataggccatcaataagatttactaggtgctattacagatgcccatgtcaaattgatcttacgcagatgttaaatgcatcaaatttcaaaattatgttgcttattgttgctagaattgctttccctttatatgcccatatcagcacatgaagctacaattgcaagaagcctatcaaccacaaaaccccaaatcacagccacatggtgccaatcaaaaaccggaacacccacatgacacgactgcaatgtgattgctgtatattgcccatccttgtcgcctctgcccagaataaacgcccaataactccggggcctagacagttgtccgatttgtcggagacgaatccaacccccacgctaagctaaacggcctgaaagctcacgcaaatcactatcgtgtagtacctcgtcagcgaagagcagagcagaggcgtcgacgccgacgtggtggagcagccaggccgcttgcctgcacctctccatcctgccgcggcgcatgttcaccaccggcaccgccgcctcggcgtcctccttgctcgccagcatccacgcgtagcatatcgccgccgcgattgagctgacacctgcggggagatagaacaggaaatcgcaagtgagcgtgtggtggggtagattcaattggagcaattggggatggatttggtggtaatccttacttttggaggcgtcggagaggacgatcttcgtggacctcgaggatgggcggccgccggagccgagctcagcgacggcggcgcgctggcggcggaggaaggagttgaggcgcgcgacgccatcgtcgaacacgtcgacggcggcgggggaggaggaggaggaggcggaggcgtggcggcggtggtgaggctttgcggcggaggtgggcgaggtggaggcggaggatgcggcgcggcggtaggcggaggaggaggagaaggcgtcaggggcggaggggtagtggaagcgggacttgcggcgggaagacggcgggtttgggggcagggagtgggcgggggaagccggcgcggaggcgaacgggtcggcgcgcggaggcgaggaggagatggacgcgcgctgcagaatctcgtcgccgatgcctcccggctgccggtgcctgcaagctcgccggaggaagagagactagtaagcgaatacatagtagaaggaaatcgccacggcgccaccggcagtgagcggcggcagcgggatgccggcggcggcggcgcggggccgccatgggcggcaaaccaaaaaaatgtggtttgcaactgggccgctaatatagctttgttgggccactggcccatctgacgattgggccgctaatacagctcgcctgtgcgcgcgcacgtgcacggacgacgacgtagtgacatcactgacatgcgtaccttcgggcggagcgtgacatcgggtcgcggcggtcgagcgacggcgagggctccgtcccggcggcggcggcggcggcgaacctgggcacctgcctggacggcgagccgacgcccttcctccccggcgacccggccccgaccatcctcctcgcctcctccaaccactcctgcgtctgcttgctcgcgctaccaccgccgccgccgccgctcctcccctgctgctgctgctgcttcttctccgccggcgccgaaggcctcttgccgctgctctgatcgccggtcaagtcgtacgcaccgccgccgctgcgccgtgtgccgacggtgccgaagaaccagtcgttcatgaagtcggccaggtccggcgccccctccacctccatggcaaccaaacctcttgatcgatcctttcacgtacgtatccggccggttggtgtttttgagatgttctaacgtgagtttggctgatcagaaggtggttttgcctttttggtgtggagatgaatggaacaatgagagggagagggacgacagcgtgcagggtgagacggtcgggtcggccattcggccggccgcggccggcggggggcggctgcttgtatcgtagtagcgccgagtggtcgtttcgaggtgctgctgtgttcttaagtcattgttcccaacttcaaacccctcattttcgtacgcacgtttttcaaactactaaatgttatgtttttcttaataaataataggaaaattatttaaaaatcatattgatctttttctgaaattttagataatacttaattaattatgtgttaacacatgtttcgatttacgtgccgggatgatgtcgatgtgacatggcaaaatttgctataggacacccaacttttgtgtaatttgatgatagacatcctaaaaaagtgacacgagtgaaagacgctctaaaattggtaatttgttggatgacattttcagctcaattgaatagataaattatttaaaaataagacaatgacccggtcaaacgtttttttagccgagactagagtgaaaatgaaatatgatgtatgctagtgatgtactttgccactttgggctatggcaaattttgagttgcataatttctaaaagtttactctaacaccatgtttgaagcatgtgaccatagaggcgttcttatcttttttttaagaattcatctctccaattgagctgaaaatgttatctaggaaattactagtttttttaatgtcatcagccgtaacacgttttttcgatgtctgtcagtaaattacataaaattttggtgtcatgtagtaaatttgcccctaagcatctacagcttgcaaattgcaatgaagagacaataggttatcgacagctcgtcaggatttggttggtggtatcatgacaacccgttcattgtagattggggttgagggggtatatccgtctatgttacaacacaaacgaattaattaattagatattaaaatgttaaaaaatgaatttggataagttatataaacaacttttatgtagaatgtatttttaagctccgcccgaaggtatgcatgtcaacgatgttagtaggtggtggtgcaattaaccccattcacaagcacatccactaagtatgttggtccttgggggcttatcggctcaggtgaaggaagtaagaagtgaagggccacgacggtgcttggcgaggaggaaaaggaatgtgctatcggagcggagaacctcaccggagctttgctggagtttgtgtaggaggatcgaatggattctattagcatattttccttggtatatatcaaatttaggttaacgggtctccacacaggctacgccccctagtcgtgcaaggtcaacacaacacgacctgacatctcactagaccatacctgggcttcagcctcaacatatgggctgacacgacacgcctgtgtggtgagccgtgcttaatccgataatgctcagatgtacttagaccccctttgattcaaaggaaattcataggaattttagaggatttcattactataggaatttttcctatatagccctttgaatcaaatgaatggattttatgtaatcctatgaaattcctatggattgcgtaatgctatgcaagttttggaggaattctaacatgaggtaaaacctcttggaaactttcgtttgagtctttatctctcctataattcttgcgtttttcctgcggtccaatcaaacaaccattcctgtgtttttcctgtgttttgcaatcctctgttttacacttacattcctatcaaaatcctgcgtttttcctattcctatgttttctcattcctgcgatccaaagaagcccttaatatttatctaacaatctcaatcctataaaatattaaaataaaaatcttaaaaaggtccagtcccaagggctccgtttggaaagattttcaccgtttgggtaggttggggatgggatgagatgtgcaatcccgggagaatcccggtgaattgagtgctcggctcaattaggaaattaccctcgccattttgacgtagtggcctctgtcgtccgtgagttaccctgacccctcctcgtcagtttgcccgccgcggcgccgccgccgccgccgccgatccccatccatcccgcgagcgagcagggcgccgtcgttcgtcctgctgcatccgccgcatcctggtgagcacctcctccgccaccgccgcctgcgtcgatccccatccatcgcgcgcgcgagcgagctgggtcgccgtcgttcgtactgctgcttccgccgcttccgttacgcacatcctctttctacccacgcactttttctcggatttgcgttaatcctagcttctgttctagaaactgacttaaccttagaaaatagtactaataacagttcaatggttcccaaaaagtttgggggtttaactgaaccccatgtcccatgttagatccgccactgcttcgaggattactaattccgttctatttgggtgtgaatattctcaatggtgaattgtcatgacctcactttgtaaatttctctgttggaatggcagtaaacatgaaccctttaaagaggtcattggaatcatcttctcaggaacatgaagcaggcaaacagaaactgcagaagagagagtgtcaagatttcactcccagaaggttctgcggagttctccttttcacagttactatattatataatcagaaaaagagtgcaatcctgtgacattgctttgtgatgctgaaattggtcagatatcagcttgatgtctatgaggttgcaatgcggagaaacacgattgcgatgcttgacacaggagccgggaagacaatgattgctgtgatgcttatcaaggagttcggaaagataaacagaacaaagaatgctggaaaagtcatcatatttcttgcaccaacagttcaacttgttacacaggttataccagtctgtagactgttcgttttatcctaactgtaatgtaatttatactaacattattttttgccacagcaatgcgaggtgattgaaatccacacagattttgaggtagaacaatactatggtgcaaagggggttgatcaatggacaggtcctagatggcaagagcaaatctcaaaataccaggcaagcatttatttgttgttgttttaaaggctcactgattcatcatatgtgctaaagaaaatactcattccatgctagcagcacttatgatctgcagtcttctgttcactatattatagagtaaatttcacgaaactacagatttttaaccaaattatcgcaaaactacagatttaaggccaagtattagagaactacagatttaatactaaagttatcacaaaacaacatattctagagtataaatctatagcactaccgttacgttagagctataaacattgtagttttgtgcttaaaattggcactaaacctgtagttttgtggtaaatttgctacttaatctttatctttgtgatactctatcttaaatctgtagttctatgagaaattccatgctaaatctgtagttttgtgatataacacctaaactctgtagttttgtgacagtttgatcgaagtatccatagttttgtgaaatttactcaacatcttttgttaagaatatcccatagatgtttttcccctgttctatctacttgttgatgctttcaacacttataataataaaattgcaggtcatggtcatgacaccacaggtgttcctacaagctttacgcaatgctttcttaatcttggacatggttagtctcatgatatttgatgaatgccatcatgcaactggaaaccacccttatacaagaataatgaaggtattgtgaaataccatcttatcatgtttttttttttttgacattagcatttaggtttttcttttttgtgtttgtcatatgttataactcatcactatctcaggagttctatcacaaatcagaacataagccaagtgtgtttggtatgacagcatcacctgttataagaaaaggcaagtattcagttatctgcaagagctatagaatgcttcttcttcttttcttttgtgtgggtgtgggtggggggaggaatgggatgttaagagacttataagtcagaaaagatcagcaataaatttcttgtaaacagtggcatttaggacatgtgttaattctgacctgccatctaagagaaatatccaggaataatgatcgtgcgcataatctccaatttcactttggccatagagttcataaatgccaatatttctggcagatttgatttattcgcatcacttagtcttattagatgatttgagttttcatggttttctttgcaggtatctcttctcatttggattgtgaaggtcagttctgtgaattggagaacctgttagatgctaaggtatgttcagtttcctgctttgccacacatattatttgaataagctgggttagattatacaggacatgttagttctgataactacactattctactttgtctattgaagtgcaaggatatatacatacctgaattccaattatttactgattgtggttttcaaccaaatgcaaattgttttactgttgtgttcgttttgagagcttaggtgatatatatttatctgttttacccatgccattttgggatacacctatgaccccttttaaaaatgtgatacggttatctgcgtactttgattctcattaatttttatctgtaacagatctacacagtttcagatagagaagagatagagttttgtgttccttctgcaaaagaaatgtgcaggtactatgactcgaaaccagtttgttttgaagatttgagtgaagaattgggagttttatgttccaaggttttatatctcttttttctcttctatattgatcaaatttgtcatcaaagtttgcagctcagcatttttaatgtttctaagaacacactcttttatgtatgtgcagtatgatgcattgataacagagttgcagaataagcgaagcgacatgtataaagatgctgatgatataacaaaagaatcaaagagacgcctttctaaatctatagcaaaaatttgctactgccttgatgatgttggtcttatttgtgcaagtgaggtatttgttatattcatttgttctagctacttatgttacaggaactgagcttaacttggtgcgaagcgcgtttgcacgcctcacaacctatttaaatccttttcagcctaattttgggttactttcttcttaaccaaaaaaatcccatctcttagtaattcttttttctctctcatactgcaacgttagctttctatgtttgaagagttcttttaccgtcactttgcttcagagttcatgtcttaatatgggtaaataataacttatcattcattctcttaggccacaaaaatctgcattgaaaggggccaggagaaaggttggctgaaggaagtagttgatgccacagatcagcaaactgatgcaaatggatcacgcctatttgcagaaaattcagcgcttcatatgaagttctttgaggaagccttgcatttaattgacaaacgcctccaacaaggtatgactatgtagataaactaataatggactggtaatgtctgtaaacttatttgcaaccttacactgttatgccatgccattagccaatggatctaagcatatatagcactgcaacaccctatatgaacttatggagtatgatgaatctgtttgataggaagtatcatgtaccatctccttgatgaattcctatcctttcatttgatgtctgtgtgtagcatgaagatggtacttcagtcttttggctctcttctcaatatgaaaatgctcagtccttctgtgtattctctaaactatttgctatcttccaggtatcgacatgcttctaaactcagaaagtggatgtgttgaagcagcaaagacgggctatatttccccaaagctctatgaactcatccagatctttcactcttttaggtattatttcttggggaaggtccacttgtttatttttttcaattgtgtgcctttaaactgacgtgacacatttctattcctaacagtaactctcgtcatgctcgatgcctcatttttgttgatcgaaagatcactgctagagtcattgaccggatgattaagaaaattggccaccttgcacatttcacagtttcttttcttactggagggagatcttcggtggatgctctgacacccaaaatgcagaaggatacattggattcatttcgctctggaaaggtaattaagatatgtcaacacttggagaaactgaagcatagttctcatgatataaccttgttttccctttctaaaatgcaggtgaacttactatttactacagatgttgctgaagagggtatccatgtcccagaatgctcttgtgtaatacgatttgatttgccaaggacaacacgtagctatgtgcagtcacgtggacgagcacgccaggaagactctcagtacattctcatgattgaacggtataaccttaatgctaccccattacaccttttattcacgtgcttttaactgaatgcagagaggaatggcaaacaagaaggatgcaaggatacataattcatttcttctaatgcagggggaacgtgaagcaaaatgatttgatatctgcaattgtgagaagtgagacttcaatggttaagattgcttcaagcagagagtctggaaatctgtcgcctggttttgttcccaatgaagaaataaacgaataccatgtaggcacaacaggagcgaaagtaactgctgattcaagcatcagtattgtctaccgatactgtgagaagcttccgcaggataagtatgttgatctcattttcagttgtctctttttacatgactacacagattgcacctataaatagatctgcaatacctggtttcagtctgttatcgtttttgtttggagacctccaattcactttcttgccatttctgcttgtgttacaggtgctactccccaaaacctacatttgagttcactcatcatgatgatggatatgtgtgtacattagcattaccaccaagtgctgtgcttcaaattctggtgggcccaaaagcaagaaacatgcacaaagcaaaacagctcgtttgccttgatgcatgtaagaagttgcatgagctaggagcacttgatgaccacctttgtctatctgttgaagatccagttccagaaattgtaagcaaaaataagggtactggtataggtatgtgattgccaagttttataaggagtaaatcgtatcactggtcctctaacttgaactaattgttcaccatctgggttcctgtacttagaaactacatattttagtccataaagtacattaaggtggtcattttaggtccatctgggtaactagcattccttgtggacatgatacactgaggtggatctggcatccttgtgccccccggcccctccccacaacctccaaccctcccaaaaaaaactgtgccacgagtgcaacatcacaaatgctgtttttgtcaactagatgctgcacctaaggtcagctgcatctctgggagcatgagtgaacatcacctgcatgcttcatcatcacctcattaagtttccatctccatgaattgtgttgttacttgtgacatccaccgcaaaatagtacaacaatttaggggagatatctaagggagaagagagagggacggccacacataaaatgccatttcttctggattgtatagttaataatctactttacgcactgttgtggacctagatttgcattttctacatatatgtacctagattagtcctgtgtacaagtttaaggattcgccatgcagtttactccaagttaagatgccatatgctggctggttctttgtaaccagcgtatgtagtcaagcttatttgtaggactgaactccattatacttcttacaaagaaatagatgtcatggtaatgttctctattaccttcttgaaggtacaaccaaacggaaggagctacatggtacaacaagaattcatgcttggtctggcaattgggtgtcaaagaaaactgcactcaagcttcaaagctacaaaatgaattttgtttgtgaccaagctggtcagatttactctgaatttgttctgttaattgatgcaactttaccggatgaagtcgctactttggagattgacctatatttgcacgacaagatggtcaaaacttcagtttcttcttgtggacttcttgagttggatgctcaacaggtatgatgaagtttgtcccctacttttgtttttttcccatttaatctgaaaaattccttatcctttttttttgtctcagatggaacaagcaaagttgtttcaagggcttctcttcaatggtttgtttggaaagctgtttactagatcaaaagtacctaatgctccgagggaattcattcttaataaagaggatacatttgtgtggaacactgcgagtgtatatttgcttttaccaacaaatccttcttttgactccaacgtttgtattaattggagtgtcattgatgcggcagctacggcagttaaacttatgagaaggatttattctgagaataaaagagaattacttggaatatttgattctgaccaaaatgttggagatttaattcatttagctaacaagtcgtgtaaggctaacagcctcaaagatatggtagttctagcagttcacactgggaagatatatactgctcttgatattactgaa

SEQ ID NO: 69447 - DNA, 21493 bp, Oryza sativa
tctctatttttttacttcgatgattagtgataaacccatttgttagactggttacttttgcataaactgttttatttttgtaatttgtagccaagttgattatgtcgtatataggctgatctaatatttatgattgctgttgcttttttttaggtaatgttgtggagaatatgagtaatggcacaccagttgtaaataaaacaagcaaccgtgtccacatgcctcctgagttgctgattccccttgatttacctgtggaaattttgagatcattctatttgtttccggctttgatgtatcggattgagtcattaacgttagctagtcaactaagaagtgaaattggatacagcgattctaatatatcaagtttcctggtatagatgcttatacctctctcttctatacatacattttctgtttctttaatatgaaatgatatattggcacatgttctttagattctggaagctattacaacgcttaggtgctctgaggatttctctatggagcgtctagaattattgggagactctgtattgaagtatgcagtgagttgtcatcttttcctgaaatttcctaataaggatgaggggcagctatcatccataaggtgccatatgatttgtaatgccacactttataagcttggaattgaacgcaatgtacaggtaaattcacattatcatttggcagtgtctagagattttgtatttcatggacacactgagctttaattgtctgagctaagttgacaattggtggaatgtaatcaacagggttacgtacgtgatgctgcatttgatcctcgtcgatggctagcaccaggacagctctctattcgtccatctccttgtgaatgccctgtaaaatctgaggttgtaactgacgatattcatatcattgatgacaaggctattgttctaggcaaggcgtgtgacaagggacacagatggatgtgttccaaaaccattgctgattgtgttgaggctattattggggcatattatgcagggggtggtttaagagcagccatggcagttctcaaatggttgggcatcggggctgaaattgaagaagacttgattgtgcaggccatattgagtgcttctgtgcagacttatcttccaaaagacaatgtatttgaaatgcttgaagcaaaactaggctattctttctcggtgaaaggtcttttggtagaggctctgactcacccatcacagcaggagttaggtgcaaaatactgctacgaggtatcgggtgaacataaaactattttgctggtccttcatattgtgtcttaacttacccaacttctctaatgttttttttttaacagcgcctagagttcctcggtgatgcggtcttagacattctgttaacaagatatcttttcaatagtcataaagacactaatgagggggagttgacagacttacgttctgcatcagtcaataatgaaaactttgcacaagttgcagtaaagcacaacttccatcactttctccagcattcttctgggcttctgttagaccaaattactgaatatgtgaataggttggaaggttcatccatggacaaagttgaactgttatcagatggactcccaaaagggcctaaagtacgttctttctttgttttaacatgtgtgtggtttgctcttatcagaataaaatcaagtcaatacgttaggatttcagttcatatgaatgacatttgctttaagttagagcatcttataaatgcatggctatgtatttaatatactttttacaagttatttgcattgcattacctgtgtcctttttagtgtcatcttccagtattgacatacacaatcatctttacaatttatctatattaatatatcatatttcacttgtctattgtgatacaggtccttggtgatattgtagaaagtattgcaggtgcaattcttttagacaccaaacttgatttggatgtagtctggggtatttttgaaccccttctttccccaattgtcacacctgagaatctggagttacctccatacagagagcttatcgaatggtgtggcaaacatgggtattttgtaggaattaactgtagagatcaaggagacacagtagtggctactcttgatgtacagctcaaagaggtgcttcttgtgaggcaaggttttagcaagaaaagaaaagatgcgaaagcgcatgcatcttccttactgctcaaagatctcgaggtgtcctatttttgtgctccactattttggtagtgtatgttgcaatgttcttttaggggataatataagctgacaggtttattcgtttttgcaggaaaaaggactaataatcccaaagaatgcaagcaagacagaacaatttgaaaagcattgtggcagcactaatcccttcaacaatttgcatgtcgatgcaatggatacacagactccaaaaccaaccaaggaaaaaaacgcagctgattcaaggaacatttctgatcccctgcttggtaaaccatgtatgttctcaatcaccagtggttctgtttttgttgttatctctgtgctttcattcatatcaggacctcatatatccacgtctgtagaacgaatcaatttgataaagttcaacaattttatcttgtttcagtgcacgtgattgtgaaaacgagtaaaggaggaccacgcattgcattatatgagttgtgtaaaaagttgcaatggccaatgcctacaatggaatctgagaaagtacaaccaaggtactaagatttcatactagcctgtgaatgcctgtttatttacttatctatgcaacagtgcaaaataacttactaatctttcatggttcagctttagcagcgtgtgctcctcccctggtggttcctctcagaaagctaccccccaagcgttcgctttcgcttcaaccattacattgcatataccaaatgctgatgtgatcagcctcacaggagatggccgtgcagataagaagagctcacaggattctgctgccctgttcttgctctatgagcttcagcggcgaggtactttgcaactccaggaggtgtgaaggaacgacaactgattgcttgccaaccagttgcttggaagttggaataatagaccaaccagttgcttgccaccactcagctttgtacatcttctccagtgttcaccttctgaattatgataagagggtacccaaagaatggagaacagctgacctggttctggtgtgtgtcagttgttatgtgtgtttgtccatatgttatctgcgtagaaactgaataagcccccaaagttgttgctgacgataaacacgcaaatatcatgcccctgtagcctgtaggtgttaaaccaattgttcaaggataaaaagagagaccattttcaaatcatgtttccttgttctattattacataaacataccggactttttttcttataaaaactactccagtaaacatttgatcattcggttactcttgcataaatatgaacagaaaggaaatcgtgattttatggtgatcaaatgtataattggcatttgatcactcgattgctctttgcgtgaatgtgagcagaaaaatggaagtcgtgatgttatggtgatcatcaaatgtataattgacatctgatcagtgatcactcgattactctttgcgtaaatatgaacagaaaatggaaatcgtgattttctgggggatcaaatgtgaaattgggccgaatatggataccatcccagctaaacaggccacgttctcaatttaagcccagacaaagcccaatttcataattttatctgctccaccacttcgtgtccctgatccccttccctcctccaaaatcaaaaccgggaaagccaaccaaccaacggccacagatctcggctaccggaacgaatcgacggcccagattcgtcgcctcaccttccccgccgtccgcttcgcatcccctgcttaaaccctaaaccccgcgtccccgcttcctcctcgatcttagggtttcgcgcggccgcgcctccgattcgtcgtcccaacgaggcagcgatggaattctggggtaagatcccccccctctctctctccaagattctggttgattatatttgtgttgtgttctcggggagattttatttgcaattattttggtgcgaattttgggcgtgtcgtgttcccgtgatgagatgttggtaatgcttcaaacggtgttggggggtgtgcgattttagatggtgttctcgtcaacgagcttctccgcgatcccactttaggctctgttttgtctagtgccgaggaacgggcttatcatcggttttgtgttccgaggttgagaaattcgccatcttgtctgtattataatctgaattttatgatgtactgttaagtatcacccttccttccctgtagaaagccttgtagtttgatgataacttgataagggtctcctatgccattatatgtggggtgatgggatgatcatttagtgggttgtcaaatttcaagtagtgaaaagtttttttttttgacttattgttgatgctagattgtgggagcttttcaagcgctgatttgttatttggcataactctacgttttctcaatgcactatgggctgcattttcaatctccagctatgcaagggaattcgtaaagtgtgatttatgatgggagtttgaatgattgatctgaatcatgcaggtattgaagtgaagccaggaaaggctgtttcatttaacgttgatgatgagtgtgtgattcacatatcacaggtttagcaccctcaaccctcatcttccaaacacacacaacgaacaaaaaaagggagggagagaataaaatttaaatacaacttgtctgattatttataatttgtgttcgttctcaatctcggtccttacataattgatcttttcatgttattgttactttttttaggttgcactgggagaaacaaagaaggcaggaagtgagaatgtagttgtatctgttaaagttgatggcaagaagacagttattggaaatctatcggctaaaaatcatcctcaatttatgtgtgatttgtttattggcaatgactttgagctttcacacagttcaaagactactagtgtcttcctgtgtggttacaagactgacatgcctaacccatatgaatatccttcaacatatgcacttggaattattttcgaatcatatttagattttatttgaaatatcctttgggaaccttgtttccttaaccatgttgtttcttttctcacatccgattctcgtgaagatgagggtaaattcattgactgatatttctgaaataatttctattgtttaagtatccaatatttctattataacataaactaactagtatgtccttatttcagatgaagatgaaaacatgtctgacatctgtgacattatgggtatgcagatttattttctttttattagttgcgcgtttaagatcacacatgcgctttcttgacaatggctgaattaatgctctgggattgctgtatatcactatatttgttaaggtaaacatctgggaaggcctgttgcagaggaaggtaaaaaggataattctgatgatggtatggacttgtcctcatctgatgatgatgatgattctttggactcgtcctcatccgatgatgatgatgtaagtttatgatgaaagtgcatttaccctcataaagttttatgtatagttttatgacgaagaaagtcttatgtatagtttttgtaatattgctcacttttttccccttaaggatgagtcaggtgatgaggatgatggatctgatgagttaccagcagaaatggagtccagtgaagaagaggatgggagtgatgggcaggatgaatcatcttcatcgatggtgtccactgatgaagaggatgaaagtgatgaggagatgaaattccagagaaagtatgcccgatatctgccactgttcttgatttgtctctaagatgcgatctgactcttgatttgtctctaagatgcgatctgactcttgttttgtgctcggcagcctgagagcagcaagctgacagctgctggatctacactttcttctggtaagaagtcaaagactgcaacacactttggccagaaaacaggttagctctgccggactgacgctatttttattaaccttgcaacacacaggggactcaactttagctaatttttcgcatttactaaaggtgataagaatactcatccagcaaaggaagatggcaagacgccggcaatcagcaaaccaaataaggagactcccgaatcctccggcacccatgcctgcaagtattgcagcaagtatgtatacagcttggcagtttattattatgctgtgataagatgcagtcttatcacaagcattctaacattagatggttcttttctctcacagggcatttagtagtgataaatcactccggtctcatcagaaggcaagacatccagccaagtgaactactggtggcatgtttgactgcagctgcttttgcttcaaagatgatcctctaataggcagttttggccctacaacctggggcatacccaattttgcttgctaaatgtttcttttattttattttttggcgaaaacgttgcttaaaaatccagaaacatccaagttggatgaggttacaagctaggtagtactattaattacaaaacaatgttatttgtgctgtgatggtctgtgtgactattaattacaaaacgatgttatttgtgctgtgatggcctgtgacaatgcggagactagtctgctttcttggttacgaggttttatactctgtcttctatgctctactgtggtttgggtatttgatatttggtcaagttcttcgttttctttccattctgtgcacacgatcgcatgtactccctccatacttgtaacggaagtcgttttaaacagcgacacggttcttgtttctataaaaaatatttattgaaaagtgatatatgtatatttttatgaaaatatttttcaagacaaatatatttgtataacttttatattttcaaactcaacaacttgagatttgttcatgatttatattcccaatgtttgacttaaacaggccctgtgtaattctaaaatttttttccaaaaacatcacagcgaatctttagacacatgtatggagcattaaatataaataaaaagaaaaactaattgcacagtttgtatagaaatcacgagacgaattttttttagcctaattagtccatgattagctataagtgctacagtaacccacatgtgctaatgatggattaattaggctcaaaacatgtgctaatgatgaattaattaggctcaaaagattcgtctcgcggttttcaggcgagttatgaaattagttttttcattcgtataaaaaaaacccttccaacacccggtcaaacgtccgataaaacccctaaaaattttcatttcaccaactaagcagacccttgaacattatcctaaacgtacggagggagtaactcaactctgcgatgaaatcatgatatgctgatttctgcactccaaggcaatgatttgttttattgccacgatcatggactcgtggctaatcacacttaaggaatcgaacggttgagaattttagtacaagttttgtatgtaaatctggacatcccagacttgtctaaaacacagacgaaacggttttttttacagacatacaccaccagtttttgttggtttatcattggtttccacgaaatccaaagataccatacgagcagtttttgatcccggtattgggatcgttaacccagattgtgtccgatatgagcagttttttatcccggtattgggatcgttaaaccagattttgtccgtccaaacacactcaggaaaaaaaaaagagcagatcccagaacaatgaaacgtgcaacatccatacgcattcattaaaagagcgccataaataaacatgtttcagaaacttggcaagtgctccaaaattgtgcttcatcaaaatatctggatctccagcttcagaattcagttacctatcactaacacacctacacaggattgcccagaaggtatttcagatcacttagttgcagtgtgtttcgccttggaatgagcttccagacccatagaggtgttgaaagtcctgagcaaaataggaagtgcatatgtgaggatatagcagcattactaaggtaaatcattcaaatgaaaagaacaaaaatttacttgttgcatggcttgcaggcataaccagcagaatgctcagacatgtcattattggcagtcctcttctttgcctgttttgctggataaggggtcgcaacgtggacatagccagaggattgcttagccatgtcattgtttacaggtgtcttctttgcctgttttgctggataaggagtcgcgacatggacgtagccacttctcttgccagttcctgcacacaagatctacaagtgagaaatgcaatctctgtgccataaaaaaaacagtgaatttaggggggaaaacaaatcaaaagaaacagtttccgaccagctttgctgtccataattggggttgctagccttgaacaagctcacacctttgaaggagtctcttcttcatccgaactatcaccatcatcatcactagaatcctgtttatcaatcatatcctacaaatatatcgcatgatcataacatatctagcataaagaaaactttgttcgcacacctaccgaagtccaaaaccatgtcatggtttcagtctgaacaagaatcagcatgctgctagttttaatagtgttactgttttacaaacctcatcatcatcatattcatcctcgcctgaagcatcactttcttcatcgctgtcatcatcatcagcttctgatttcccataattctttctttcctctacaatagcctctggtgtaggggatgcagcagcagcagacttaagtgtggcaaacttacttggactgttttgaacttctttgatcttatcatctgaaagtagataacataaaagagtgtatcattcgaagattcgcttaccagcttgtattagcatgtgcatcagattctagcgtaaaaatatataaagtcttataagttcaattaccatgctatcttcttaagtcttataaaataattgttacgattagcaaattatataccatctgaattggggaatagtggaatagccagtggaacctcctcatcagattcatcacctgaaacatcacatcttatgagaatcaggccaagtgcagcggaaacatcagagatgaccaattactactagtaaagaacaaggacacataccttcttcagtaggagagtcagatgtgcatacagccaggcaaaaggttaaggaaaaatattcctactcatgatttatttgaagaaagatcattataaatgcaaaaggatatcttctcgcatccgcagcttggtagccagaaaagaagatgttgtaggtctttgaggtatgcagtaactcaaactccttttcaaacaccagatcaattgacaactgaggacgatgttcaactgaaagtgtgccgagcagaatccttttaccatcaacttcaccaaaaacttgcacgttctcattcagctcaccaggctctaacgctatctgcagtgaaaatgggaacttaaagtaaacaaacttgatccacctccaaatgagcttttaggtacaatttgttaaacaaacctgtgaaatatgataatagaattctcctggtggatcacacatcactgtctctccaggtctgacagcaactcctagaaatgtgaattacattcatgaaagccattagtaaacattggtaaaaatgagcaacacgtgaaattgggaatgacaaacatttgcttctttcttaagctctacaaatatgcccatcacgcttgtgtccaacgcgatcaaaagatctcttcacagttgacacagaggggaaaaaacattagtggcatgccaacgggcagtttgaatgccacacttgtgttcagaataagtacaacgcataatcgaaggcaaatataagtagaagaatgcgcgtatttcagtgataaatatttcatatctacatgggcaagaagaaaccatagtcaatcatgaagacctgaaaaatcaaagattgaccaatcaacatcgaccttgccagtcaacactctccagtaagcttcatgccatgcttaattcattaaaaaaactgaagcactaaatcatccaaccataacatgaaaatacaaactatactaaatccaggaaccaccaaacagaagcagggaatgtattactctccagagcaaggcacagttcattaagacaaactactgccttattactcctagatatcaacttgttcacttgaatccaactcatcaatggaatagccaaatttcctgcagttctgccaagagcctgattaaagttcaagggtatgactgcattttcctacacgaatattgcttctatttctcccccaaatacaccaaaataccaccgcatcctatcaggaagcattgccggtgaaaatatccccagatctccggagcatatggggggaaacccagcatttaaccaagaaaccgaggatcaacaatccaccacaccatttttacccctcaaaatttcccctatcgactaggcgcgaccaaaaaaaattaaagatggcgtcgaatcgggagcgagaaacagtagtagggttcgggggcaagaggaacgcaccccagaatcccatggtcgtctccatgggcggcacgaaggcgatcgcgttccccgtggcctctccctccttccccctcctctcctctcctcgccgtgctcctctgctagggttttagagagggagagagagcagccgcgcggcggagtggaggcggcgtcgctttcgcttcttctcttctgattttcctacatttgcgagggggccgaggcgtcgggtggggtggctggtcgtctccacgctcaatgacaagtgggcccatgggtgttatcccgtccgtccgatcggaagcgagggaatcacatccgtccaaatcctttctatataaaaaaatagggggagaggtttttacgccgttttgcggtgcattgtccggcccagcataccttgcgtgggccggccggcactaaacacgagaaggaataagttcatctgaggtcccttaacttgtcagcgaatctgattttcgtccctcaaccgaaaaaacacagatacaacgggtccctcaactatcaaaaccggtgtagattaggtccctcggcagttttgatggtggttttggctgacgtagcacctacgtggctaatttgactcagacttcatctgacatggcattgacgtagcgcctacgtggcaatttgatccgaaaaaataataaaacccatgggacccacatatcagtttcacacacatattaataaaaatggtggggcccacgtgggccccacatgtcatcctcacccctcctcttcttcctcctctctccccatctcccctctcttcatctctctctcctctcctttctctccaggcgacggagggaggccgatgagcgcgcgtggaggccgacgagcaggacagcacttcggcggcgaggcgtggacgagcgggcgaagcgggctgggggagcagaggaggagcggcggcgggcgagctcctcgtcctcgcagggcttcatcgtcgaggagaggtcgcaatccatcgtcttcgcagggcgtcgcgcggcgaggtgaccggtcgcaacagtgcctaggagcggcagcacgggaaggggtcgtggcgtggagtagctagaaggaggcgaacggatggtcggcgacgaagtccaccaacttcggcggcggcgagtagtaatcgtcgcacaacgtgaacccgagatcatcgtcggactcctgcccacggcggcggagctagaggttgttgttgttgtagaggtgccttctacagctggtggagcaccttgaagccgtcgtggcaggcgacgtggtggtagctgttggaatatatgtaaacttgtgttttctcctgagtttgttattttcagtcttagatactgtagcgcgtcagttttttcttcagtttcagagtctgttagtttgttgagttttctcagcaccggttggaatcagtagctccgcgccaaccactgcatgaaggagaccacgacggagttctcgtcgaggcggcggaacttgcgctccagcgcgatgtcgtcgatggcttccacccggactagctcggtccacctccacggagcgctcggcgacgccggactccgcctcctcgtcgccggccacgctcgtggactcgtggtccgtccggtcctctccatgtctcggcgtcgaagtggaactcctgcacggcgacgttgaggaggccaccgatgtactgcgcgaacccgtcctggatggccgccttgttttcgatgaaggagaacgtcccgccggtgacctcggcgatggtgtgcatcgccaccgcgtcgtggtccttgccgaagccaaacgtgtggaccggcgggaagcggtcaccactcgccaccgccgcagccgtcggtgcgcacgaaggacgacggcacgagcacgtcgtagttggcgtcgcggccgccacctcctcctgttccggcgccgctgcacaagtcggccagcgacgaccgggagccgccgcgcgtgtggctccagctccgccgccgtgtgccgctgcctctccgtcgcctggagagagaaaggagaggagaggagagagatgaagagaggggagatggggagagtggaggaagaagaggggtgaggatgacatatggggctcacatagaccccaccattctttaattaatttttctgtgaaactgatatgtgggtcccatgtgttttattattttttcggatcgaattgacatgtaggcgccacgtcaatgctacgtcagatgaagaccgagtcaaattagccacgtaggcgccacgtcagacaaaaccaccctcaaaaccgccgagggacctaatctgcaccggttttgatagttgagggaccgttgtatctggtttttcggttgagggatgaaaatcagattcgttggcaagttaagggacctacgatgaacttattccaacacgagaatgctccttctcggtcacacgggggatgggaaaaaattggtcgctcccccctcccccaatcacgtgtacaccagcagcttctctgggcttccaccacatgccccctgtccccacctgctacttatccacacacataatttcattgcaacaaatcacaaacatattttgcaaaccctctattaaaggaatttggtttattttttgttgcaccaaaaatatttcactatattcataatgtttcactatgtataaatctaatgttacagtgaactgaaatatttcattataacaaaaaatccacatattttggaaaccccctattaaaggaattcgttttattttttgttccatcaaaaaatgtttcacctagtgtacagctaaagaaagagccaaaaaaggatctttcgtgtataatcctgcataatctcgaatgttatcaattctggtacgtagaccaaataatacaatgcaagcaaaagtgggtagatttatggagatatggaaaagcatataagttatcacgcttgtatatccatcatttgagtctccaaaccatgccgtttggagaagagcaccaagtggggggagtgtggagtccccgaaagaggagctttctaaaggcaagagaaaagctccgatggagcccttggagctacagggaccaccaacccttcgcagcttagactctcacaatgtttcactatatataggtctaatgttgcagtgaactaaaatattccattgcaacaaaaaaaaccacatattttagaaaccccctattaagggaattcgttttattttttgttccaccgaaaaatgtttcacctagtgtacttataatgtttcactatgtatggatcaaatgttgcagtgaactgaaatattctttcgctatttgctgaaacattgtttttatataaggtgaaacaacacccgattttaacgagtgaaacattttcgatctacttaataaaacaattccgatatacctggtggaacatcatgcaacatttaaaaataattcaataataagctaaaaaaatttcgtcaaaatatatccatgtgtggtcttgttttgaagatttaattgcaacgaatttaatggtacaatcggattatgatttgaataagtaatttaataaaaaatcaatttaaagtaattttgcacgtaaatcgggacatcagcgtcttatttttctccaaaccaatcgggcgcccgacccgtagactcgtccactaaacacgatcgctttttggagttttggtgatctcgatttagaaaactttttcttaaacagaaaaaaatcaaaaaaaaaacgcaaaagaacacctgaatccgaaccaagcaagcactttaggcctattcagattgtagccaaaataaatcttaccaaattagcaagatggcaatattgccaaaattttagcagaatttcttatgtatttatcaaatttagcaacaaactaaacatagatattattttagtaactttaccaaaaatgatatgattgaaaatggcatcaatttgaacagcccctaagcacacgttgagcgcatgttctaaaatcgggattggcttggctactttctcaaattttgttaacacgttttacatatcgctacgatatgttttgtatgaaagttttcttacataaaaaatgattttaaaaataaaatatattttttttaataattaatactcaattaattatatgttaattatatttctcattttgagtgtggctgataaggtcatttttaacctctgcttataacatgggtcactaacacgcacccttaattcgtcagcgagattgcccagtaataatgaaccaatgggagataaaatcattaaacatctatatatcctctcgacaaaaaccacttttgtgcagatcatggcagccatttctgctggatgcatagtacaagttttggtctcagctggagctgggtggcagcgaagaaaggaagccctcttgccaagccatgaaaaattccttggctactactagtagtggtaagtactccagtgtaatactatgaaattgcatgttcagacagccagacatgatggctgctaagttgcttgcctcagtcacaaatcaaatgataccttccttgcctccctttccctccaaaattcccatttcttgcttcttcttcttcttcctcttctccttcaagtgcatggacgctgaattgctcactagaagaagaaagccaagaacctctcacacttccgatccatctccatcctctcctctctctctctctcacttgtgtagctgtgtgacttgctgagacatgggcaaacagccggcgggcggcagcgagccgaggagccgtgcccgtgcgtccggcactgcggcgccgacgacgcgggggccggcgccgcagacgcacgcgccgccgcaggagcgtcgccaagaagagatcgtccatggcgtacggcacgccgtggcgccgggcgacggtggcgccggtaccagcgcccgtccggaccgacgcactcgtttcgtgacccaagtaacggaagtgccgcaatcgccggttcacggcgacgccgtcgccggggaggaagccgccctggcgaggaggccagggaagaagccgtcctacctgcctgcgcggctgagaagggcggaggagggtagccatggccggacgccatggtcggcgcctgctggccacccagcaccgcccgccgccgtgccggaagaaccgcaggagccgcggttaggaccaccaggattaaagccggcgaagatcttagacacccataagagtatcgagcgcaccagcacgatcagagacgaggacgacggcgtcacctacccggccgaaccggcgccgccgggccgcaccttcccggccgcccggccaccacaagatgagcctgggttcgcaacggcggcgcgacatccgcgcacgtcgccggggacaccggcgctgccgggccgcagctctccgtcaccatggcggccgcacaatgagcctgggtcgtacgcatcgccatcgccatcgtcggaggcaccggcgcggacgccggccaagtcgccgatgctgcgccctcggaacgacaagaagaggcggccggtggcgttctgcttcaccgcgtgctgcatcctcttctggctgctggtcatcgccgttggcgccgccgtgctcgtcatcttcctcatctaccacccgcagtcgcccaggatgcgggtgacctccgccaccctgaacgccgggtacgtcgacgagctcggcatcgtcggcggcgcgcgcgcgctcaacgccgacctcaccgtcctcgccgccatctacaaccccaacaccaagctccacgtcgtgctccgctacatgcagctggacctctacttccagggcagcatgatcgggacgcaggcggtgtggccggcgccgctgcacgagggcccccgcggcagcgtgctccggagcgtccacctcgtcgtcagcgaggtcaccatgacgcaggaggacgtgtacgagtggcagaacgcaacgagcaagggcgggcccgtggtgctgcacctcgccggacgcttccgcgcgcggctcatcttcggccggtggttcaagttcaactactgggtctcgccgcagtgcacgctctggctcgacccgccgcccagcggcgcgctgcgtcgcgcgcggtgcagctgaccccgcgcgttcgtccccctgctgctgcgtcaatctgcttaatttctggtcgttttcatcagcctagaagagcaaactacaaactactggtctattatcttcgattagctattttttgattgaattaatttgaattcttctgcaatttttgctgctcgaatgggattatggaaccaaggatagagttaattagagatggcaagcaaagaatatttggctgctctacttgacaaaaatgtgcaagtttttccatgataaacttttgcaaatttaaacgttagtgattaccggtttaaggatcttgggaatcagcaaatgtcagttttgccttggagataaatccaggagccggtgaagccgtgaagtactcgaaacttaggctgaaatgaatagaatctatgtgatcacgatatcggtacattgaagacgcaatgcttcacaaggatggggttgatctgctcaagtgcatgaaacagaaagtctctaacattaggatgactgacaatatcatcttggacaatatttgccaaaaccttctgttacctgatgtgttacagagtgatttctctgctggattaatgagctagttttggaataggtggcaatgaaggaagctctctgttccttttcagaaaaatggaagtaagctcgcttgccaagccagcgaaaaattccttggctaccacctactagtcagtaccactaccactgtataagcaaggataccttccttctctccctttccctccaaaattctcatttcttctccttttccctccaaaattctcgcttcttcctcgtcccataaattcaaggacactgactagctactccgtttcgtgctcctttcacgtacgtgtgtggccttgccgagccatgggcaaccgcccgttggcgccacatgcgggcggcggcggcgagccgagacaccaagacgaatgcttccggcatggcgtcgcgccccgcgacgaagccgtggcagaagcacgcgccgccgcgacggccgtcctatgtgcctttgtggcagagaagggtggaggaggaggaggagaagaagaagcagcgtcacgccgcggcgccaccgcgcgcagccgcgccggaagaacagcagcaggcagagaagacgccggtagtggtgctagccggagaacggccagccaggactatcaccatcccgaagacaaccgtgcgcaccggcggcgcacccgggcgacggcgacggcgcagcacggccgctgacaccgagtctccactatcagatcaaaatgaagaggaagccgctggcgttctgccacatcctgttctacatccacgtattgcttctgatcatcgccgtctgcctggccaccgtcgccgtctccctcgcctaccaccccaagtcaccccggctgagagtgacctccgccaccctgaacgcagcggcgcacatcgacaaagcgcggcgacagcgcgcggcgggcgatcagcgccaacctcaccgtcctcgccgccatctccaaccccaacaccaagatcggcatcgtgctgcgctacgtgcggttcgacctctacttcgaggacagcgtggtcgccgcgcaggcggtgtggccggcgccagtgcaggtggcgcccggcggcagcgtgccccggagagtgcacctggtggtcagcagtgtgtccgtgacgcggcaggacgcggccttgtggcggaacgcgacggccaagggcggcaggccggtggcgctgcggctcgccggccggttccgcacgcagctcaacttcgaccggtggttcttcaggtacagatactgggtcaagccgcagtgcacgctctggctcgacccgccgccgagcggcgcactgcgacgctcgcggtgctgacccttttgctgctcatcgattgcatttcacgggtatattagaacgaattagggatatctggtagaatattggttgctctacttgacaaaatgtgtaaatatgaagtaaaacagagtatttgtatgcatcgaccaatgttccagagtaaatgtggctcggtaaactactgaagaatttcaagttagtcaaatccagtttaagaagtttggttgggatttcggaatcagaagatgtcaattctctgtggagataaatcccaagggttcatgcatgtactcaaaacttgtaagctgaaatgaacgaattttgagtatacctcctaatagatgaaaacaagaatactttgctctacttcagaatttctgcatatgttagaacaacaataatctaaaaatgataattgaatgaaatgctcaaccaccgaaagtacacataaccaatatgaccaaatagccatgcatgccagccaacgtcacaagtagatgcatgatctctgaagcgaccaaaattaaagcatttctatccaacatatgaaagattgacaagatcatcttgtaatatatttgccaaaactttttggtacctgatgtgacaacgggtttttgggtgaagccgatgtcaaaacttccagggatttgcttcattgcttgtcacattcacaggcacaagataccatcctcacatcctttcccttcagaaaattctgaggctcttgcagagttcagtacttgttgcctctgatgtcgttcccaatttcccatcattgatgactgaatccacattgccaccaccgccagcgtgttcgcaaggaaacatcttactggaaatcctgagcagcaactcaacggcagcctcctgctccaagagaatagcagtgagcagagcagcatgaggtggtggtggtgttctgggggctgaaacaggaccggataggcaacctcggcctagtgcagttgcaactcgtttggcagtggccacgcgcagctcaggcttggatggttgctgtggcagaccggtgctgattgatctctgatctcaagctcctgaaaagaaaaggacgagttcatgaaatatttgacccttcgttgcttaggcaaggttcctacaaagttattcctattcagttcttggagccaagataactgaggggatgatacatttcaaatccataccaaatttactgatagagacatgcataaaaatgctataaaaatgtggtttatgatccctgaaaaaaaatccaagtggtactcaaaacaggtaaatgaagtaattacgccgggaggtaaatgaagtaattacaaaaccaatgctcaacgtcactattaaaaaatcagatttaactttctttagcaaattctggtttatctaggctgcatctgtgtaaaaacctaaaactgaccactggacggtatacagataaaacattacaacctaagataatataaattaaacaaccctgacaaccttttttttcctttgttccatagaaggccttactaggaatctaagcaaagtgattaacagaataaacataaaatgtgcatgaagatagataaaaatactcaatttgtttgccgatagccagatatgattaacatcacacatgaaagagcctgtggagaagatatagaggcacttttactaagaatgcataagggtgacgcaatcgagattagtaatttgcagtggaaaagtataatcagaaacgcttcagttcaaatccttggcaaaattctaacctgtatcagagcaattgagaaggtatcatctagcatctctctgaaatccaagctagcttcttcatctctatgatattctttcagtttgctgcattcctatgccttgaacatttttgttgtaattgcatagatctccccatgtgtaagccatcaagcagcctattgtaagtcgcaatgtttggtacatatcctgcatccagcatttcatccaatacagcctccccctctttccttattccctgcctcccaaagccctgcacaatgatgctgtatgtaaagccatcagcctgaaaacctttctctttagcctgcagcctcagcctgtttgcgtccactgtcctcccagcttcacagagcgcctcaaaaatatagttacaagaaatggtatccggaactatctccgcagcaaccatcctccccatcatctggcatgctttgtccagcttcccctccttcatcaggcactccaaaaccgttacaccagcagggacacccaagcaggatacccaattcctttccagtatcaactccaccacttccactgctttctccacattccgaacacggcacagagactcaaccagatccaagcaatcaaacccttccggcaccactccatcgaccaaaaactcgatgaaaacctcggccgccttcagaggctccccaccacggcacaacccattgatcatgatctccatggatgcaaccgatagcccaaatccaagctgaagcatctcgcgtgcaaccttaatgccctccttgcaccttccttctctgaagaacccacgcatcagagtattgaaactcacaccagtcggtgaacagctccaacgtcgcatctcctgaaaccagcgcatcgcagcatcaacgccttcagcgcggcaggagctgttgatgagaatgttgaaggtgtagacatccggatggacgcggtgggtggaggtcatctcgccgtagaagcggacggtgtcttcgtggcggcggaggcgggcgagtgcgtggaggatgatgttgtagaattcggcggggagaggtgaatcagcggcgcggcggagggacgcgagggcgtcagacgcggcggggatgtcgccgcaggcggcgaagg

SEQ ID NO: 69448 - DNA, 20580 bp, Oryza sativa
  unsure (1)..(20580): unsure at all n locations
cggagcgaggggagtcggcgggattccgcgaggcgggaggcgagcagtgacgtgaggcggtggtcggggcggaaggccggggagtcggacgcggccgcgaggaggaggtggaggtcgagcgccgccaggcgcgggtggtgccgcgcgcggcggaggatgcggaggagcgcggccggggtggacgcgtgcaccgaggggagcgccgggagagggctcggcggcgagaggtgggagacggcgagcgggagaatgggcagggaggggtcgagcgggatggacgacgacgacgcggggctctcggcggcttgctcgacatcgatctccggcgagatgaggcgctggtgcttggagatgagagacgggagctttcgcgcgaggcggcgggaggcggccatccgccggccgccggcggcggactgcagaggcggaggcggaggggttggactgttcgcaggaggaagacgaagtggaaaagagcacaaggctttttactgtggaaggcccataaactgaagggagagagcccataagttctcttttgaaagattagcccaaatctgatgggttgaaatcggcccaaatatattaaaccatacttcctccgtcccataaaaaactaacctgcatcctaacactacaaatctagacatacctataatcttaaattcgttgtactagaatatgtcatatccagtactagattcatttttttaagacagagggagtacaagccaacaaggttcatcgtagtaaattattacacatgatctagcaacttggtagatagatacgatatagtataaaaaattgataattgaacgtccaagtgtaattacttggtaagtgggtgtattctaatacaaatacaatttattaattttttggtacaacaacttagcaaagtatatgttgttctggtaaatgagtgttagataatttttttcactgaatcaatatgctctcatatagcaatcttacaaatattaccttataatcttgaactcgaccataagaattaagttccacaaccaatttgcaccaacggtttggattttgttttcttcaccttctcaaatctcaaccgaaatataatatttttatacttagtaaaatttagttgactttcagttattagaataaaaatttaaatatgcttacacaaatttgcattagtataagtacgtaaaattgaatttgtatagaaaaatctcaaaataattatttgtcgcgtcacttctacttattgtatcaaaactggacccaccttgaaagttgttatgacttatacattcaattataaagttcttacgctaaattgcacccatctgccaagttgttgcactatgacgtttatttctcaagttgttgcaccaatttgcactcacctgccaagttgactcaccttgaatacattttactctatttgtcgtcaaatttaaacgaagaaatttgatatatgtaaatatagtataatcataatgtaattacattgtaacttgcatgtaactataatctaatttgtatataactttcaaaattctctaggtaacatgctattagtgtgaaacggaggtcatgggacctaatcttctcacataggcgccaactgtgattcttttcttcctcgcttgcacaaattctaaagcaaatctaatgtttaaaactttacgaagttgcatacgagttatattatagttacttaccagttacaatgtaattaattacattacgattgtattatatttacatctgtcaaaattttagaagaaaatttatcgacaaatgtataacaaaatctctggtttaatccaatttctcgcccaaacaaaatccgggtgaggatcgtctaccataatgtcattactattatagttactggtatgcgagttccaacctactattgccctatacattagtgcctgtaatgttagtgtcattccgataaaatgtgaaaaaaaaaactcatgagtcatgacctcgtataatcctcagttcctcaccggaaaagaaaattggaaatttgacagctacgcctgtcgattgtgataagtcataagtttaacgtagacacagactcagaacattctaatgatagtgacatatatgcatacagtttatacatggaccagccgactaggtaaactctcctcctcatttgagaggcttcacggcaattcacttcgccatcaatatcaggacagggtcgtcatacaagtacatacaaccaaccgaaatctgacctttgctacgcgaacacatctggacgtctggttgctggtcatagagtcatatactccgcctagatggctactcactccgtaaaaaaaaaaaagacaaaccttggtttccatatccaacgtttgaccgtccgtcttatttaaaaaaattatgaaaaaaattaaaaagataagttacgcataaagtattaatcatattttatcatctaacaacaataaaaatactaattattaaaaaatttcatataagatggacagtcaaacattggtacgaaaacctacggtttatttttttttttttacggagggagttgaaagcaccaggcggcagccagccacgcacgcgtcgcttcgcggggaagttggcttcctgtttggcggtcttggcctcgcgcgtcgcacgcacgcacgcaaacacagcaaactaatccaaacccgagagacacgagtggtagagtagtagacggcgcgtcgtccctggcaagtttgaaaaggtctttttctcgatatatatacgtatatactccctcggtttctatattaattaatattttggacaatgttaaggttaaacttttataactttaattatcaataactttaaaaatatttagtttaaaaaactataaatttgtcttttaaaacactataataaaaatatacatgcatttatttattgtatatattataataaaaaaataaggttaaaggtatatcttgtaaagcgtgtcattgtctaaagcgttaattaaaataaaaccggaggaagtatgccatcactccgtatgacatattgacacgtacgtttcgtccatctttgttcaaatgctatttttgttaaagccttgagacgagtactaggcaaatcagccaatctagaaactgtatttctggtagctaagccatcgagaaaaggatggcgcttttacgtacccattttcctttgtggaatgggtttcgcgttttgcaactcgtaagctaggctgtgtttagatcagtgcaaagtttgaattttggttgaaattagagatgatgtgactgaaaagttgtgtgtgtatgacaagttgatgtgatggaaaggactgaagtttggatccaaactttggatctaaacacaaccctagtattgccgtttgccgaacttttagtactccaacaaaataattaccatagtggacaatttgcaaattaggatggttcggcctaatttcttcctcgtcttcgtcttcaccccgcgcttccttctcctactaaccatttgacccctagtcctgcaacctggcaattagtcagcattaattaaccgatagagcaaggcagctaatgtgattagcaaaatgggccgtataaattaaggactgacgagatgtgtttggtgttacttaatccggtccagcacgtaatcctggggttcaaatccaattaacgtcaacaccaaaaaagcagcaataaaatacttccggctgcgccaacccggtgaagatgacgattcaggtgtatatcgatcagtatatatatgaatatatgatgatcaatttcgttcgaaatgaccgattggtttcccagctggctgctaaccttgattagcaggcaaacccttttggtttcttctgagttaagtatatatcatcatgttaatatatatcatatcgccactagctagcgtacaaatacattgcgaattcacatatattgatatatatagccagtggatagcttgtcgatatcattcattattgtagaactaccactttgtgttttataattaatgaggtgtatatcaaggaaaatgccaaccactttaccggtttattactaacacgacttgataaatccgttgtcgttgaagactgcataacacatatagtcttcaacgaaatctggccggtggtggtggaggtggtgcaagcgggcagtcccgcgaatctacttatttattttcctttagagtggactagtgtgttgtaggtaaagtcaattatatattcttcacttgcaaagtatcaaatgggatgtagcccaatggatggttaatctcaagtagtttttgtttaatttagagtattgagcaaattattacgtacagtgctggctatcgactttattatacggataaactatatttttaaaacataaacataatacataactttttaaaataagtggtttaagtaatgcagtagaagaaaatttttttaaagcacggaacgagtatccggtgattgaataaggtaaaaagaaaaggccttaagtgtgatataatggctggagaattttttggataacatgcatatatagccgatgcacctgtaaaaataaaactaagttagtgtatcgtagccttaagaaactctttatttaaggcccattcaacgattcaaatgacatcaaactaaacatttaagcataccttatctatcgtaatttagtccactgcacttggtacatattttaatttagtacaatcggccaacttgccatggaacgttgaagtaatcattatattaggcggttaattatttgcttggaccaatagttagtggtagcatgtggccatttgcaataacttgaagaagttcttgagattaggttcttaaatatgtttttttataataatggacaggttcttaaatatgtaattcctcaacatatatgaccactcaaatgcgtttattgacacttactgaaacgtgtattacaattgatgtgtaatgtgatccaattgtattggctcgtcagcaaggcaatctaagcaattcactacatacacatattacatgtgtgtatatatttataaatcttaaatgacatattagctaagaatatctttgtgcatatcctagtgcagttgtgacattctaattcaattaggatgcggcctatgtagcacatgagtgacatgtgcacttgattagtactacattgcttgctagttgagaaaaagtggaaccaacgagtcgctccaaccataccacttatgggttaattcttatacacagagaacgaaagtgtaagcagggtactatgtataagtgggtccgtctatcggatggtttgagctacacggttctataggatggacggttacaacaactgaaatattcatttcattatttaaaaaaatgctacatctatcaattaggttgtgaagtggtattggcacggaatttttattaaaaaaacttctataactatcaattaggttgtgaagtggtatatgcacaaaattgagtgatagatttagcttttttgtgcggggttttgaatgaattatctccccaaggcttcaacaaggtacctcatgtgtatcaaatacataacatcataaggtaaatttacagaccatgtcttggggttctaaagaaatgatgccaaatcaaatatattataacatcatgccaagaacatcttaaatataaaaaaaaatggcggatgaggaatttgtacaaaccatgacattgactaattataaccataaaaagcctacatacggagtctatctaaaatataacaagactgcaattgtttctgaataaattattgctcactactttttattgagatatttgaggaaaacgtaacaaagttgacaactttatcaataaccgcgatcccacaaacaatatgacatatatttatatgaagtcattctttttcgattacatccactgaattaccacgaccacactttctaaaacatcttaaatgatgtgatttttttattaaaaaacttcatcattatttcttagaaaaccttttagaatcattttattaactttctaatatttgtatttgattatttgtacccttgaataatagtcataaactcagtttcatccaacatccattaatatttttaatagactatgagggaagttacagttttccaataaaaccatgtgctacattgcaataatctgaaagcaaattttcacttcaacactgtgttagaaagtttgtggcactagaggtattatgatctattcaaagattttctctctttaattataccgaaagtgtgtccaacaaattattatttttttaaggtgtctttcaatattgacacgtttttatgatgtataccagtaaaatatacagattttaaatgcaccatagcaaaatttatctaatctaaaatactatatctagagtcacaacatattctaatagtttagccaaaacaattgtagtaaaacgttactcactccgttctaaaatataagtatttttggacttcggtatagtcttcgatatgctactttgaccaacaatatctgtaaaaataagattttttttaaaaaaataaaaagagttgcatattatgatagtttttttaataataaatctagtaatattttttttattaatagttaaagttaaaaatggttgactaaacactacataaaaatcattatattttaggatggagggagtatgaattttacggttttttacgcgtagtagtgattagaagactacaaacattccattcaagcccgagcaacctctattaacacttttcctagctaatctattaagatcacggttacctctgcggcccgcccacctggtgataaaatgtgtacaatgtcagcatcacatggctcccacaaaagtcatttgccttttaatgagtgcccatggtatgtccaattccccatcattggattcccagtccaataaatccaacacttcaagttttcaactgccaccaaaaaaaattcctaacatgcccccctgttcttttcaattttttcttgatttttgtcctagattatttgctttacggttttttaaaaaaatttcttcataaaatttcttcgcggcaatgtataggccactttttataagttgtttgtgaattttattttttataaaatactaatttaccatgttaataaaatataaataatatgttctagcaatccactcaaaaaatttcaaacaggccctgaaacagattcccaatgctattgtacgttaaacgcggtgaagttaaacctgggtgaagttttcccgcacgtgaggagtttgacgaggaaaaactccaactccaatccaaatgcggtgtggaccgtgtggtgattggatcgaacacgcgttgtatatataccggagtaaatccaaactactgtctttccttccttgcacagttgcacccgtgaggccgtggcactgcagaagcagccaaaccaccaccagctcacgcctcccaagtcccaagcggcgacgcaacgcgaaggaaggagccccgaagcctcgccgcgcctctcccgaaaaataaaccgcaaaggcggcgccgcgagcggttgcgttgcgtactcaccttggtcgtcgtcgtcgttcccccgccgcctccgcgtcgcgcacgaggagatatacgccccccgcgtcgcgggcttggttgatcgatcgatcggttggttggttggttttgttggatttttttccttggtcgatctagttgagatgggagggggccagtcgaggagcccgcgggacgggagcggccacgggaggtacggccactcgccgtcgttccagcagcagtggggcggtggcggtggcggcggcggcggcggcggcggtgggtatccctatgggcaggatgcgcatggaggaggctactacggcgcgccggcgccgcaagggggatacgcggcgccgtacccggcttatcagcagccgccgccgccgatgccgtccccagcggcgacgcagccgccggcccgggcggggggcgcgtccaagccgcgcctcgaccgccgctactcgcggatcgccgacgactaccactccgtggatcaggtatctgcccgagcatcatatcctgcggttctgtagattcgtgtggaatttggatattcgatcctgcttttcggagcatcggatttggttgattcgaacccgctcgtgtaggcctttctcccttaatcgcggttttttgtttttccatcttaggattgttagcgaatcgctcgttaccgatttgcacttcatagttggtcaatctgtagctgtagccacttgaaacttcagattaggatgatctgtagtggtggatcgaattgatgtttgtgcaaaaatcagaaggagacgactcgttaagcctgctggtcaactgccaatcactgttgatgaagaattaaaaaaaaatgtttgttgtgaggttgggcattattggcggctccagctttcggccaaccatcattattggttgtagttggtctcttttgcttggtcttctcaattctcaaagatcttatgagtacgcaaattagcattaatcaattgagtctggcctctgtacttcctgaatgctccttgcctcaatgtccaaaatgcggcaattggaggatgtttatttttattggtgggataaactggtccaccagtttaatgtttcacacttccaattttctgcttacattactaactccatgtctaagttttctgaatgttttttttttattttttgcgtagcacattacgctattgttcacaattagttgtttatcggtaaaagttgtttcatatgttgtatttaaacttttctaacatttctgtattctggcctcataaccattagtataagaatcaggcacataagcaaacaatccagtttctattgtgttgctattattcccatgaattggtttgctcaggattaatattaattgcaggttactgatgcactagctcaagcaggacttgagtcttcgaatcttattgttggcattgatttcacaaagagcaatgaatggttaggttagtactaacaaatcgttgtttggtttattttcttatcagtcttttgtgttgcattgccccttgatgcttatggtttgttttcatttacaggaaaattttccttccatggacgcagtttacatcacattagcaatgcacctaatccgtatgaacaagcaatctcgatcattggacagacactgtcgaaatttgatgaagataacttgattccctgttttggatttggagatggtagcgattctattcattagctgaccatttctcgcactatattataatttgtccaatcataattcaactgggtgtgttttttcagcaacaacacatgaccaagacgtcttctgtttttatcctgatttgagaccttgcaatggattctcagaagctctaagccggtacagggaacttgttccacacttgcgcttagctggtaagctgatgttgcccagtgatgcctcttatgctggttctatactgttaattcatacttggaatgttgttttttgaacaggaccaacatcctttgcaccaatcattgagatggcaatgaccatcgtggaacaaagtggcgggcagtaccatgttctgttgataattgctgatgggcaggtactgtgtaaaacacacaaagggaaatattttttttgttaaataaaacattcatgctgaaattttgttttccccatatgaatcgttgttttcagttcactattttaaagctttgaatgacaaaacatgtttttcatatatggagtttcacgtgctgggatcggtggactgttgaatttgaggattagaaatggcatgttctatgtccacttgtgttccatctgaagcatgttgtaatgtcatttgatactctgtcctacatgatccttagtcgagcaattttttatttgaggttattcttagtttgaagcttgttctacatgttggaccaacctaacgactagacattcattttctttataccttattagctgtcatattatcacaggttacaaggagtgtagacactgcatctgggcagctgagttcacaagagcaaaagactgttgatgctattgtgagagctaggttcgtacttcataagttccttttttacattgttttgatatgctcataccgcctgtaactcccatgcattttgactcctgtttttgtggcgattactttatatgttcacatagtttgcgttgcctctgtcatggatgttgctgatgttttgctttctggttttcgtctgcagtgaattgccgttgtctattgtgctagtaggagttggtgatggcccttgggacatgatgaaagagtttgacgacaacattccttctcgtgcttttgacaattttcaagtaagtcactgagaaccctaatgaacccatgtaggcatgtttgtatatggtagatgaaatttttgttactccttactgaggatctattatctgtgtagtttgtgaatttttcggagatcatgaacaaaaacatgccccaatcaaggaaagaggcagcatttgcactttcagccttgatggagatacctcagcaatacaaagcaactgttgaattaggaattttagggtacgcccctaacacgttattactctaatgctttgatctgttgaattattgattcattctgtagtattctgactaaaattaatattgatgtggcatcagtcgtcgctctttcaagtcgcctgaaagggttcctctccctccccctggtggaagccatgatgcttactcgtatggatcaaaaagctttagtaaaccaagtacctacccacagagtagtacatcatcatcgtcatatcctcactatgaaactgcacagagttcgagccctgctgtaccttcttctacttatgacaatcaggtataccttcgcgtgcggtgacaacatgctatctgttgcttgtttcttaaggcaggcatttgcataattttgtgtcttaaataattctttttctcctgtaggtttgcccaatctgccttgtgaaccccaaagacatggcgtttggctgcggacaccaggtgagacattcaccctcttgctagattcagtgttttcttgcttcttgggggtgtcattttctgcttttgtgggcttgttgaaacgtcagcgtcagcatccttttctaacaaagtatataattttgcagacctgctgtgattgtgggcagagcctcgaatcgtgcccaatatgtcgcagtccaatctccacaagaataaagctatactagcaatggcagtttggatcatttgcgaatgggtggcatactggagaccaccttgtgtcacattgggcgatggattgtattggatgcttcaagtgcaatccatgcaaagcctttgaacggcttgcagacaagcccgttaagtactgggtttgcatcgacaaggatcgcaaggccagcaatccactgctccaagattgtggagcaggggatgtctcaagtattgaaacccactaggaatgatccgaactccagtgcaagaagtgggttgataaaatattctaacgaattgaagaaaagaaagaaaaggagaaatcctgatggatcgaacaggagtctgtctgattagtcgaacatttgtacatatcgcgatgttggtttcgtcaccgtggccgacataagttttagaggattcgttttccagtgccgtcttcatgcaagatttgtttgtttattcatgcgtttttgtaaagatttgcagttttcgtatatgattgaaagtgactttttttggtgccattttttctagtgaatttgtcccctgcttttgttctgatgccggcatacctgcaaattgcctcaactatgttacactggtatcatgccgtcctcggtaaaaataatatcgtgttcggcgtcaagtgtaataggttggcatagcttaacattggttaggtccaatgtgttcgtcaaagatgatataatccttacggaagaatgcaaagctgtaaacccgctaatcacagcgctgcgcttgcaatctcatccttaatggaagaatgcaaagctctaaacccggctgatcacagcacactgcacttgcaaatggtaatcgacggtgcaaatggtaatctccggcgtcgattgattacatgtccgcgaagaaatggtagacgctggcgttgtggacgatgagacggacggcggcggcggtggtgacgacgctgaggacggaggaggcgacgatgatgccccagtgccaaatcctgttccatctccctgcttcatccttccctttgatctgcacatcaccattccatccatccatccatccatcatgatcttgatagaattatagtgctatcaatttctcaacagaaatgtgtcgtcataccttgaggacgaccatgctggggaacatgaaggtgagagggaagaggacgaaggagccgaagaggttgacgaagtcgcccatgaaggggaagagcgcggtgacgaaggcgttggctccgaacacgagccccctcgccagcagccgcctcccgaggttgtaccgcgagaacatcccttcgtccagcctctgcatctgcgtgtccagcgcctcgtgtatcggcaccgtgaacagctgcgccacccgcacgcacgcacgcattaatccacggcaaattaaacgccctaccctaaagagctaaaattcaacttagttactctacaattttgttattagcatatttttcaaaccgttaaacaatattttttgtgaaaatatttttttaaaaaatgctttaaaaattaaataaatattttttaaatttttttagtgaataatactcaaccaatcttacacctttttcgttctacatcattatggcttcttttcatattatttgtcgaattgttaatatggattatttgctccacgtttctaaaatgtatcaatccgcttaaagcttaattaatttgttctaggctgagctctcacgccatcaacggggaggaggagaagaatgtggtatatgatatatgtacgtgctgcgagacgatgctctggaggaaggcggtggcgttgatgaggacggtggcccagctgggcccgctgagctggtcggggaggtactccgacacggcggcgccgtacgcccagtagccggccacgctgatcccgtagtacaccgccgccccggccgtgtactgcagcagcagcgcccgccgcatgttggacaccaccggcttccgcagcgtcgactgtatctccggcagcagcccggaggtgttgcacacgaggatggccgcgatggcgccgaacgcgccgaacaccttctctgcctgcgtcccgtggacattgtagtccttctgcttgttcgatttccctaaatgcgaaaccaaaaaaaacatataaatcctgttcgatcgatcagatgctgcatgaacatgtatgatcaaatcaaagattaatactccgatgttctctgctgagagtattattaggggtaaattagtaatttactaataccatgattaataatagtaataactataattaatttatgttactgtagtttagtcactgctaatgacaattatatctctccgcacatatttttcttagataataatatctcttcatgtttctattactaactaataaggtgataatgtaaatatgaaccatttgatcaaataagattaactgtttagattgttttctactattatagagcaccgcaacagagaatacttgagacatgtagtactatactgtagtgattagtgattaccgtctttgattaggatgacaatgagggcgacgtcgtaggcgacggtcagtgcggcggacgtggccagccagttcctcatggcggaaatggtcggcacgaagtaggcgaaggcgaagtagacgaatccggttgcagcgatgaaccactggagcctcgccggtgagtggctgctgctgaactccgcatgtatcgcctgcaggttgcagtgaaaaaaaaatgaataactaaatcggctaactaaactgcgagcttacaattggtcatagatagacagctaatcggatattcgatacaattaacagcaaattttgtaccttgagtgctcttccgcctagcagaatgaagcccatgtttccgagtatcagggtgatgaactgcaggaaccaagtgatgtagtacattttcctcccttcacaaaacaaacaaaaccgtgtaaattaacaaggttcgtcagctgcattttcagcctccagctaacttaatcatctattcatctcactaattaatcaacccaatttctctgacatgaaacgcaccgaagacgaagcccatgaggtccctgtagcggatgaacctctggccgtcgatgacatggaggccggcgaggagccaattggcgtaccaggaggcggcgccgatgaacagcaggcaggcgatgccccacccccaacccagcggcgccatcatcaggttggagaagctcagcacgtaggcgcagttgaaccccaccaccagcagcacccctacctgctgccatgaatctgcatgcacatgtgtacatgtccaacgattaaactaaaaccgatcaataattaacaattcaatatatgtgtcaagaatgcgtggatcctgatgcttcttgttgctataaatcgaacggataagatcaagaattgctggtttgttcatcgatcaccatggatatgcttgcacctgtgtctatttgatgagcagtggctgcagtggtgtagctgccgctgccggccttgtcttgttggcctgcagctgctgcctcggcgtcgagcgatgaagcagccatttcatatgcaatcaaactgatacatacacactctctcacacacgcacacttcatacatatatatatagaaggggatcaatggaaagcatgaatgatcagccgaatttggtagtgatggagagacatgcaaattaaagaaattaaaaaggtggaaggaaacatgagctgaattcgacggcattgtagctcggtcgcatatgcacccgtggctcgcactagctgtagccgctgtgccgctctctctctctaaaagaaagaagcattagctgccgttgtgacgtcgtctgctgttgtgaacaaatataaggacttctatcacttaaatttattccaaactaaaatatataagaatttctatgaaatacttaatttgtcccatattaattacggcatgagttagtttaatagctggctatcacagtacattcaccaatttaaacagaggcataaacggattttttgtttgcttcttgcatgattgccttaaccggatggatgaagggtggttaggtggttgttctcatatgctgtaccggagtttcggtcggcgtcagggcctcacaggaatagcggctttttcctgggcgtcaggcgatcgaaaacggccggaaaaccaatactgtcgtgtgaggtagctaggctgttacatgaggatgatgtgacgctacgtggtgtgtggccgactgagttttccttttccttttgtgcggattaataaacagactacagtctggtgatatacgtatacagtacagtatacgtagtagcagggtagtagcaggcaagtaggtttgctgtcgcaacagtgtgtcaactttgccattattaagggcgtccgtatatagtttcttttttgaaacccgttggagtattagataggagaaaaaacgtactgtatagtttcaccgcgaggtaatagcaacacgcatcaaagaaaagcgggttagcaaagcaagattcgtgcaatgtatagttattttctcgtggcactatgtggtccatgattgataatatataattttaaaaagtcgtacaatgtgaaaaaagtaaacggttttttctctcttcagttgtactaaacaaaaaattgaactcaggcctcttacgatctctcgtttttcctcttcagttgtaaacaattaaaaataatattattactaatttaaagcattggatcacaagagaagaacgattattttagctttttcgtataacccatgccgcccaatatatacggccggctggtaggaaaaagattttcttaattagtacctacaaaacacacattgtggattcttttagtagcatcatagtctttaaaatttgtatcgaaatgtaagtattcctagagttttgtctatcccatcaaccatctttatttatctttttactattgatcttaaatcatctatgcactcctaacaatctctcatttaatgaggaagcatcatagtctttactactcaatattaatagtgtttatattaataatcaaatttcattaaaattataaagatttggttgagtcgctgattgcttcaaaccaaacaaggtagacctgaagtagttcacaatatactagtctttgtactcgcgcattcacgcgactatggccatcctactataaatagtgtaagaaaatctattaataatattatattatttgagaacatgtaaaaaaatataaaatatatatagaaataattttcacgcatttgctacacacgtgagcatgctttttcatgcctttttttttctttatgttgatccaatcgctagaattttttaggttatgtggattatcatcatttcattttaggtgattttaactatcctgttaggagtggtgaatatgttctttagagaaaatagtgacgctcgttacccatttttatagtaaaattccacttactccacttactctcatagtaaaatttataaattacccattttaaatattaaaattcaatcaaatccaaataaaacagtgacatataaaattaaattaagatgaatttgaattttatgtaatattatagtaaattttattctatgttcagtaaagcacgtatatttagctcataattatatgaaatgaatagaactaaaacctgtatatagctgtatactcctactgtatcaatgagattgtccgcagacactaatatatggaatcagactcccgtatcagccactgctattacattggaagtactgtagaggaggtgtgtccttccgcatgttatgcatactgtcagttgagctatgaatatgatgtcttgaaatttcaaaatgtcaaggttttttggaacaaaaattatgaatacttacctaggggtgctttcataaataattttattttataggcgtgatattgagaaagaggcatgagtaagaagccacgaggcggtcgcaggcgcagctagctagagcggtgagctgttccatctctcatcctctcttttattcatcctctcaattcatttccttcgatcatctccattctccagcagcagctagctagctaggtgcatcatctgactccggcggcacctgcgtcgctgtctcttgctagtcgccagttttctgatgaggacatcccaatcatgactataccaagttcaactactgctacacatgatcaagtaatggaaggactgattacgcaaagtcgtgcgcagaaactacaacaacaggtgaactcactccttgctacatttgatgcatctatagatgagaatgttatactacctaaatgttctactttggttgcgcttaggattatgcaacaagaggaagctgaatcggaccatgaagatcaaaccgctacagtgaaaaacggaccagttcaacttcaaaacagaccagtttaagaaatcgtcataacttttgattctcaaaagctatgaaggtgaatgagcatttttttttggaaagcttattgagtctagtttcacacccaacaaaccgctcgtccattggatttcccactaaagagttatggccagattagtggacactgctccgaaggccaatagtctgccatgacatttaactttccatgcaaaactgtatcaatctataatatttcgtagtgcattatgcacatggtgtgaaagcttattaagttagctttccaacgcaactgaccccatgtcatttggactttccaataaggagtaacgacctttttttactgaaggctactcataagccaaacagacgcgcgagtcttctcggaaattcacttgttgaggcctttgggctagtctatgtccttctttcaagacttttcatacctatctaggagggttgttcctagtataaatattccttatgtgctttcagaaacaacttttgatgatttgataacctgaatgtttttttcagccaagctgcttgagtgtcttacacccctttgttcttgcgagttctttttggacttgtgaggaagatctctctgaggtcccctagttcgtgcaccacggcttctagtttggctgcaccgtattgtgtggattagttccgaattgtggttttgcggttgttcggagatcgagtcgaagttctcacggtttcggtgtctctctccccgtcgcttggtcgcatccaaccttagcagttataaagctagttacccactgtttctacaacaagttatccttggttttcaacctactgtcgtgaagatcgggccacccttcgcgagtgtgttcacatcattttctctctggattttctttctttcattgttgtatcttttttttttctttctcctaaaagcacattggctgtagctcgagatttgctggcatcgatatcaggatatatccgcgtgaggcagagcaaagcctgtgaggatcttcttcctctgcttttccttccatttccgcctatctctcacgctccgcctatctatctagctatcgggaggcgggaaccgtagtggatgcaatggtggaggaggtggtggaggcagactcagtggcatgatgaggaagatcaagccgcctccgccgcacttcaccggcctatcattgaagtcatcttgctcttgaagagtagcgcctggatcaggttctgagagtgaccatggaggatttttttttcctttgccgctcattttgttttccttcctgttcatgatcatgccatttgcccgtttcgcctcaaagcctcgtgaagaatttatgcagatttttttctctcatctaatggctacgatcgtctctctctattttgtccttttctgaatcggacgggtatacttggtgttgcttccgtggcccaaccatgttgcgtcttgggattagcttttcaattagagagattttccttaagagtaaatttcaagtagctgtagatattttgaaaaaaaaatcacaaaactatatatagttaaatttactataaatatcacaaagttacatatacagcatatcctttatcataaaattacatattataactgctccatcctaacattgttattctaatggaggcttaaaatctgtattttttttaataaatctaagatttaaaatatgtaggtttatgataaaactgatggtatatatgtgattttgtgatattataactaaaatctatcaacctgattgttttgcttacagctaaataagccgcaaaacaccatataagcaataaataataatttatatgtacaacttttatatttatattacatacagttaaaaaaacaattgctaaaattaaagtacaatgaaccaaccctccccccaccctaccaccaccacaaaaaaatgaactcagcatgtaagttttaaaatggtttatacgctgaaattcaagctccgaaatctttgtgataaatttagcactgaatgtgtggttttgtgatcaatttagcactaaatatatggttttgtgataaattttgcagggaaattgagttagataggcaaatatagcatgttctggctgtatccctgtaacacaacggaactatttcgttatccatgtcaaatcttcctaatgcgcaagggacggcaaaggaaaatcgataacataataacttttttttatgaacgaaacattgataccatagccggggaagatccctgtttgtgcagtagaatatgctttaaagccacaccgtatcttccgatatctcaccctctcattccaatccatccattatcttggtgcaaatcatatcatgtttccttttggaaaagcaaagtcaagaagaacggacgacgataactttaaagcttcctttgagctgccagaatggatgaggcgatttgattgatgcatgcaatttgacacaaacgttcgtcaatgatcgccggtttcgtgaaatttcaacaatgcaatgagccaatgatgcgttgaacctgattcatgtattcttgaccttctatcaaatagtagcacctcttacagttgaagattgatgaagccacataaggtttcttgtgctgaacactcatttgctagttttcttgtcccaattatctccaccacgcgttcgaaaaccttatctggaaacttgcggaagcgctcactgacactgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69449 - DNA, 804 bp, Oryza sativa
ccaactcgtacagtcaagaatctcatctataaaagtgttatagaaagtaatgtaaaacagtgtttacctccaacgctgacccaattactgtagaagaataggagttttttacactgtccagcccttcgacatgagatgagattacagaggataaccacaacagaaggccagagtcttttgttaaatgatgagccagaacgggaagttttacacacttctttagcacctaagttacaagggatattataaataaaaacaaaatatttgaaaattcgaagtagttactggattcttggaaggcaaaataaagtatacaaagccaaaatggataagtgaagcaaattacagtaaaaaatacacatcaagtgctgcatagtccatggcttccagtgtggtgtagcaggtaaattaatgtcaagcgacatgtcaaactcaaagtatcatatattgctaatttgttatgctcttatgttgttttgtgttttagactgcatgcagcaaacaagatactaagcatgaaaggtttactagatataaatggcagcaggctaactactaatgtgcatagtaatagtaataataataactactatagtgcaccatcttgaaatcggtttataacgagaaaattacagagttacctggagggttaaaagctttgtttcagaatctgaaacagccgaagaaccataggaaagagcaagctctaaaacacctcctcttttgtatatcttaacatcatctgctaggtttgatccagcatataacaactgaagcatccacaagcggtcagatttgaaatgc

SEQ ID NO: 69450 - DNA, 33441 bp, Oryza sativa
ttccacccaaaacaggtcctcagatatgttatttggaacaacagcatggaaatcctggcgtccattgttatcataattccttgcattcccaggtggcccatcagcaaaaacccagtctaacaccaatgccccttcaggtagagtaactatacatggagtaaagtaaggagtaagctacctgagtaatagactaaaaaagcaagaaaacaccaaagatccaaggcatgtaattcactcatgagagatacacatttattctaggaaacaaacatcagtaggtgtcttcaagtcatatacaatttccaagtcaacgaacttcttaatattgaattcgataacattttaactctttgcatttctaaattaagaaagctataccatgattaaatgtacatactatcatgttacgaatcatctctcaagagatgaaaagtgtgaaatagcataccatctgcataccaccaatcaccatccttttcatatgatttgattaatttttcagcaatagagagcccatcactccaattattgtaaccgccatgcatccaaatctcagtgttatgcattagcggtcttgagcttctgttgtagaacaatttgaccctatcccctgctttgtatgtgtgaggctctatataccatagattatcagcatatctgctggctgaatttaataaattttgcaacttattcttgttcatctcgacttcagcctttgcttgtgccctgtcagcctccattgcagccctttcttcctccttacgacgctcctcctcagcctgtcttttcctttcagcttcttctgcagcaagcctttcaagctctctttgtttttcttcaaccaagaagtcctcaaatgagtgttcattgatttcgctttctatttgtaggacgaaatcattatgattgttattttcgtagatggtgtcaccattaaagaatacaaaatctaatctgtaagcctgcttgggtatatggagtttgcagcaccaccaatcccctgttaactcacttttatgcattttttgggtaaattttttccatctccaaccattgaatgcccctttgataagaatatcaggctcactggctaaggctgacatgctatggttcaagtaaagatcaatgaccgaatccgcctgtactacttcaggaaaaacaaaacacttattcccagccaaataatttttctcagcaagctcttcaagccgcctcctgagcacttgtggatccacatcatcctgtactggtgctatatcaggttcatactgttcatccttgattatcctagggtcatcatcagcaaacagaactttctcagtttctctacttaatggttccctctcaatactcttgccagttatctcttctggtgcttcttcggtgacatcttgtccactaataatggttttctcttctgttggattttgtccactgacaccactacttggctggctttgttcgggaacagagacaattgatctatcttgctcatggaaactaactacagatttttcttgttcatgaaaaccaacaattgatctgtcctgtacatgagtgctagaaactgatgtaggttcaggtttcgaacttattagtgcacttattttaccacggtattcatcaagttttctgtcaattgcatcatcatccatagattcagaagacagttctggagactgattttgctcgacctcttcttcagtctcagcttcaaaagcatcatccattccctccaagaatacactgctcgatacatttccagagaagtccacctccgatgattcttctacattactagtttgctctgttgcttcactactgagcttcccattgcttgtgccaagatcaccttcatctgtgccgctttgtccaatcttcttcatgctggattcaacagtaggtctcggagcatatgttctagaggcagcacctttaggtttcggagtggaggctctccttgggtttctcttagaataatctgaacaatgcaatgtcaggaaaaaaaaaacatgatcaaagaagtaccacataaagacagttgtgctttgaacaaaaccattccaccaacctgcacttgccaccaagcatcggagaagccttgtccttgtaaatctcctgcaccttatgatcggctggggaaaaaaaaacagaaaatggtacatgtgtgtgagtgcagatcatttacctttcctgaactaatcgtacttaatacatgcatttcagtgaaaatatccctgaagcagaaccgcacaatccaaattcccacccaagctacaaaaatttccgacaatgttcaatgcgtggagcaaatcagcaaaattgtcataaagttcacttcagtcttcagatacacacaaagcctgaaatgaaccaaccgaccggaacaaattctactcctagaaagtagaaaccaatcaaaggaacggaacaaaacgcctcgaccacgcatggcctcatcttctaaagcggcatggcctctcagtggtagcaccaattaaatcagaacccggagaacacgaacaaggaggaggccaaaaccgacacagccgcacccaaacagctccagagacgcacctgcgcgaagccagtggcggccgtcgccgggcggacgacgagcaccggccggctccgggagcagagcgggctatgcgccatctccattgccagcgccaaaacctccctcctctccccctgatcccctcctcctccctccctctccctctccctcctcagagctgactcccttcccttctttttcttttctggtttccaaaaactcgcatcgaaatgcgcagctgtgtgctgtccgcagacacacacacgcgcgcacgctcgatcgaaggagaaagaaaggctcccgtgctttcccgtgaaattttcgcgatctttttcttttttattttctgcggcgagagggaggatttgtgcgggatttgtgtggacggtgtagggtgccgaggtggtggggccctgagcgcagggagacaggagcaaaaggctacaaatcccaaaggagggggccgcggggttgcaaacggccaaacctggcgcgtcagtgagtgggccagggggcgttgcaacggacggctgctcttggttgggggagatatggatggggacatcggatggatggcgagagccgtgtatgccttcgccgttccggtggatcggcatctctccctgctgggttctggaacattccatgttagatctcgccgactgcccagtttcaagcagtcacctgttaacgtctatactgactttaagatagctataacttttttttcagaatcaaaagtttgcccaagcaatttaacatttcgtctagaatataaaaatatgtagttgtagatttcagaagataaactagaaaccagattcatagaaactagctatcaactaactacttcttagaatattaaactcctaaacagacccttagtcagtgaaatctattaataatattgctgctacactgatctaggcttctagttgtagtgtattagtactacagtgctttaacaaaatcaagaatcagacacgtgatttccaccataagagcaagaagtgtcttaaagtatcactagtgttgtctcacaatccaagagcatgaatacattatgacatgaataacacaatcgagaaattaaacattcatcttttctacatatatgacaaatgcattagtacgttgtggtactacattgtcagattcattctgcttaactttttagacaaaagattaattttcattggcccagcttttaggagaaagccaaaagaattcatacagaagttcgtcctgcttattgtttagtaacactgaagttatatttgaagcaaacaaaagataagggaagaaagaaacgtatctgagttgcttctcagctctcacggtctcacctagtcagttctcgactcgtctaatgtccatgatgcatccagcagttgtgcctgaatcattgcttgtaaagatcttgattgattgatggcttatcctctcctaaaataacagcaaaggggggcaagctgttcttgtcctcatgttaggtccatctcctgcaagtccaaatggaagtaagacagaatagtagcagcaacaactcaggactcaaatacgtccaagttccagaatcattgtacagagaaaccgtcgacattgaacaagattgcttattgctgaagcgtgtatcaggttaactgtagaacgtaggccgtaaagtagcagttacatggaaacagattagttgagtgcataacaaattcagaagaaaaaaaaaacgtaactcaggaaacacaaactgtctgtcctttttcattgcagcataacaaatacccgattcatgcttagaagttcagtaaacagattgatggggagcatatggtcattggaagagttctatgagttagcaatactaattttgctgcctagaattccactttcattctgttagctgaaagactaagagaatgcaacagttctgccatattatttttcttttgtagtgtgaggccgtggaacataaataggtcttcaaattaatgagacaagataagaacatgagtgaagaaatttgatttcaggccaatctgcaaattacacatggcaatattaggccgtctaaagaccttcctgagtcctgacattgactagagaacgataataccctaacagtatagtcacaagacaatcatttgtgggctttctatgagttcttatgagctaaagaccagaacaaaaataaatgcacaaaaaacagtaggcaccattatactataagcattcaatcaccacatcagtattgttcatgggtttaaccacatcaggtggcccaaattcgaaagcactaacagactgaaacttgagatttgttcaaggtatcaccatacttgcagacagtaattgcaagcatcatgctaacatgactaattaactaagatgtgatataaactgagaagaaaataatgtcattaattacaaaaggcggataggcattaagcagctcctactagggaaatactcgaaggattgcgacatttgcacttcaacagaaaaacttttagcaattatgccaagatgtaaatgattcaacagcaacacaccatggaaatcaatgtcgaccagaccaattcataaatggatcagtaatatcagttgataatatgtaaaaccccactgcttactaaagcgatcaactataaacttaacaagatgcaaaagaaggaaacacaataaagaagcgaagtagaacgtaccatccgttcttaattgtcttaattagcagtaccctacgattcacctcactatacaaactaaatgaagaaagtagaaatggctggtccgaaaacgaatcatgttccaacaaaacagtggaacaccattatgtatacaagtcatagatggtatataacagcaatgcatgacataagcccaactcacatttctcagaagttggaacttgaaagcatcaaattgattgctatggatgacgacatcacgacactaatggctgcagttgaagatgctccatgttagtagtcaccgagaacaaatgaacctaatacatcagtcacagaaaaggcaatatcatcaaaaccaagcgagaatttggaaaacatcctgaatatgctcccaaccattcaatgtgaatttagcataagccactattgctgcaagtgaactgataacaagagtattttcacaatctgggcagaatgaagttctattaagagcatacgaaatgtaagagaaaaacatgaccaaagttaattcgaaggcagctctgactaatgattttggttactagcagttacaaccaagaaagcatactaagatttatgtcagataagagggtagttgccaaacaaatttacttactgtagacaaatagctttcaatttctgaagtaataccagctcctctttactttcacacggcaatgaaaaatacaacatgctatacccatagaaaaatcaagaacaaaatagcttcaattcacagagcattcaatagatcacagtaagagcatccagtcatattgcaactcttttctgtcactttcgtatttttttagcaaatcaaagcataagtattcttttttgtctttgttttcacatatcagtacaaccaaacaaggaaaaaaaaaatcataaaccacaaaactatcgaaacaagggagagctagatccccaaatctacaggtctatcgcagcaaatacatcacgatccgccctcctagtgagcggcgaccaccatgtccggcgagccgaggaactccatggccacctcgacgggcaggtccgggctcggcggcggcggcgcgaagagcatcaccctcttcgccgccgcgagcttcttccgctgggggcaccgcgggccgaggagcctcgatacgggcacgaagtacggcatcaccgcgccgccctcgccgtccccggccgcagcaggagggggagacgacgagggcgcggcgggggaaggcgaaggcgacgagggaggggcggggcgggagacggcggggttccggcgccggagcctggcgtcgcggaggcgggcgagggcgccggggcggaggaagcggtggtggtcgacgacgcccgcggcggcggcggccgacgaggaggagcggggcttgcgtgtggctgccatgtgggcccgaggtgtcagtgagagccggatgcgggaggcgcggattggtgggaggcggagggagcgggtgggggtatttgaaggggttagggttgggcggggacgcgcgagccttaggagggaaaaaggtttgtgccaaaaatgggatcgcgccttcgttgctggtgacgcgtttacactatgacgagtgggtcccgtatgtatgtgggtcccacatggcggtgggatagatggcgcgtgacgtggagggagtaaattggggggaccggttgctcacgttttgaaacgagcgggcggcggatggcgcgcgtgccgcgtgatcgatcgcgcgcctatcacggtaacccgaccgatcgtatgggccgggttcgttgaaagcgttggatcgcgagaagaaaaaagtccactttacatcccttacaaatggatcgagttttaataatataacttgaacgtaaaatcaggtatactgtgcaactcgagtaaaagtgcatcataggaattggatgcaagccttgtccacaattcaacagttcgactagaaatccatccacaattcaacagttcaaggaattggatgcaagccttgtccacaagtcaacagttcgactagaaatccatccacaattcaacagttcaagtagaagtgcatgatgttccataggccatatttgcataggaattgccgaattggatacaaagtgtgtctgcagcaatagtctaggataagaaaaacatttgagcgggcaacaaacagacggcatacttgatttgttctaaggatacaactgccggcacagtttgtttcacatataagaaagtagtgcataaaaaagggacctagaatacaaatgtggaccaaaactgcacaaaaacagtaacgaaaaggtgatcattacaatcttaaaatctggaaacaattgtgaacgatatctgaaagatggcaagttccacattataagctgaatcaaaaacatcaccggcatcccacatccatatttacattctttgaatcgaacacatcatcagatgaatccctcggcattctctggcttctttggagttttggtactgttcacatcagtagtggccgtgcagacaggaatcgttgcagggcttcctgggatatgggttttcgacaattcgctgtacgggttcctgtgcttttcacttttcgcggccatcgtgaaacttccaggtatatcggccttaggtaaatcagcctcctgatgcttatgctccttcccggttatttgggcattttcttgcgcatgggctgttgggattgcggcctcctgattttccagctcccgtttacccatttcaggtttttctggcatgttcttctttggtcgttcaccttcctgatgcttgccctcttgtacaaactctttagagcttataggagaatagtcctttgccggtttatcatcttgatgcttgtcatcctgctcagccaccaccatttcctttgattttgctccagcatcagttgcagtggttgcaaccttgctataggcatcggttacccatgctgcccctgtaaggatgtatctgttactcatgattgcagagccagcagtagagactgtctgttctgcagctgctaatgctgatttggtcttctctgcaacctggtatttctgatccatttctttcatcttctcatttaccactaaggtaccagtgctgaacttctggcttagacccatcttcctatcaagcgaggtaactttcgcagttgcggtggatgtgagctgatgcttttcatcaaaagacttggccctttcaagggcatccttcccaaggacaaatcctttggccaacatggaaacaacagcatcctccgccttccgaagtgcagattccatgccaccagcgttcttagactaacagttcaaagataataaagtctagttactgaaagcaatttgcgaaccaaaccagagatgcaaaaattccatagttctacctcaatatcagctaaaacggctgccggcagctgataattagtggccggtgttatgatgacagacatatccactatagtcgcaccctgcaccagaaaagtacagttttacatcatatagagagcacaaccaataagacaaattttgaatccatagcttcttattacattaagtcaattaggcaatgtataggtgctaaagcacaaaagcacatcattatcaattactggaagaaaagaccgttacatattaccgtgagaagcatagccctctctgctccttcgtcatcttcgaaggtgatgtaggcaaactgagaccgctcgtcaccactgaaaagcattgcaaaaaggttagagccatatatcctccttcgtgagctgtctttgaaggttagttgctctgtataaataataagagatgtcatgaaggacatagcactaacctttgcatttcaacatgtacgatgacaccggaaaaggaaaagaactccctgatatcttgttctgatgcttcaagtgagacattgtggacctttattgtgctaaccatgcttgctttcaaaaaagagcataaacagaaaggcactaatcagcacactggttagggttttccatttttagatgcctctctagttagaaaaccaggacggtgtagaatgaacttcctcttttagtaaacaaatgaattttatggatcaatcaatttgggaactttctcacagacacacaaccgagaaattaattttatgcaaaactatgttacttgtcagcaagcgttatcaatggatcatgtcttcatcaaataaggttgaaactcacccaatttcatgaaagtaatacatttgaatggtgcttaacaagtaaaagagggagtgccagtattacatgcattattgggtctcagtttctaacagcttttgaaaatggaacagtcaacatgtgctcatttctgtgaacaaaatatagtatggaagagacagacatatatgttaagactaaaagaagaatgaaacattaaaagatcttctaaattttataaactggcaaaatatatcatgatggagtggtaaaaaaaatgtgacatgccaaagatttatagtgcaggtaaggatactaccgatctatgcagcagacaaccttttttagatgcattagatgttagaaacttagaatcatggtattacattgtgcaaattgccaaaacaacatgcatcgggtagcacatcaggaataaataaatcaacatatactagaaaaaagaactttagacatccagaatttcagagtaccaatgctgtctcttttcctcacatgcgagaagctgcagcaataatattcagacaaacatcacaacgaccagaaagtatgagccctaaagaatgtctaaccatgcaaccaaatgagttccaacaaagaatcataggacgagagcacttcgatctcgaactcacacggcatcaggaacaacgggtggtaggttcctcacctcaaacgagaaattgtgcgctcgcctccacggacccaatccgatccgagcagcgctcgctccggactccaatcgctatctcgaactggggagagggagagggtcgacggaaacgggatccgttgcgcgcgcgcattttgccgccggtttcgtcggatcagagtggtggtgatgccgaaaccctggaggaggttggcaacgtggcgacgcgcaggggacccgatccaatgggccgtgggccttcttcttctcttgggccgcctcaaagcccaatgcctcgctcatcaagcacacgcttcctccggtggtcggcggcgagccgaggcggcggagggatgggtggggggatgatctgagcggcggcggaggacctggcgcggagccggccggtggcgctgtcgctgtacaggcggatcctgcgggcgctgaactcgccggagctgccgctggggcacgcggcgcggctggcgaagaaggcggagtgccgcgccatcttcgtcttcggcgccgaggagaggtcgctccacaacatccgcgacctcgtcgacgccgcgcgccacaccctcggcctcctccaccgcggccgcctcccttgagttgggagaagaagcaagctcgcgagctacagctatggtattattacgcgtctatttcagtgttttttttcttagccattctagattgtaagattcagttcgtccctgtgtgacatgaactgtgttggagtgaactagtatatgcccgattttagatttttctgctatgtatgtgtaccacgcataacatatctattccaaaccgaaaaacggttagcattatgaatttatttccactggagtcaatttgatgttgttcttagatttgagatgtaaagttctcgatggtacgaactgataaaaagaaaatttgaaacattcaagcactagcatagatagataatgtttccagattccttgcacaactcctaacaatttcatgcagccatagccttgctagacataggactacaagaaataggcggggacgttcgatttctgacagaccaatgaagctgcaacttcatatttacacctttgtgatccgaggtaacagcaattctctcagcaacattgttgatcgatattactaatactgtaccaagctatgaaaattatttactcttcatttctgtgaaataaataactgtcaccctgttaacgttgttacaacttgcaaaatggaatcttaaatgtaatgaggcttctaaataaaaagcagttctctgttcaatgtaacggaactgttctaaattacagattgagtggatttatggttccttacagaaggtatactcagtgaattcaagatgcatgcatgaggctacaggccaatcttgcacgtaaagcccagctttaagtgatttcaaagctttggttcacagttggttttgctgaaattattttggatgtagattttttttagccaagattatgttgatcttagtgatatatatttggtcaggacttaaacattcttagatatctcaaaatagaaatatcacaaatacctctacaattaccatcaactgattcatttttattccatctcatatatacacttataccatctcatagagactcatttttattccatctctaggctgcgttctttaccgctggttcccaacccatctctctcgtttttcgcgcgcacgattttcaaactgctaaacggtatgtttttttgcaaaaaaaagtttatatatgaaagttgcttaaaaaaatcaaattaatccattttttaaaaaaatagctaatactcaattaatcacgcgctaatggatcgctccgttttccgtacggagatgataggttcccaaccccaactaacataataatctgataaaattatacatttatacaacattttctagtgccaacctaaatttggccctgtacacaaattctcctatccagttgtccatcttgagcagatgattgcaacgcatccagtttttcctctttcttctgctcgcgtgcatctccattgtcacccctacttcttgttgcacatggttccttttctggagacgaatcaatagccgtaacgacttacgaaggccaagaatcaagatatgttgcagatcgtttcttgattatagcaccatgcagtaatatgcaggaacatcttttaacacaaacaaaaacatgcagacaaacaatggccattgagtactgcagcagcattgcagcatggggagaaggaagataaccatgaatggctaaaacagtaatttgactgaacactgctgcttctttatgtctatattatacatcataatggatctcacagtagcctatcaaatggaatcaatatcaccaggactacagtgagatacagaagcagcaatgctccagctggcccacaaaggccaacctgatctttttcttcagtactgtagtgcatacattacaagttaccctaaaacaagagaaatgaagcatggaaatactcttggaattattccttggattaaattctaggcttacaatgttttccctattcggtggtcgtggcaactctagatcttctgcttgagcacttgccggagctggaccttctggctctccatccgtgcctccatgagcttggatttcaggctgtgcttctgggatgtccgtgggtactccatgcagcccttgaagccccggttgaattgcatgctcattgaatccggggagctccattgccctatgctcggcgagctgaggcctatttcttgaatgccactgtcaatggtagaatgggtcccaacggatagccgaacattagatgatcttccattgatcgtctccacagcatctttcttgcagacgtcattgttctttggacgggacgacttccagagctttgataaggctgattctttcttcttgggttggttcatgtttgtcaggtatatatcagtcgaatcatccttcagtttctcagcttccttgtactcaaaatcgtttcggctcgtccaagagatgcttccatcacagatcttgttaactgacggttcacttccatccggtgaaccacttgaagcctgcatatcttcatggcttattgtctcccagctgctgccatcttcagtgtcactctcattctgagggcttttacttgagtacaccttggttggcttttccaggaatatatcagtcattgggctagcctcttggatttctgattcgcacatagcagagttgttcttgtagcatggctcaatctcctttatgacaggctcttcacttggacgcagctcttcaaaaatggaaaatatgtcttctgattgtgccggtggctcatatctgaattcaatatcttgtgctctaacagatttgatcgcctgtattatgttctctgcttcttccacaaccataatgtctcctctagcacaactgcatgcagcaataaaagcctcaacatcctgttgcagtttgctcaattgtgtgtatttggcatcaagagtaagttttgcatcaacaagcttcatctgcacccgttcttcacgccaaacctcagccatctgtagcatcttgcgctcctcatcaacctcctctcgcagcttgagggaatcatgtttcaaggcttcaatctcggctttgtcttcctccacctcccttgccagttcattgcacacctcctcagtgagctcgcgtgctttcctctcattatcatattcttgcagtagctgctttgctgacatcttggcttccttcaactcatgacaagcttcaagttaatcatctccaggcgtctcctgtttttcttctcatggtcaagatctgccttcatatcttcaagaattgcgcgcactttctcatgctctctactccgccaagctgccttttcctctgcaagttcttgaacaagtgatccagcttcttcttagccgcacgtcgctcggtttccagttcacttacccgatcacgtgcttgctggagctccatctggaggttagcaacataagttgcatcttgctgctcgttgagaagatttagttgactagctatcagataggcatcatgtgcttccattccctccaagctctctggctcccattttgttgccttctccatagcggtgactggtagcacagctgtagcagcatgaagcggtacctgcagaattaaatagatcagtgatcttacatgctggtgcagcaaaaagtatacagaggttttaacctcagtgcctcaccttatggagctctccactctttcgttccaaaacagaaattgggcttgaaatctcattcttaagggtttggtgatgaaccaaattattctgtttaataagctggacttgtagatgtcttgggatatgctgtcacaaaggcacatgcacaaataagttacaagaaaaatagatccaccagattttacagcaaatccatccagaattccagaaagcaggcccctcccccctagatatgtataaattcatgttactgtttaccactggggctattccatatataacaaaacagtgaattgtcatgggacgtcatccgaaacacagagaatccagaggggcccaaactatcatgacagatagacccctctaaaacagaaacatatgcactgaacctaaagtccaacctacatgaccacacttgtagcgttggtaacatcgatctcatttgttggctaggattccccatcagacctaaggttcaaagttcaaaaaccatttgatgtagctaggatagactccaattggatgagacaagaagctgtatggtcagctagtggctcacaagggaccacatagctgaacccagcttgcatatgtttgttgctgcacgggataagagttcaatcatttggctcatcggatccctcttaaaccaatcaacccaaccaagatccaaattccaaatcacacacttccaatgcaccattcatttccgtaaaacggagataagctactaccgttttcaccaacgaaatggcctaagccatacggacaattcatttgtagccatacgggcaattcgattgtactagttgcacgagcatggagaatccaatgactggggcccgaccaggttcacatgaggggatccgggagcaggaaatgcaactgccctttttggatcagtaaatttatgcgacaaggatcacggccatcgcccaatgggctcagcacggcagctctccataaatgtccatgcttctgagcgacgcatcctgcgcttacgacgaccactgaatgcgtcgatgctgagcgactgacactagtactgctaagcacttcaatgaggagaatggattaatggatttgactacggcagtcggcaggcgagtttaaggcagaaataagcagatgaagctagcaggcagatggtacatgctcctgcatggtgtaatgaagaaatcgcccagaaggcgaactccgaaatgttttgcgtgagatctgaacatctctgcaacaaatgagtgcgttttgacctggaatcttagcattttggtagtaatggattagtcaaaaaaaggataaacatgaccctagccaaagtttttgtttgttttttctttgattcaagctgaaatagcatgagaccggaacaaatccatcaaaaagcattgaaaatgcgcgctttcttagctggacttgactaggagattgacgaacgatacagcaaatcagctcagcgaaaaagcagacgaagcacgagcttctagtgagctcaccagcactgcaacgcatatttgttgggggaaaaaatcaaaaacgaaaaaggggaaagggtttaagcctccgtgcacgtacctcgaggccgacgtgaaccctcctcctctccccgctccccgcggcggcgcccccggccaccgcctccggcggccgcagccgccacactccagccgcgagcctcctcaccgacacatcccgcgccgcagccgccttctccgacgggccacctgccttctcgccgccgccaccccccttctccgcgccattccccacatcccacttgagcagcggcgtggcgggcccgctccgccgccccccaccgccaccgccaccgccaccggaccccgacgccgtcttcagcgggcgcctccgcagccttcgaggcgtccggacagcagacggcggcgccgccgcaggagcagcggcggcggcggcggagcggtgcttggagctcatctgcgacggagggtgcggctcgggtggagagcgcgctccggcggcatcggctcggagacaagacagggagagagacgcgcacgcagtggagctgaacagcagaggagagcggagaagcagggacgggagagagacgttgggggtggctggctacttggctagtgaggaggcgttgggaaacgggaggtaaattagagagagagagagggggtggtggtggggagaagtaaactagagaggggaggtgtggagtttttggggagtgtgtggagatagtggaaggacggatctgggcctggccgcggtttaacgtgggtaaggctgtgtttggttccatgttaaaataaaattggaagtttaaagaaattaaaataatgtgataaaaagttagaagtttatgtgtgtattaaagtttgatgtgacgaaaaaattagaatttaaacagagcctaaatggatggggagattttggatgcacgcacggctttgttttgttatcaactctcttgatgttgcaacaaaaaaaaactgtctacgatttttgggtgtgtgatctactgcagtacactataggttcaccaagaggctgtcatgtgagtttttcttaaaaataatccattgttctcatgtcaaaattgatcaatatttaagcatggtctcaaaatagcatatatgtgtttttacggatcagatcctctatagtaatgcataggggcactgtttatgtgaggagtacagtaatgcaatgcagtgaacaatgtcgattcattgtagcaacaataacgaaacacattgtatagcactattgagtattgcggtagatttactgtagcacgcacgatttggacggtctccattccccctaataccggatattgtaaatcctctccattacaacatgtaatgcagaggatcttgattcgtatttctacgttaacgtttctctacatctttacaaaatatctcaataaccactcctttataaaatgtagtacttatcttattacgagaacaacgagttactacttctccatcagaatgtgaaggaaaggaactatggctgtgtttagttccttccaaagttataaatttgggttgaaattggtatgatgtgactgaaaagttgcgtgtgtacgacaagttgatgtgatggaaaaagttggaagtttggatctacacagcatatgtgttggtacggtacatcttccgtggtggaaattcagacaacttttatgtgttggtacggtatggttacaaacttaaaaacacgttacgtcctctagtatttattgtgtgagaaaaaatatacgaagttaacaaaacaaaagcaaattaatcacataaaagaacatcaattaacttaggggacaaggtccaatctcagatgacgcctcctatatctctagaaagcgcaacagcacgtcacatgacatatcgccgtcaccggctcaccgccgcaggtccccctccaaaacggagggcaataacggaacagccctcacaccccgcacgtcgccgttgaagattgaagaacccatcatcaaatgatcaacaaaatcccaaatccaactgcttcgctaacctctccagatgaccacagatccgaacacacaccacacgttcgacaccacgacacacctccacgtggcggcatcccgcacgagcgccgcgctgtccggtgtccggactccggacgcgagcaccggccgagagccgcgcgggaaaaaggcatccgaggtcaggagcacgagggtacggggagaccccccgccacgtcggaccggacgggcccagggccccacccgtcagagaggacgacgtggctgcacgcggtggtgggccccacctgccgcccgcgtcagcatctcgtccttctccatccatcgcggccgcggggagcagtaaaaaaaaaaatgggtctcgccgggaggaagacgacgacgaggccgtgcgcccgtgtcgacgcaacgcacgcagcgctatgactttttctctttttttttttgacagcagcgcctgtgattcttctgcgagcgtaacagtggagggtgaattcaaaatttaaaccttgccgcaaaggtaaaaaacgcaaaccggcaaaaccccattgtgatctgtgaattcttcaactttttttctctgtgttcggagctctcctcttcagattctttccctggttcatgtggatggatccgattcatcacccatcaagcgtggagacagctcgttcgtaaacaataacgccgtgtctgtgataaggatctagcaggagagaatactatgccgcagcagtagtagcagcatccgagctttctcatcaagggggaagaaagaatacgatgtagcactagcagcagcgtgcagcatgcttgacccgacacacacatgaagatgagcatttttaactgcagatcctctcgtgctcgtgctgcgtggagtatgcatgtggcgtagtcgaatgctctacgggggtctaggctagtagtagaataattctctttgtatcaaaataaaccaatatcgtatcggatatgatacatcgttcaaattcatcgtataaaaatatgttacatctaatattatattggtttattttgaaacggagagattagtatagagcctgttcactttgatgtaaaaaaaaaccttttttggtaaagttgtcaaaatttcagtaggatttcttatatagttaccaaaatttaatagcaaactaaatgtagctattttttttataacttaactaaaatttggttagattgaaaatgtgaacatgcccatagatttgcctcgctggtcggctcggtgccgacttctgagctccgacgaagatcaggtaggtgtagttcaggtcaggtcgcatgattagtcttggagcggcgttttgctccgtaattatggctgcagatcgatcggtcaaggcgtaccgcgtacagtatgtactactcgtatagtctactgtagaagtaacatgctggtggttggcgatgccttgttaatcttgggggcacggtggttagatcatgattcggaaatggtagttgggcttgcagaggagacaaagcaattacatgtgtaaaggggagcgattttttcttgcaggtacaggaatgccttttcaactggtgtagtacgcattagtagctcggttgttgcgtattctttggattccccctatttatgttctgtattgtgttgctctcgacgctgcttgttctttgggcttaggattccccttaagtattttatgtttatcctgtattattattgcggagaagcaaagcttgaaacttcctggaaggagtacaaaaatctagaattcggcctgccttgatgtggctgagaacgttggcccaacttagcccaaacaaatttaactggctttggcccatacaggattcaaggtttttgggtcccacggaaaacgaactgaatgtatctctatctctgtcaaagttaaaaatatttctaccacaattttagtacgtcatccgtatttgagttagttataaatccatacttaatttgaatgtctaaaataactagtatatacttttagggaccacctattatgcagttaattgaaaaaaacgaaatcatcagttgattttggtatagcgttcaaatccaacggttgttgagtaaaacaacccaactcaactagctcaacctttctctctcccaccctaactcgaccgacccataccatcccatgcgtctccaatcgacgccacgtgcaccttctccgaccggcggtctttttctctcgctaatcctgaccctctccctctacttccaatctcatctcttttctttttttttctcttcgaaattcctcttctcataaatattttccttttgaatttatcattgtttaaaatgtgaaatgtagtaagtttgttacattgcaaatacctttccatctagagtaaaagaatgtttactaatgaataaacaaaatttcaacatttgattgacgaggtatagtaaaatgcgtcaacttatgtaatagacacttgattgatttgtgagattatagaaaagtgtacataagggattgttcgttccatgatgcatgaagcacgtgtaacccgcaatgctatacatggtttctaactttatttgctgttgttttatttgtctattttcgatttttatcaatcgtataagttatctcactggttaaaacgcatacatttttgctggttcgataaaaactgcgaaaaaaagagcagtggcgatcgagactcttcgaattcgttcgattccctccacgaaatttgcccaaaaaacagttctcccgccaaagcgtgaatcccccggccaaattttccccaccggatcttcatcctgcgaccgcggctcaatcccaatcccatgccgatcccctcctgcttcctctctcaaatctccctgccgcaaccctagcctcgccgccgccgccgccgcctccggctcgccggctcccccctcccccgcggatccaagctatccaccaaatccctccctcgccgtcgccggcggatggacttcactgccccttccttctccctcggctccgagttcgacgagccagaggaggcggtagggtatacggcgcccgatgccccgtccttctctctcggaatcgatttcgagggcgacggcgacgagtcccacctcaccgatgccggcaatggaggggaggagcagaagcgttatgaggctcccgatgcgccatccttctctgtcggcatcgattccggcagcgacggcggtgaggagcgccgccgggaggagcaacggcgaagttacgaggctcccgacgcgccctccttctccctcggtatcgactccgatggcgacggcggcgacgagccccacctcaccaacggaggccaccgggaggagcagcagcggcgttacgaggcgcccgacgcgccctctttctccctcggcatcgacttcggcgacggcgacgacgaaccccgcctccccaacgcaagccgccaagctccgcgctacgaggcgcccgatgcaccctccttctccctcgggttcgatgacgacgaagacgatgttctcatcggcggcagccgtcacgagctcgggactgtcgaggaggaggacgacgacttcgtcctcgccgacggccaacagcaacagcaacggcggcacgaaactgttgtccccgacccggcgccgccgccgccagagatgaatcgattcaagcggctgcggagaggccccgcgccgccatctcaagcgccaacaccacctcctcataggacaccagcgccggctacgatggaggcttctccggtggtgagctcgaaggccgtcttgggggatattgggagctttgaggatgagatcgaggatttcaccgacgaggagagattcatgcgaggtgagggaaccactgaccctactttcttgaatttttgtgcttacttatctttctaggcatttccgtttcttattctgaatctagtaatacacacgtacacactcctggtcaatgaatttgtaatttggcttcttcaaaaagctgaaggttagccaaattactggaaccagcacagcacacactagacatccaccaaaacttgcagtctgaaaaatagagagagtgatttctagcgatttggagtcacatgcctgttcatgtaacataagagtaatccagtagtcaaccataaaaccacacactcagtagatctccaaaataacactggtcagattacactgaagactgaacaacccgtagtacttcctcaatcttcagaactaacttcagacaagaaattagctgggatatcctcaaccaggcttgctgccatttcacaccaattatgccttcagatttgttgtatttgttgcttgattgcttgaaatcctattaatatatttttctggtatcgccccttgactagacattccaacatgtgctgtgtacatctgctggatgaggaacttatgccccttccaataccatcctgtttgttgtcagccaaagagcccaacaaagagctagcagcccgtataacataatagtttttttggctaactttttagcttcccatgtctcatctgttctttggaaaattcagaaatagagttaggaacactgcaaatttgccatagagcgctgaaacaaagaaaatgtggccagcagcacccaattatccacacaatttctattgtgattattcattcatcatgtatgtggtatatttgtctgcagctggctaatctctatattttacggaactttcttcatttccttgtgtggattgtggaacatgtaacaacttctctgcttgcagacgtaccgccgtctgttggtagctgcatcacttctagcagctcaaggttctctcatgccagcaattcaaagttctcgctgatgaaccatggtgtcctgatgagccaatcaacaagtaaatcaaagaaatttgcacaaacacctaattattctgcttcaaaatctatggaagaaagcagcaccaagaaactgctccctaagacagcattgagcccaatgaggaaaattcatttgcttgattcagatagtgactcggatgataacaaggaaatgcctggtttgcagcaaaactgcaaatccaaagtgagcactgttcaacataagggcaaggctgagatgaatgacagttgggcgacacctgctcttgatgagttctgcaatgagtatttcaaatccgtggaagactcgagaccatctcagcagaaagaaggcaacagtttttgtggccccaaagtcatacgttctaactactctgttagtgaaactggaggacattttccacatcaatccactccaagtggggctgtactagaggacaatcagacagatagtcatcctcctgcaatgcattattttttccaccatgaccagttggttcgtgacctggtccgtcaaagactcaagcattttgttcctgttggagtagacagcagaggaaatgagcaagatggaacacaaaatctccagtacaggtaattgcggttcacacatcaacaaattcacaatcatatcctgcagtcctctgtgcaatgtcttcgctgatcttggttactctgtttcatcatccttctacaggagtcagaccggccggtgtgctgctgaaaatgatcggtgggtgactccgaacaagaggatgcctgttgcaactcaagttggcagaagaagagtaaatcctgctggaatgtctggctctggccattggttgactggagacgatgggaagaaggtaaacctgcatgtttgttttcaacactctagttgatttcttgatggaaaaaaggctctgtcgcatatgcactgtttttcattatggaggccgacctgtttccccctgtattttggttacgtattcatcgttgtgctccattggatttgggctgcaggtctatatctccaaagatggccaggagttaactggaagggttgcttaccgacaataccaaagggtgatatgctcattcctttatgattaatttcaaagcattatccttgtttgcaccacactagtttcatacacaatattagcatattttgatttattttcaatttaagcatatagtggttacatatgcctagagttgcacaaatatatttagtttggaattcatagtgaacctggcatgaggatgttatttttactgcatggtggcatgccatctaatttaacaaatctgtgcggaacaggaaagtggcaagggatttcgccagtcgaagaagaaaagttcggctggaactagagcaaagaaagccactactaaggtgaaacaagagaaaactagagcaaaaagaaagcgctgaattcaagacgtgctggcctcgtattcacagacgaggtggtgccaatgtaattagtcaatgagaaatcatagtcattatttgttcaatccatttcataaggagttgttaaaaacatagagcagagtagaatgacatggtttatgtcggagaatataatcacataacaaagcttcaactgttcttctttgataaggtaatttgggtgactagttatttgttaacttgatcaggctttgctactattttacacgtcgtgctcgtggttctctcatagcactaatgcaggaacacaaggccttggggctttgaagctgttcactgctgggtgaaccttgattggcaaacgaggtctccatggagtcatggagagaagaaaacggtcagacaatagcggctgcgcagcctgggcattcgtgaccgtggctgatagctgcggcgcactggtgttggcctccctgtttcgcgcttaaggtgttgtttcttcactagatgagctgaattcgctaggatacgtagcagccaaactagtaggcctaaatgggccttaacatttatttcacaagaaaagcttcaactgcagctctccttggataaggtgatttgggtgacgattgacttgtactccctcttccctctgtccaaaaaaaaaaaaaataaacccaactataaaaaatttttatataagacggacagttaaagttggacatagaaacttagagtttatcttttttttttttggacggagaaagtacgtcgtacgcgtggttctctcctgttgccacactcaattgtttacttacccttgattagttgtttgtcgtgtcgtgtcgtgcccgtggttctctcctgttgctgcactccatgtctattgtttttaccctcggtcaattgtttgggaacccacggtatcgagctgttcgccagccgaatcgtaagttagtacagagctaatgcagacagcaaacatggttgcggaacatggccatcagcagttcagcactccccaacgttctcacgcgttctccaacccttctgccagagcaattctcacgcgtgcacgcgtcaggccttcgatttgtttatgttgtgcacttgtgcttgtgcgtgcggtgtgccggagtttcgccggccactctttccactccataaccataatctctccgttttgacagtccacccgcggaagggaaatgcctggaggcgcggctcgtgtgctggcctgcccagtggccgagtgcttccacgccgtgcgcttgcttccagtggccgagtggcctttgcctttgctatgatcaagatgagcgcaatgacgggacgtgcagctgcatcgttcccgcgccgcgcgtccaacggctaacgcctccaaccgccaacgaaatccagagtcctaactaatctcgcgcagggttcggttaccttacctgcactgagctgccgaccgattattggtagaccggccggaacaattcaagtccatatttaaattttaaattgcatgatctacagattccgtgcaacatatatgttgaggtggatctatagaaaaaaatgttatgcattacatcatctctactctctagtagtatcctctactttagagtccctaagagcacccgcaatggtaaagtaaggtgctctctataaaacatgtacatctcagcaatagactagataatagtaaactacttcaatagtatgtctacatgggtatctatagctctctaatgcattgcctcgtttttctctatagactatctccaggttagtagatagctgtgctctctctcttcatttaatctcttccaagtaggaaaatatgctgacatggatctcttgtagagagcctatatataaccattgtgggtgccttaacaatcaaatgggggttgcctccaattctttaaaaccttaaatatgccatcaactttagtagtagccctcatattttagctcctatttcttttcctcttttattttagcatataatttatgtttatatatagtttaacaccaaaagtttgaattttaagttttgaagtcaggaaggcggattattttttaacctgggtttatcggcagtgatcggctcgttatccgtggaaaccagtttttcaattcaaaatgttattatattcaaacttttgtccacaacaactggccaattaccggtattttttttcacggaacttcaccgtagcatggcaccacgggtccacgaccgtacatggcccgagtcgcgactcgcgagccccggcccccgcacatggcacaccaccctgcgcgcgcgtcatctttcgacggtgtcggtaaccagtgaccacgcgcgagccaacatccgccgcccacccgctcgtctgatcggccggtgtcccgtatgacgcgccgatgcttgcgtgcaccgtgcactgtgcgggcgggtgcatgtccatatcgatatcgagcatcaccaacaatctacttatcttattccaaaactaatttttcgagattttagttaaaaaaacagttccaatatatacctactctcctacccgaattttgagttcccttctctcgattcctcactctatttatatgcgggtgtgaaactcactcccaatcttgcactccgcctctctctctccagttaccgcgtgggagatagcgatccttacatgtgtgaaagaaaaaaatggaatattctattagtagtttgacagaagggcccatttttaagttttagacggttgaatttaggcggttggagggatgagtctttcactttttattttcagtttagaaaaccaaaaatacttttttttttggaatgtgatgctcaccaaagctggattgaaacggctctccatcaatggcctgagcgctaaattttgcgaggaagttttggcggatgggaaccggtcgataaaacagagacgatcatgctacccgatacaacgctgccacatgttagagcaggagtttgtcagtttttggctaaacgggcaggattaccggtttcaaccgatgtatttggtgtaaagagaacttttacggtacaatctcttagtatatactagtagtatatagaagacatgttatctatgatcgggatcagacatgctgtgaaagttaagctatcggaaatagaaaaagtctatacgtactaaatttttcttacaaaatgtttacaaactctgatatgtcaaactgtgagtaaatctagatttcttacaactttcatctagttaaatcaaacggttgagaaatttgttagtaaaagttttgtaagaaaattttagtacgtgtagcagtactctcggaaataagcaagtaactaatcaggatttgatcccaaggatcgtatctacagattacagaatctgtacgaattacgtataactgttaatacgaaacccttaacagcatcatcttccaaatgctacagtagtagtactacattatatgttcactcgccattattgcgttggaccttgcttgatcgcgcgttcgggaccttgattaatttgttctggtgtacccgagttcagtcggtactcggcagtgacgtggttgcagcaacgtgagaaatccaaactgcctcctctccagcggccgctcgcccgtccatctgctttgcccatcccaccccgagggaccgagagcgtgacaagcagggcaacctgctctcccagccgccaccaccatcaaagtggccggggcccgagccgcgcacggcgcagcgcacggttcgcccctcgtccgcgggacgctgaccgcgcgcgcgacatctaccgatccgcgcgggcgtcacggtgcgtgctgcccaaccgatcgtgcattcgcgctcctccccgctgtgcgctagcttcctctggccacaggccgcgcgcccgtcccccggccgtttctgccacaccccatcccaattcccaccccgcttcccctcgtgcagtcgcgtggccagtgcccggtgaaaacgttgcatacgcgacgcgacgctgctacttccaccgtgcctcccgcgggaggcccctcgctcgctcgtctgatccgccagcttcgtctcccggcgttgtgcggtgccaccctctcatgcgtgcgattccatcgatcgatcggtgcgccactgcgtgccggccagtggccgaacgagaaagtgagcaaccagccgaccgggcgcgctcgtttttttgcacaaggccgccgcccgtacgtacgtctacaccgctctaaccaagttggatcggaatggctccttcagtggccctctgcccctctcgctctaaatttcgcgagggggtttcgatggaaagggacccgggtcggccgagcaaaccgagacacgacgtgttacctgacgcgacggtgccacaagtttaaagttagctagaccaggtgtttgtagctaaacgggcactgcttagatacacgtgatccggatcgaggcagcccatcagggggctccaaatggcgtccatagaaggggcagatggaccatcgacaggtttccatcgttttcgaatccaaatgctactgaagaacttgttccccttcaccacaattgcggtggacctgacctgttattagcttgcggagttgtggtatcagtctctcttcgaactttccagattttcttcctctcggcaggtgatgtacgtgtgtcagtgtgtggtcctgacgggctgaattaatcccctaacaacggcatgcatgcatggattgatggatacgccattaaacactgaacatccgatactttgttttcgcatatttattatctgacagtgtcggcgctccgggttatacaagtttaccatgtcggagaatttaaggggagagcggttccattcttctctctcattctctcttcctcaatactaaggtgtgcttggtttgttactatgccaaaatattggtaaccaaaatctaggcaagtttttgtagtgtcaatattttggtaactttttgtgtgctattggtagcaaaccaaacactattaaaatactaatcaaagtgctaaacaatttggtagggcacattttggcttcaaaccaaaatgaccctaaaaatatggacagagtgaagtccggtgtcggttgttagggttgagttttggacaatctcactgtagtttttttgttggccaagcgacgattggtcacgtttagcaatgatcggtccagtgttagctttctcacgagtttaagtgttaacgatgttggcgcgtggggtggttattattttttttttctggttacgatctttcaggactgtagtcttgtaaatttttttattccctattaacttcgtatttcgtattgtcttgtgcgagtgggtgaaaaaaaggttgtttcattctagacaggccttaaacaccttagttggaattctacgatattacggcgccagcttcagaaaaaactgtagtatactgcagtcctacacagatgcacaacaaataattttccatgtttatggcatgtgactagtcaaagtcctaacatactagcagccacctagcaaagcaaaacatttctagtatgatctccctatagtcaaacaaagcccttggagccactgacagtgggctccacttcacaaatacaaactccctggattaaataagcaccaccttaaatacgtgtccatcaacaatcaaaaccaaccaacacgctgttcaactccagaacctcactaagtttctggcaaggtctaatcttaaaataaattttcttaatgggtcaatttatcaaaattgctgccagaaccttctctattagctctccacaaccacacaaagcttcgcgccacgacgctctctcgcctctctgctgctttagcgttcgcgcgcgcgcgctgcggctggctggctggaccaagctaatagctatggacaccgtcgtggcggccgcgacgacgggatcgagacggtggctgccgtgggcgcggcggcaggcggcggcgtacctggcggcggccgggggaggcgacgacgggtgggcggcgtgcgcggcgtcggcggtgcggatcgtggtgtgcttcgtgtccatgatggcgacgacggcggcgtgggcggtggtgatgctgctgctgctgccgtggccctgcgcgcgcatccggcagggcaacctctacggccacgtcaccggccgcatgctggtaaccaacgctgcgagaagccaaccgatgtttcttggactatacgaattcagcgaagctgaataaactttttttttttgcttgcagatgtggattctggggaatccgatcaagctggaagggatggagaacctgaacacgaggggaatcttcatctgcaaccacgcttcgccgctcgacatcttcctcgtcatgtggctggctccgaccggcactgtcggaatcgccaaaaaggaggtagatagaactgtatatacacagttgtgctagcatgcaagagagtgagaaaatcatctgcctagattgtactaataacgtggctgaaattgcaatttatgcagatcatctggtacccactgttcgggcagctctacgtgctggccaatcacctccgcatccaccgctctaaccctgccgctgcaatcgagtcaatgaaagaggtataattaagttcagtgatgtttacacactcctgttcatgtcgatgcatcattgtgcttgtgcatttgtgctgtttcgtagcatgctcatatttcttctgccctgctgttcccaggttgctcgtgcagttaccaagaacaacctatcactgatcctgttcccagaggacacacggtccaaaaccggaaggctactccccttcaagaaggtactacaataccaatacagattcagcaactcctcatcatcatcgtaatatcagctgaaaaactcaccgatgaatctcgatgcgtggcacgcaggggttcgtgcacacggccctgcagacgaggctgccgatcgtgccgatggtggtgaccggcacgcacctggcgtggaggaagaacagcctgcgggtcaggccggcgccgctcaccgtgaaggtgctgccgccgatcgagacggacgggtgggtggaggagaggatcgacgagtatgtggagatggtgcactcgctgtacgccgacagcctcccggactcgcagaagccgctcgagcctgtgaacaccgggaagaagaagatgagctaagttcacggttagttaacgcacacacggtgacaatgggtgtagttttgtgcatacgcgctgtgctgattgttgtatagattggtgtgtgcgtgatatacatgcttgatttggggatttgtagatgcaacagaaggttaaaaaaaggttattgattttgtgagcacatgaagcattgagcttgtatttgggtgccaatgctgtcttcagcccttctgcggatcatattttcgttcttttctttgctcgctctccaagcgaaacactatctaaagaaaacagagctaaagaccgatacaatgttgtactcattttctccgtgcctggattccctttatgtaatttgattatcccaagctgcagccttcgtttcttgaaattgtatggagatttttttttaatattatcaactaaaatacgatttagcacttaatacactaagcattcccattaccaaatgctccaagatcaataaagtttacccagtgaaaatgactaatgcaagagatagtgagcaataataatggatgtccttgtcacaaattaagagatcgattgcattgatgagctcggtacaggtatactcagccgtttatagaaggaagaaaaaaaaaggcacaatcaacctttacgatccaattgaggaccaggcgttcttttgattatatatgtatacacaggtcagttatgcagcaaataccaatgttaggttcgtattggcagatgcttgcttcaaaactgagagttggaaatctttccaggcatttatcgacctggattccctgaacctagcagcaaaagaagaaatgtcgcattaattcataactgcaaaataaatatcaacgcataatagaaatgatggataatagtgatatattaccacatcatcatatagagtcctgtagtgatgactgatgaaataaatcattatcccaatttctgttttgagttacgcaaacacaccaagtcctcctagcgtaaccgttcagtcagttggtcagttgattgccattgggctctgggaaattaaagaaccgtttcaacttcagcaaactgaagtttacgtctatttaagtatggaatgtctttcccactgaaataggccagacttctcaacatcaccaagtgacaacacaggaaaacctgaaagcccagcactgaagctgttagaaaacataaccaggaggctttggcaggcctgctcttcttctaggtgctctgcctcattgcgatgcatagcaggatccttccaaggttgataataatgcctgggagaataaacatggttagatcctgcagtacaaaaatatctaatcataagagaagcatagacaaatgtaaatgatgtggttttacacactagaggccataccatctccatgcaggattagcttcagccggacattgtatctgtgagcacagcatttcgatttgtccataatcgccaatgaagtttctgataactgctttaagaaggttaaaaaaaatacgagtgcaaagcattagcaagacgggcgcatgttagacctagaattgatagattaaaaattcaaatcacggtaaacataccttgtttattggatctgtcaagaagcaacaagcaaagagcagccaccacagatggcaaaaaatctcggttcattttcagatgtttttgcaggtacagtataattatagctagtgcctcatctgcactgtgactgccaacagtttcaaccttttcatcatatgtatagttcaagaaagattcaagagatccaaaattgttggcatcccttgtaaggtctccacacttttcatgagagatgcaggagattttcccaagaattatggaagccactaaccagcgcagcatcttagaaagtaggcactcgttttttagtggctcttcatgtggcattttcagtacagatctttgttcatcacacaaccagaagatgttagaagttgcccatgaaacaacagttgctgtcatcgacttatcctgccattgtcacaaaaaatataatttataaatcccattacacaaaatgcatatgaagacaaaaaagaaacatgttactgcaaattatattaattatgaggtccacattgttcatggcactgcacattctcagttattaacagtaccacatggttaggcaccaaaatatatacagtaaaatcttataaattccacatgaatcaa

SEQ ID NO: 69451 - DNA, 961 bp, Oryza sativa
  unsure (1)..(961): unsure at all n locations
ccccgaaattttttatttttgttttatttgtttgatatttttttcacgcttagggacacacaaaaaccaaccatagaaaaattgaactcaaatggacgtaatatatgacatgtagaatttttcctctcctctcctctctccgaactagtgcagaggagagagatgtgcaacttttttatttttattttatttttttgatattnttttcacacttaggaactcacaggaaccaaccatgtaaaaaataaactcaaacggacaaaatatgtggcacgtggaattttccaaagctccaccgaaaaacttctctcctcgaaaacacaatcttgcaagcggaatttggaggttttaatatcgccgaacccgacaaagcggggagaatcggatgtaactttttctgtagatgtccgtgcatatattatttgcctgattccgagtccgtatgaaaaagttacgcctattttaatagatgacatattttgtccgtttcggtagagttttagaaaattctgcatgtcacatattttatccgtttgagtttattttttatacggttggttcctatgttctcctaagtgtgaaaaaaatatcaaaaaaataaaataaaaataaaaaaattgcatctctatgtactgtttaacttatatatgtcatttcatgtggttatattttgaattagattaagtaatttcatatagtggtatagtgcattatgtttaacatgttgatcaaagagttttactaaaggagttatggtctaattttagtgaaggtgcaaagtagactaagtggtatgctagatattttcagacttagttaagtggtagttcgagtttaaatttttttgtggttggttgtatcgtgatcctgagtgtgaaaaaacatcaaaaaataaaataaaaatgacaccgttgcaactccatacagagaaacaggaatagaggcggcggcgccagccatg

SEQ ID NO: 69452 - DNA, 18042 bp, Oryza sativa
  unsure (1)..(18042): unsure at all n locations
tgcaggatgttttgggttggatgtgtctatggaagaaatgacgagagtagatttggcttcttctgccattctgctctagagtttctccgccaaaatggatcttctcctgtaagtgcaagatttgttccataagattaagcttttatttcgaaaatgggtgcaagagatctgcccctttgattatagtgtaggaaaagatttaagttttttgtaccatgccattttctccgttctcgtacttggccatgaactaatcacaatttatatgtaactcatcttaaaagaactaatgagtcaattttccagttctgttcatcacaaattgattccaagcagcagctagtttttgctatatcgctgaacgtttgaaccatcactgttcacagattttgtactgttaccttttttttttttttttgctttcacccttctcatacacaagtgctgtcattctgacaggatattatacattgtcatgattggtcacgtgctccagttgcttgtctattcaaggaacaatatgctcaaaatggactgtcaaatgggcgggttgtatttaccatccacaaccttgaatttggggcacatcacatcggcaaagcaatggcacgttgtgataaggctacaactgtgagtgacctggccgtgttctgtttttactatcgtgtttctttttcaaattcttcaagataccattttctatgtgaacgtatcactaatgtgtgcttctcattgtctgtttttaactgttttggccataacttgcaggtttcatatacgtattcaagggaagtgtcaggacatggtgctattgcccctcacttttccaaattccacggtattcgtaacggaattgatccagatatttgggatccatacagtgacaattttatcccggtatattaatcaccattcagtatattcattcatattccataactgtgcatttactatcttcttggatctgtaaagtgtataaagagtgcatgtctagttaagaagttgattatctgcagctaatttgattagtagcatacatatgcttatattcgctgttgatcaaatatccaattctttgatttagtagttgtacgggtatttgctcacttaacatttttttggggtgtttctttaaggtccactatacctctgagaatgttgttgagggcaagagtgctgccaaaaaggcattgcaacagaggcttggactacagcaaactgatacccctgttgttggaattatcagtcgtctgacagtccagaagggaattcaccttatcaaacatgcaatttatcgaactcttgaacgcaatgggcaggtctatatcttgctcatagatgccacactgtttgatgcatatgtttcttgccatctatctgttattctatttttcaatactgaaacacattggctttcttaaataggtggttttactaggctcagctccagatcatcgcatacaaggtgactttaccaacttagctagtaaactgcatggcgaataccatggtcgtgtaaagctttgtttaacctatgatgagccactatctcatttggtaagtttcacactctaccaatagcaacttatgttagaactggaaaactgatttatagttgtgtactaaatctatggttctactgtattgtagatttatgctggtgccgacttcatccttgttccttccatgtttgaaccttgtggtttaacccagcttactgctatgcgttatggatctatcccaatagttcggaaaactggaggtgcgttgtcatcttgatatctccctgacattgcattgccttttggtatttctagcatcgataaaagatacgccgagcattatgcaggcctttatgacaccgtttttgacgtcgacgatgataaggatcgagctcgagaacaaggtcttgagccaaacgggttcagtttcgaaggagctgacagcaacggtgtggattacgcccttgacaggtaagtataacccataggagttaacacaaattttaatgctacgacgttaataattcattcttttgctatccaatttcagagcgatcaccacatggtatgatgctcgcgattggttccactccctctgcaagagggtgatggagcaagattggacatggaaccgacctgctctggactatatggaattgtaccattccgctcgcaagaactgagacctttctagccccaagaacacatggattttgggaagtaggtttccccaggtttctgggacatgccggcatcccagtacataccctttctctgggtaccattctttagacagaaagaaaatgaggagaatccaatcccggcttctacattgatctccagcgtcagtaagagatcaattaatctttccgttatcctgcggttgtgagttcgccatcgtacggcgcccgtgcgtatgtgacatgcaggaagctcatcgtgcttaaagccagttttgcaaacatgtaccatgcaaatatgttccattttacgattctgcagtgtttcggatgtacatatgtaaggcagattagatttgtagggcggatgttctctctggtttattttctgctcactcggagaaggaatgaagtgcgagcagaatggcatgtgacggcctgtgtagctttttaatttctcgtgctgacatctcaaaattgatttcaaattggcagcgtgaaccaaaccatcaattgaatactctaaaagtttcaaagtttttaagccaatatcatccatgctcattatattactggcattattttgtatacaatcattagtcacacacatatcaaacacaaatccgtctctccatctgggttcacatgtatagatgataaatatacgtccacggttcacgttgtgcttcacttagcgtagccgatgctgacgccggcgacggtgaccgaatcgcagccacacctcggcacgatcgacacgacgatcgtcttgtcgccgtcggcgccgatgtcgtccagcaagtcgcatatgccgaacctcgcctccgtcttcctcggcgacagctgcccctcgcggtggatcccgtgcggcgccagcgcgacgctgccggcgcacgtcgccgcgcacgtcgccgcgccgtccccgctctcgggcgcgttcacgaacacgtcgaacttgacgtacgtggagtggtcggggatctcgacctcctcctcctcctccttctcctcgcggctcctcgacgccctgggcctcgtcacggccacccgcacggtcttgtccagggtcgccgggaacgcgccggccgcgggcgccggcgtgctggctgctcccgtggacggcttggcgttcagccacgggagacccacgtcctggtacgtgaagcgcagcgccgacgggtcgagggtgtcgcggacgcggacgcggacgaggcgggcctcctcgtcgtagaagaagaagctggcgtcgagccagtcggggtcggtgaagtcggtgtcgccggggaagaggaggccgcggcggatgtgccacatgcggtcgacgttgccgtggtgcgcgaagaacaccgggtcgcgcgccgcngagtagaagatgcccatgtcctcgccgttcggctgcctcgggtcgccggtccatctgtggacggggttgtgcggcacgctctcgacggtgcccgcccccggctccggctggtcgccggcgcggtacggctgccccatgaacagctccgccttcctagctcccgaaatcatctgaaacatcataaaattttgttcgtccaatcttaactcataagtcgattaatttggagtttttgtcatctattattatttatatcaaaatttgtatgtgattactggcctggcggtacatgatgttgaggttctgatcgatcagctggtctttcgggatgttcgtgtcggttccactgtagtcgaggtcgagcgggaacggtggcaggtgagcctggttgcgccgcgggtcgtacagcggcgaccacctgttggcgtacatcgcggggaacgacatgccgtccggcgcgtcccagttccagaacggcagcgcgaacgtctcgtcgccgatcagcttgcccagtatcctctcatggaagtacaggtacatcctgcacgtacgttcacacgcatgcgtccagcgttcacagaatctcatgagccactcaaataatcctctcatttttacatgtcaagtaaaaagtcatcaaaaaaattaaaaaaatatagcagtatagatcaatattacatcaatatataatatgttatttcacaaacatacaaattcaaattcaacttatacaagtagaaacaaaaataacaaatttaactgcgtaaatcacggtcaaatttgttgtttttgtttcgaattgtataagtcgaattttaactcgtatgtttgcgaaaaagatataccgtatattgatctatcttgacaaattttttaaattttttgataactttttgaatgacatgtacaaaataagaggaagtcgtaaaaaatccactccccatatatatcatgcatgcaactgtacacgaacaacgcgagacgtgaacgtgatgcagccatgttgtcacaatgtcacgtacctgtgccatgggaagaagagccagcagctgtgtatctggatctccaagccggggaagccgacctggtcgtacgcgccgtcgcagtaggcgcagtggacgcgccactgctgctcgaagctgcgggggtcgtcggcggggagcttcttcatgagcgacacggccctctcgtacttggccaggtacgccctgtccgccaggtgagccgccggccgcacgcggagcggcgaggacgccggcggcggcgcgaagtcgacggcgacggtgccggcgctgtacgtcgggcagcagttgatcgccggcgccgtggcggggacgtccacgggctggtggcagtcgccgaggtccggggcctggatgggcgccgcgagcgcgccgccgccgccctgcgtggccaccatggcggccgcgccgctgatgccgaggagcacgtcgcggcggtcgaccctgcaggacacgttccgcggcttccaccccttcgtcttgcggtgcaagagcaggttgttgtagcgaagggtactctggaggttggtgatgcacggcggcggcggcggcggcgccatgcgaggcgtagcggttgttcctggtgctacgttgatgctctccatggcggcactgcgctgtgaacttgcacttgcaaagttgcaatagcgtgtgtatttatagggcaatgtgtatactactatactgtagtagcccactggttgtttggtactttggtgtgaccgtttgcagggccgcgcactaacaatttgggagactgactattataaaataggatcttattcataaaaaatactaatcacacatattccctccatcccaaaatataagtatttttagactctaacaagatttccgagatgttactttaactaacaatatctataaaagtaggatgttttaaataaaaaggttatatattataataatttgtttaatgatacatctagtaacatcaattttatatgagtgatatttttttctattaatagttagagttgaaaatgtttgatctatcactatactaaaaatgcttatattctaagacgaagggagtaatgtaccaagactgtataattttttaatatattggaatgggtctctacactaccactgctctttgattaatcttcatgacaactagtggccctccaactatacattaggaaaactagtatcaatctaatgcttagctattgttgtagtaattaagtttctcactaaatagaaaattgagatatgattcttattacctggaaaacacattcttatcatagtcacggaatacagttcatcttatcatcgaacatttattggagcagagagaaaataattctttctactcgattcagtggaacagaaagaggaaatttgaaaaaacgaagtgaaattaaaagatcacatcgaaatatattaattaaaataggaacacacaccgatcaccttctactggtgtcgtgtcacactgtcactttgctacatctctacctagtgcacattagcaccacatataccaagtcaaacatatatccgtcacttaagcaatcccgttgagagatatcatgtcagctcgaagtagttcagagattaacctttcacccagcggctcgaaattgtcaagtgaaccagttaataactatgcacccgtcaacaacagtttcactgtcgttacgcaaatcggaaagctcccaaacgacctgacctacgagagcgttgggcgaaacactccatcatcctgtgcgtgaatcgtctgaatatacacgcaattcatccggccaactccgctacggaatcacggatatgcatggatgatggaggcagttcatcccaggtcaactaacccttgcctaaaacggccggagtttcagttcaggccgggcggcgtacgtcgtttggacgctgcaactagatgactgatgacttgtcggcgtcgttccgccgtccccggcgaaaaaaatggatggctgacaaaaactgcgacggtgaagaacgagcgaacgtcgttgatcatatcgggtcctttaccataataacaatatcattagagacactgatatgtgaaacaataggagagtaagacttattccctccgttctataatataagagatgtgacatatcctagcactatgaatctagacgggctctctatacagattcatgtattagaatgtgtcatactccttccgtttcaaaatgtttgacaccgttgactttttagtacatgtttaaccattcgtcttattcaaaaaattttaagtaattatttattcttttcatatcatttgatttattgttaaatatactttcatgtacacatataattttacatatttcacaaattttttgaataagacgaacggtcaaacatgtgctaaaaagtcaacgatgtcaaatattttaaaacggagggagtatttctttaaaatctcttatattatggaacgaaggaagtacataacagtcattgtaatgatagtgatattatgttagaggatcctcacccaatcagatcagatgtatgcgatgtgtcaaacacgtggcagcaacacttatagagctattttggtttgaagccgtaccaaaattttggtattgccaaatcttgggctagttttggcactaccaaaaattttggtagggctatgttgtttctaactctattgaattagtaagatttaacctcaatctaaatagctaacaagtactacaacactactaccaaataattggtagggcaagaattggttttaatccaaacatacctttaagttcttaaaggttgacataaacggggttggtgtgcagtgtgctctgcctcgttgccctgatggcttgtttgggcctcagactggtccttccacatgtataggccaggagattgaacttaaattttggcccatatacataaagagagaattacttatataccactagaatttgaccagttcccttatatgacacttaaaattggcttctctctagttcaagtttttccaaccttttatgcaactcccaccactatagtgttagttgactgttagtaaaggatagttttttttcgtaaatgaccaatatgccctctcaactaaaaaatgtgtaaacttcaaaaaatcataactaatttattttaaatcttttttgagtgaacaaaattttgtcagaactagtgaaaaatgctctttatattaaaaatattgttggaaaactgcatgattcatgcttacattgaaaatttatttgtgatggtaatggctaaaattgcatgtgatgcagaaaaaaatcaattttcatatgttgtatccagtagttatattagtactaaaatacctattattggttgtatactaattcttaagggcaattgcgtctttttacaatgaagttaacggtcaactgacggtggactgacggcaatagcataaaagggaggagaaacttgaaccgatggcataaaagggagaagtcaatttaaagtggcatataagaaaaccggttaatttagagtggcatataaggaattctctcatacataaatggtctgggagtgtggcccatccgaacgaggcctgactagcgaaaaggatagagcactgcagtcagcatagagaataagagagtgggcctagaattgctgctgaatggatcgagctgggccgagccaggtcatcgttgacactcctcgtgaacttaaggaaaaagtgtatttcaaatccttcaactatggtcgaatttaattcacatctctcaactgtaaaaccatatatatgttatcctctaaatttttaaaacggtgcaaataaaatcactcgacaatattatattgatccagttttttagttttcaataaaaaaagttagatgaaaccctcgtataagtctctcgaacaaaaataaagaaaaatagtagaaccttttttcctctccctccctccagtctctctccccttaattttctcaacacctcctagggggtggcattgagggacctaggggataagaggatatcattgccatggaaccgaggagatctgtctgacggtagaggtgggcattagggccaggatgatatcatgatagagatgggttcaggactccacaccttgggcactatagcagtgtgtcccagcctcatcaagaaacccaagtatcaacgtaggaaaaaaaatgatgctccgatatccatagttcgtgtagctttaggtgggcccaccaccattgttttaggttggccccaccacgaaaattactatcatcgtcatctccttcctggagcaacatctcccacacccacctccccaacctccgccgcttgttccccatttctctctcttgtcctctccctcacttggcttcccacgacggtgcctcccgccccctcctcctctccgtcctctcccatggcgacgactcccccgccccccctctcctcccaccggcgccgcttgggagaagacgcggcggcaccgggccctctccccttcctctccctagcggatctgttggcagcgagggtgatgacagcgagcgcctctccccttcctctccggacttctccctcggctatcccgagcccacgcggtggcgacggccttcctgagtctccagtcaatgccgccgtcagtcccctcctcaggtgacacagatcgggagctcggccgacggcagcttcctcgacagtggcatcatcgttctctactgctcaatggtggcggaaatattggaggagaggagctgaagcttcctacccctttccgaaggcgcgacatatatcttcttgcttttttttggcaatgctagctgaccgggaacaagtgtctctcttttaatgtgcgggctttaggtgagtagcatcagaggcaaacatggcaccgtatttttcaacgtttcatgctcgggctgaatgacaaatcggcgcaccgtaaacacccataagtagtaacaacggcgttttaggcatagggatgagcaggggagtggtcaacgctcccctacgagctgtgctgctgcttggtcgcgggtgctcggagtcagttccgttattatgggcggtcgctaaccaagtcacaacccccaccaccaccaccaccaccaccaccttgaagcagaagctgcacaccgtttagatcacgcaaaaattgaaagtttggttgaaattggaacgatgtgatgaaaaaattagaaatttatgtgtgtaaaaaagtttcgatgtaatggaaaaattaaaagtttgaaaaaaaagtttagaactaaacaaggcccaagtcgccggatctcactggagccgaatgggttcagtttcgaaggagctgacaacaatggcattacggctactccatcgaagtacgcccttgacaggcaagtacaacgttaaacattccttcattagccatccaatggcttttgtcctgctattgcaaattcgcgaccatgcgacgccccgtacggatggacatgctgattctgcccaaagttctgcgattctgcagtctcagatctactacatgttaccccttaaaaaaaagtggattaagtcttggatattcatgtcacgcttttcaaactattaaacggcacgttttctgtgaaaattttctatatgaaaattgttctaaaattttctatcagaataatccatttttcaagttcgcaataattaaaactcaattaatcacacgttattaccaactcgttttgtgtgaaacacttcattttcatctttatctttatcttcatattcaggggattcaaacaccacctctgtaactcaaagattagattctttggacgcaggcccggcttagagctacggcgaggagtgcgacggcctagggcccaacgtaagtaggggcccaagatcaggtaagtaagtacgaactggtatgccgtatacgtgcgtttacctttagaaactacatacgtatatactgcgagcaaatgcgtggcgattgtttgtggtgacggagcaaccgtgtccaactgatcacgtcattgctgcctccgtggaaacatgacctcacaaccttcagttttcaggtactattcttgagtgagtttgtattcaagtaagaagtaactaaggagtatgtctcttaactatctcatctgctcggtgaaaggccaaattaccacgagaacatactatgtttaggccctatgacaaggcttggctgtgtgctaagttgagaagaatgtgatggataatattaatctcattacattttttaaagattttgcatcaaaaatgtttaaaggagtgtatttttttcgtgagaagccatggatatttgtaatctctttatttgtgaggtattattgatagagtcgttagacagttagagtttgacctttattcaaggtattcatattagctccattttgatgttctttagttatatacagaagatgttcaatgtttatttcatcagaaaatatatggtttaaaaatatataaatagaaaacacatattaagagcctacaccatcaagctcgccctaaggcccttcaaattgtagagccggccctgtttggacggatgctctctttagcttatcttctacccatcttaagagcgtgcatgcctaatggcatgccatctgatctctgaagccttaattcctcgggttgttatctgaaaaaatgatttcaaattggcagcggttaccaaatcatcagttcatgcacgctgatgcacgcattatttttatacaatcatatcctataatactatataagtgatccttacttagtgtagttattagcaattctctttgttcttatgcttccacgtcaccaccctcttttctttcagccattcgatgttaattaagcgtctagcgtcacatgctaggaacgttgcacccaacgctacatgcattccgcacgcttgccgctgccgtcttcaattctatcagggaatgatacgttttctgccgcagctcgatgattaatgacatacgggtaactaatgtggccgaaactgccaaggatccaagtagtccaatacgatataagtgattgcactaccgttttccccaagaggagctcaaaagtcatgtctatcctataaaacagaagcatattcattcagggaaaggggttacaagttcaatcgattggatgttcctctcatcaccttgatcatcgttatccctaaaatcctaactaccaccggtgggcattgaggttgccatgcttgcaaagtctgggagcttcgctcaagttgcctcatgtagatcaacatcacatcgccgatcaatcaccggtcaaattgcaatttccttctgacttgggcagttgggggtacaaaattgaaggagataatctctgtaatcatattctatttatttctaccggatatatcaactttaccgatgtacaaatacatggtaacaatatccctttctgttgcattagtttatttttaaaagaaaaaaacaaaaggttgttatacatatattagctagattgttgtttgtcttcaccactatatatatgcagctaagtaaggccgacaacatcatttctgatcactatcggctaaatcgtccattcggtctggtcagataagacatgagaggtgctattttacaccgcggcccttttgttaattattattttacaatttttaagttggtttccttgcaaattatatattctcaatccattaatttgaactgtttgaactgagttttttatttgacaatcgattataacaaaagccagtactgatcgagaccaaattacatcatgtatagtttttatcattgatcaatcatcaacgatgtggaccatcaagtttttcattgagttttatgccttacactcaattggattcatacctactttgttatttggcttttcttttgtaatgatattaatttaatcctgtaaggcagttaaacaagatgttagcggtagttcaacacgatgttagcggcggttcaacaagttcacatctctaaaatgatttgtatatcccgcagcaacgcgcggggtatcattttttaatgacagacccacacgcgcctacaccattacacacgcaacatcacactcatacaatcattaatcacacgtcacacattgtacataaacgtattcttacgttcacgttgtacttcacttagcgtacgtagccgatgctgacgcccgagactctgaccgaatcgcagccggacctcggcacgatcgagacgacgatcgtcttgtggccgtcggcgccgatatcttcgagcaagtcggagatgccgaacctcgccaccgtctttctcggagaacgcttcctctcctcgcggtggaccccgtgtggcgtcagcgcgacgcgacgtcggcgttctcgggcgcgttcacgaacacgtcgaacttaacgtacgcggagtggtcggggacctcgatcccctcgatgacaggcgcctcctcctcggcgtccttctccttgcggctcctcgacgtcttgggcctcgtcaaggccacccgcacggtcttgtccagggtccccggcagggcgccggcgggtcccgtggacggcttggcgttcagccacggcagggggccaacgtcctggtacgtgtaccgcagcgcggcctcgtcgagggagtcgcggacgcgaacgcggactaggcgggcctcctcgtcgtagaacaggaaggtcgcgtcgagccagtcggggtcggtgaagtcggtgtcgcgggggaagaggccgtggcgaatgtaccacatgcggtcgacgttgccgtggtgcgcgaagaacaccgggtcgcgcgccgccgagtagaacatgcccatgtcctcgccgttcggctgcctcgggtcgccggtccagttgtggacggtgttgtgcagcacgaactcgacggtgcccgcccccggtttcggctggtcgccggcgctgtacggatgtcccatgaacagctctttcttcctagcccccgaaatcatctgatacatcataaattatactgttcatattagacacgcgatccaatttaaagtcgactaattaatttggagtttgctatctacggttttcagtagctacttcaattaattcctagtttgtgtcaaactgtgtatgtgattactggcctggcggtacatgatcttgaggttctgatcgatcagctgatcttccgggatggttgggtcgtgtggagattatggatatcccatatctacacggcgatgatatttggactgaatataggataccgaatatagatagaatatcttatgtgtatcctgggtttgtttcttaacttgtacatcaaggaaacaccttgagacttagtcggtcacgactgtattttatctgtatttacatattccgttagggatatagattatcttttgtaacacggactctttcccatatataaggggggtccgggtgcctctaggggcggaggttggattttctccaaatcatacaatcaataacacactcggcggattcatccccggacaggagtagggtattacttcttttgtaagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaatgggtttcgtctccggcatcgacgacctcgtcttcccgcccgggcagacgtttcggttcggcagcctcgacttcgtcaccaacaacttcggcaagatttctctcctcgactcggaatcagaccagtcgggagagaaccggatttcggtcccgtttggattcccgaacgcggctgaaagctacttcaagaccatctcaaccgagtcggcttcaaaccactcggccgagatcgcatcttctccaacgacaccagatcaagatgatggggcttacccaccagtcctgatgaagctccccgacgatttagcggccgtttccaccacgacaacgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacatcgtggagtacgacgaatttagttctcgctacaacgacttcgacgacttcgacggaagccttgatgacaactacacccctctctactttggcgttttcatggccaataatgagacggaggagcaacgccaagcctgggagaccgaagaacgtcgccgactggaggaggagcatcaagcacaagaacaagaacggctacggcgtgagcagcaggaccgtgagcggaccgcgaaggaggctgaggatcgacgtcagcgagctttggaagcagggcgccgagcgcgtgatctcatcgaccagcaagatgtcgaagggacaccggttttccgcacccctcaacagaatgcggttgccgcgatcacccttctcgacaccctcctcaaccaaaacgagctcaatcaatccgatcacgtcgtcaacatcttgaaccagacgaagaccatgattgcggcttcggtcccagttaactccgaaagcgtccacacgccgactggcagccgagtcccccacttccgatctcatgactaccgtcatccaagcctcagcatcaccggcgcgggatccaatcgcaggagcaggggtcacgacgagcggtccattcactcacctcccgaccaatatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagacaacaaggccatggcgaactatttaccagtggctttagcggattcggcccgatcttggctccatggattaccccgtggtacaattggatcttgggctgaattacgcgaccacttcatcgccaacttccaaggcacctttgagcgacccggcacacaatacgacctctacaacgttattcagaagtccggagaatctcttcgagattacatccggcgattttctgagcaacgtaacaagatctccgacatcaccgatgacgtcatcattgccgcattcaccaaagggattcgccacgaagaattggtcggcaagttcgggcgtaagccccccatgacagtcaagcttatgtttgaaaaagccaacgagtacgccaaggctgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgctcgcaccatcctaactccaaccacgtggccaaagattgtttcgtctacaagcaattcgcggatcaatacaccaagactgcacggaagaattctgacgaagaacaaagcacgtcgaggaagaaggacgacggcgacaccccggcaggttttcaagatcaccgcaaggagctcaatcatatcttcggcggccccctggcttatgagtctaaacggaagcagaagttgactgaacgggagatcaatgctgttcagcccgacacgccccaatatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccctggatgatatgcagatccctcactccgagttaaaaccaagcaatgcgccttttcacggagtgattccaggattatccgcaactccactcggccagatcaccctcccagtcacttttggcactcgggaaaactttcgcacagagaacatcagctttgaagtcgctgatttcgagacagcataccatgccatactcggacgcccggcgttagccaagttcatggccgtcccgcactacacttacatgatgatgaagatgcctggtccccgaggagtcctatccctacggagtgacatcaagcaagccgtcacatgcgacaaggagagttgcgacatggcccaaactcgcgagatggcgtctgcccgagaggatatccgactggctgcagccacggcgagcgaaggagaagagcccgctaccaagatttcaaagagtggagaaagcgaagccaagactaagaagattcccctagatccctctgatcctgctaaaactgctgtaataggcgccgagttagattgtaaataggaaagcgcgctcatcacctttcttcagaacaataaagatatctttgcgtggaaaccatctgatatgcccggtattcctagagaggtgattgagcattccttacatgtcaaagaagacgccaagcctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgtgttgattataccgacctcaacaaatcctgccctaaagatccttttgggttgcctcgcattgaccaggtagttgactcgaccgccggccgtgagcttctcagttttttggattgctactcggggtatcatcagatccgactgaaggaatccgactgcttgaagacttcattcatcacgccttttggggcatactgctacgtcaccatgccgttcggactaaaaaacgcaggagcaacttatcaacgcatgattcagagatgcttctcaacgcagatcggccgcaacgttgaagcctatgtggatgacgtagtcgtcaagaccaagcaaaaggatgatttgatctcggatctagaagaaacctttgcgagcatccgtgctttcaggatgaaattgaaccctgaaaagtgcaccttcggagtaccgtcagggaagctggttggctttatggtgtctcataggggcatccaagccaacccggagaaagttactgctatcctcaacatgaaaccgccaagtacccagaaagatgttcagaagctgactggatgcatggcggcgctcagccgatttgtttcacgacttggcgagcgggggatgcccttctttaagctgctgaagaaa

SEQ ID NO: 69453 - DNA, 18122 bp, Oryza sativa
  unsure (1)..(18122): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcgagaacccctcatacgatttttgacttctcaagaactccctcaagacaaagatgaagccgagcggatttcaaggcggagcaaactttatgttatgcataagctgagttatacaagaaaagccttcaggaattctgcaacgctgcgtatctttagaggaagggagacaattgctgcaggacatacattctgggatatgcggaaaccatgccgctgcacgcaccattgtcggcaaagcttaccggcagggttttttctggcctactgcagtgtccgacgccgacaagattgtgcgcacgtgcgaaggttgccaatttttcgctagacaaattcacttgccagctcaagagttgcaaactatcccgctgtcttggccgtttgcggtttgggggctcgacatggttggcccgtttaaaaaggcagtcggcggttacacacatctctttgtggccattgacaaattctccaagtggattgaagctaaaccggttgtcacaatcacagcagataatgctcgagacttcttcatcaacattgtgcatagatttggagtgcccaatcggatcatcactgataatggcacacaattcactggtggagtttttaaagacttttgtgaggactttggaattaaaatttgttatgcctcagtggcacaccccatgagcaatggacaggtggagcgagccaatggcatgatacttcaagggattaaagcacgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagtcgaattcgaatctttgcgctttcgaaatttccgtgaagaacgctacgaagaggaccgagtggatgacttgcaccgattggaaaagtccgcgaagcagctttgattcggtcggctcgatatttacaagggttgcggcgttatcataatcgcaatgttcgatcccgtgcctttctagtcggcgacctggttttgaggaaaattcaaactacacgggatcggcacaagttatctcctttatgggaggggccatttatcatctctgaagtcacccgaccaggttcctaccgactcaagcgcgaagacggtactctcgtcgacaactcttggaacattgaacatcttcgtcgtttctatgcttaagcttatcattgtatttccctatcttgactgtcaacatcaagttttcttcttgccgttgtcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtattgtacaaattgagcctccatttgctacatttacactcagtcagaatcagtcctttcatcatcagagttattattgctcggctgaaggtcgttgttgcggaattgctctacaacatcacttgcaatcttgtcaccgcactttgagcattactgataagatcaagagcagcttcttcacttgtcccgtctgcaaagccatcaatggtatcaatttcgattctcgggtacaaggatttggtcattgccaatgccatgctagctcccatacttccagctttcttgatgttcttgaagtacacatccggtgcaactcttagcttgtcaaagatctcggttgcatcaagtgcactcggaccactgttattaagaaacatagcttggacaagtggtgtagcgacattggcgacttcatctcttgctccttcagcttcttgatcttaccaaccaggacatcaaactgagcttgagatttgattttacggtctacaaaacacatttataataagaatctgctgccttacagagagggcagttcaaattgtcagctggcagtaccttcaacctccttcaaggctgagtccctttccgcagccagttctaccttgtcttttttcaaggcttctatttgcttctccatttgagtcatcctggtggcttgcgctgtttaaaatccaaatgtttgaggatccagttatgacagcacaaatgggacagatctagagattaccttttgatgaaccactcagctcgaagttggagtcctggagctgtgcaattcgctcccttaattccttctccgttttcttggcatgctccttagcctcgtgtagctgttccctaacggcttcaagagttcccaaatgtggaaccagcttttctaaggttgcagtcttggcttcattacgaagatggattctctgcacggtggttcagggattagttttgctaacaaaaaaacaaagtcatcaaaggcaatcacctagaagacttacattcacaatgcgagtggcttctccaagtactttcttcagctggcacacttcctcgtcttctttttggcgatttataacaatgccggaaacttgagagttctcgtcccaccatttgagtaagataggaggacgagagtcattagctgcctttatgcggagaatttcttcttcgtcgccgcctagtggacctgatgtattcccaagatattagacgaacaagctggagttattcagagtggcatcacttgagaagttgagttacctgaggatgtgcctggctgagcgtgaggggatccttgctctttatctggagacccaatcactgagtcattaccaacttttggtccttgagaagttgtctgcgcttcagcttcaggaatctcttgatttagatctacatccgactggtttccagtcgggggctctcgggttgttgcagtttcagttgctgccgactggtttccagtcggcggctgatcactcggattggccttgtcgtccgaagcttgggcgccagtcggctgactttcggcagtcggctggctttcggcattcggctgattttcggcagtcggctcagcgtctttggataaatttggctctgtcacagccggatcaggatcttttccagttggatctatgtcggatggtttcctgcaaagtgtccttttgacatttagcataatttctataagagaagcatgccgaaataaaatggtatcgagaggtttatacctggaagatgttctaatctttggaatttgacggccagccagttttttcccgggcatggtatgctttgggagtttgttgggagtgcccttgtccccagatttgttgctgtcatcgccctcatcgtcattaagcaccagctttctcttgcgaggacctgtctgcccagccggtttggaggtttgaggttgtgggtctgacctgattgtcggccctccacttccctgaacggtgtgctgacgaggtgaccggcgctgagtgattgggggatcagatttcatcaatgcatattcctaaatgagatgcttccacggttaattaattcaacatgaagacaagataatgttttggtcatagattgaagatttcagatgcatacctgcggaggcggattgaatgcattatatggcacaactggcagctgatgtgagtagctgacgacgatggcatttgagaagattttatacattctctccttcatgattttgaaatccagagagtctggttcttcgcgattaggatcatgcttgccgtcaaactcaaaagctgtacgggatctttctttaattggcgccagtcggcatttgatgaaatgccgagtgatctgctctccttgcaagccttgttctttgagttttaacatgcgatccaacaattccaaagcttgggcagcttcatctccgattggaagagagttccaagtatcttggtacaccggaggaagacaagaatactcgggaagagcaggctcaggattctgaacataaaaccagttcgcatgccaccctttgtttgaggtcttgaagggcatagagaagtacttctgactcagagttcccctcaactgaaatcctgcccctccgactacacatggcttattcttgttcggttggggcttgagaaagaagatccggcaaaacagagcgaagtggggcctaattcccaaaaaggcttcacaaacatggatgaaattggcgatatggactatggaattcgggtttaggtgatgcaagctgattccatagaagcttaatatcccgcggaaaaatttcgaggtcggaagggcgaagccgccatagaagaaatgagagaagaccacaatctcatgtgtatcgggggtcggaaaagtctcaccgcacgctggccgccacccgatgatctccttggcagggagaacgccgtgcgccaccatctccttcaggttctcttccgttacgtcggatggcgcccactggccttcaaagctttctttttcctccgccatcgattttccccgaatgcgctgatttgattcgagggatggcttgggagaggtgaggaattgaggcggtggatcacgggaaggattttgatgcattttttcgaaggtggatttgagtggagtggtgaaccctagttcgccggcgcagttctgcactgtagcaaggagtggggaaaatggcgagagttccggcgggggagacgaagcgttgcttggatctcgggatttcttgttaagggtatcggaggagcaaatgggcctaggcctgaacagtacttcagcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagctttattaggctacaaaagctgtctgggttaatttggaatgacttgtttttatcatagtcacttccttggtatgttatatacctattttcattatggtaaatagtcatggcccaggctattagacttattcattaccataatttttataatacttggtgggtaatctttagagttttatattcggatgcctgtccagtgtgttcattcgtgaaccttttagagtgtaaaccactcggactcttttcattatggctaaaaagcagtcggctagcatgcctatctaggcgccgtgtatgcttttgtcatatgatgcacaattgtgttattattttgtttctcaactatatgtttagttcgttaactaatcacatagttgggggctacacctaattaggtgcatctattcgatgcaccatatttttatcttttcgccctttacagtcttcgtcttcgctactcggcaggtcttggcatgataagttttgaagcactcggattattatctttgagaaggctatgatggttgactgcaaaggtctcgggggctactgtggagattatggatatcccatatctacacggcgatgatatttggactggatataggataccgaatatagatagaatatcttatgtgtatcctgggtttgtttcttaacttgtacatcaaggaaacaccttgagacttagtcggtcacgactgtattttatctgtatttacatattccgttaggaatatagattatcttttgtaacacggactctttcccatatataaggggggtccgggtgcctctaggggcggaggttggattttctccaaatcatacaatcaataacacactcggcggattcatccccggacaggagtagggtattacttcttttgtaagaaggcctgaacctgtataaatcctttgtctccaaacccatacactttcctagcttgatagccacccccttttattattgccgaaatctagtttcgacaggtcggttccgttgtagttgaggtcgagcgggaacggtggctggtgcgcctgatttcgccttgggtcgtacagcgacgacagcctgcagttggcgtagatcgccgggaacgacatgccggccggcgcgtcccagttccagaacggcagcgcaaacgtctcgtcgccgatgagcttgcccagtattctctcgtggaagtacaggtacatcctgcacgttcatacgcatgggtccagtgcatgcagagaatcacagccacatcagcacatatagctggatgcccgtacacgaaccagacgagacgggatgtatatttggggaaagtgtctttattagccttttgaggggtatcccttctttttcatgtcatttaatttaatatatagttaacagaaaatttaaaaaataagataaattaacgtgagatatactcaaaaggctaatatacccctcaacttctacattttacaacagaaaattttaaaaataagataaattaacattagctggagtattacttttttatataagttcaaacacaacttctatattttacaacagaaaaaaaaataaaggtgcggatgtaagttgactagttttaataatttatctctctcttttttttacaatttgtagatttcaaatttgagcttatgtgttaatttgtgaaatgatatatctcatattttcttattaattattttagaaaatttatagctatttactagtaagtggtaagtggtatgtaagaatcatcgacggacgtctccgtatatacctcctccgtctaataaaatatcaatccaacctacgaatctggacacatgtgtatgtgtctagtttcgtagctagaaatttgtttttttgggacggagtataatgttgttgtcacgtaccgtacctatgccatggaaaaaagaaccagcagctgtgtatctgaatctccagacccgggaagccgacctggtcgtacgcgccgtcgcagtaggcgcagtgcacgcgccactgctgcttgaagctgcggggatcatcggcggggagcttcttcatgagcgacacggccctctcgtacttggtcaagtacgcaatgtccaccaggtgcgccgccggccgcacgcggagcggcgaggacgccggcggcggcgtgaagtcgacggcgacggtgccggcgctgtacgtcgggcagcagctgatctccggcgctgtgtcggggtcggggaggtccacgggctcgtggcagtggccgaggtccggggcctggattggcgccgcgagcgcgccgccgccgccctgcgtggccaccatggcggccgctgcgcctatgccaaggagcacgtcgcggcggtcgaggccgcggccgccgcctcggccggcgctcgccctgcatgacacgctccgcagtttcctcccgttcgtcttgcggttgcggtgcaagagcaggttgtagtgaagggtctggaggttgctgatgcacggcagcgccatgcgaggcgtcacggatgcacctcgtgctacattgatgctctccatggcggcattcagctgtaaactagttcttgcagtggtgtgtgtattttatagggcaatgcgtgtgtatacgagaaactattaatctaaactattgagaatagatcactcgttatttacatctcatctaaatggttataaattttttttaaaaaaaatcaataaaataaattaatatatgatcaatcactccataaacatgcaataccaaaattaacttctacagattgtaatggaaaaaaaacaaaatttaactatgaatatacgttaactatttatagcttaattttttttaacatgtaatggttgaattttaacttgcatgcttatggaatgatctatcacatattaatctatttagttaaatttttttaatttttttcataataatttggatgatatgcaaataacgaaagaatgcctgatcctaagaatttagaatccactctagtgtgtatactgtagtgtagcgcccacttttttctttcttactatgcttctatatttgcaatggtattactaattactccctccattccattttaatcatcccctaaggtttttaggtcttgacattactaattactccttccattccattttaatcatcccctaaggtttttattgaccattgacaccatttaaattcaaagaacgacgagtcaatatttatttccttattaattacaacaagtagtacgggtactaaggaacaacgttacgtcatgggagtctattgacgctattcaatcaaagaacgactaatgacgccatttaatcaaagaacgactagtcagtaattatgtcattatttataccgtattattcattagttacacatcaaacactatggtgaccgaatcgcagccggacctcgtcacgatcgagacgacgatcgtccggtcgccgtcggcgccgatgtcatcgagcaagttgccgatgccgaaccactaatagaaaaatcattttttcagacacggtgtattattttcgcaagcggacatgacccttagaaccaaattaccgcctataaaaatagaaatcgggatgaaatttaatgtccgcctgcgacggcacctgcgaaaatagacttgaactagcaaaaatgcccgtgcgttgcaacgggtgaaaaaattctaatgataatatatatttttcatgaataatcatgtcaatgacaatgtttgtattttaatgagcggcttgtatttttataaacggtgtttttttcttgcccaattttctcaaaccattcagaaatggcgcatttctttcttaaaagttgaatggcgtatttctttcttaaaagtttttttctagcatgtattttttgcttttttatttacaacgaaaaccatatttttctccattttttgcttttcttttctcgtgtgtttttttgccttttttttgccaattattttctcgcgcgtttttttgcttgtttttttttcaaatgttcttttttctttttttttcagtaaggagaatatatgacgaaataaaagccgtgtagtaggtggcaaaaacatcgatggatcatatccgactcagagcgatttttttaatagacggtgtttttttcttgcacggttttttaaaaccatttgttaaattggcgcgttttttctgactgttttttcctcgcatgttttctttaaaaaaattaccgacgatggaaataatttttctcgcccgtttttttattttttttatggaagatggaaaacctttttggagtgtttgtttttttgcactttttctgacttttttctcacgcgtttatttgaaccgtttttattttctcgtgtattttatctttttaaatagttagattatattagagatagagaagagatatatatcgattagaaatcagactttgtttcgccctttcaatttttttctcgtgtgcattttttattttatacgaacaagctttttattttttacgaactatttttttcgccactttcttagggaatcggacaaacttttttagatgtattttcagttttttttttgcttttataggaatcagactttttttccggtttttaaaggaattgaatctagtatttttttttcaccactttttttttgccttttataggactcggatttttttggttcggatctacaatttttttttcgccactaagggaaaacggaacttttgttgttgttatttttcttttttttttgtgcagctttcctttttctttttactagcaatagtgcccgtgcgttgcaacgggagaaacaccgtttgataatgtgacaccttaaaaacctcaaatcggtaaaaatcaagtttaatttgatatattaacaaataggtagaaccgagactaatttgatgaattagtatatgatttagaatttatttttcgagtctactcaggagtttatccaacgggttttaatttaaaaaatcagacccacgttctttgatcaaattagacatattcatttttatttttttcgcctttttttaccgcgtccacatagtcggattttttttgcccggttttttcacccgatttttttcgcccgatttcttttttttttaattcgaccgattctttttttattttttcgcccttttttacacaaaatcggattctttttttcgcctgattttttttcacgggttttttttcgcccgatttcgtttttttagaatcggaccgattcttttttttttatttttttcgccttgtttttcacggaattggattatttttttcgcccatttttttcctcccggttttttcgcccgggatttttttatcggaccgatcttttttttttctttttatcgccctttttttacatttggttttctttttctttttccggttttttttattggaccgatctggtctttttcttttttatcgcccttttttttacgtttggtttttctttttctttttctttttctggtttttttatcggaccgatctggttttttttattgccccctattttacgtttggtttttctttttctggtttttttaatcggatatgtttggtttttttctttttttcgtccactttttttacggacgatggaagcacctcttattttttaagtagtagagatgcacgtttctgtttttgttctctctcttttattattatttttaacaaacacggcctcaagtaccttattgcaggattatagggactcaaatgtaaatataaaaattacagggactcaaaagcaaaagtacaaacccaaaaattgaaatcatataaaaatggaatgctatcgacctgtaggttccgtttattaaacagatcttcaatccgacacatcattttgtttcaccaagatctgtgagatatcacggtatagattgagaatcggatctatagtcggagttttttttccgtttatgagagggaatcggatagaagtcggactttttattttattttttttagcttttttttacggacgaagaaaacatcttttattattttttaagtgtagagatagagatagacaagtagagatagagatagagattttttttcactttttttttgcacggaatcggatttttttttgggatcgggcagttccgttttttttctcgctcgtccggttttcttggggcggttttttgtcgccctttttttcacggaatcggactttttttttgcctttttttatcggacagttacggtttttttcaccggtttttcgccctttttttttcacagaatcggattattttttcgccggacagttacggtttttccgtccggtttttttctctctcgtccggttttttcgctgggttttttcggacgatggaagcatctcttattttttaagtagtagagatagagatataaatagacttgcgggccgtaatttttttctaagtcctcacacatctcctcctttcccctcccctcacttctacactccccgacggcggcaggcggtggcggcgaagggcggcagcggcgaggaggcgaggcggcgcggccaaggagggcgacggaggagggcggcatggcccggcccgtccctcccagatctagaggggcgcagggggggaggggggagcgcggcggccggtggcggcggagggcgacatcggcgaggaggcgcggctcccagccacgacagcagctcccctgccccctccctcccagatctggccggaggagggaggggagaggccggcgagggcggcggtgacgacagcgcgggctgggcggcgacggcggctcccctccccctccctcccagatctggccggaggagggaggggggaggctggcgagggcagcgatggcgcgggccgggcggcggcggcggctacccccctccctcctagatctggccggaggagagaggggggaggccaacagcgacaacgatggcgtggagcggcgacggcgctggccgggcggcggcgacggctcccttcccccctccctccgagatctggccggaggaggggggggaggccggcggcggctcccggcgtgggccggcgatttttttttttcgtcccttccattttcgcaggcgggctgttgccccaactgcaaaaatcgatgattttcgcagtcgttgtggtgtaggcggacctctctcccatctataaaaattagttttggccactgcgaaaattagttttatagtagtgacctcgccaccgtcttcctcggagaacgcatcctctcgtcgtggtggacactgtctgcgttagcacgacgctcccggtgcacgtactcgccgccgcgatgttcccgctctcgctggcgcgttcaacacgaacacgtcgaacttaatgtacgtggagtggtcggctgacctcgatcccctcgatgacaagcacctcctcctcggcgtccttctccttgcggctcctcgacgtcttgggcctcatcactgccacccgcacggtcttgtccagattccccggcaggcgcctgtcgtgggcgccggtgtggacagctggcgttgatcagccacgggagacccacatcctagtacgtgaagcgcagcgcgccgcgtcgagggagtcgcggacgcagatgaggcgggcatcctcgttgtaaaagtggaagctcgcgtcgagcacggtgaagttggtgttgccggggaagagaaggccacggcggatgtaccacaggcgctcgatttttttaaaggaaggcaagggctgccaaatctatcttctatcagtcaatctgaaagacatgggcgccgctgaagtgcaagttcttctcttagctagtcacgtaaaatagagtatggacggcagacaggctagaaaaaagaggatggcaaaaccaaaagatttgcctactttgctacaatgttgatgaatcggccctgtacctcctggccaaatgtgactcacagagaggatatgggcagaaatgcagagatggaccgggactgaccttcagatgaacaactggcatagctatcactcagtcgagtaatggtggacacttgtaacgaaatctccaaacactccacgcaaacctctcaggaccctggtgattttaatctcgtgggaaatctggtgcgaaaggaacgcaagaatcttccgcaacaatgcatattcgctatcctcaatcctagcaaagatcaaggaggaagagagagcatgggtcaaagcaggggcttctatcctgcaggagtttgaaattttgggagatatcacttaatctctgccttttgcctctccttttgcaggttatttgtttcgtttttttcatctaaccctgtagctcttttgagcaaaggccgggatattatattccattatctaaaaaaatctaaccatgtatatatctcaatataattttctcctgctctattaataccacaggcgttcgatgttgccgtggtgcgcgaagaaaaccgggtcgcgtgccgccgagtaaggtgcgcgcccatgtcctcgtcgttcggctgcctctgatcgccggtccattggtggacggggccgtgcggcacatgctcgagtgctcaacggtgcccagcctcggttccggctggtcgccggcatggtacggtacggctgccccatgaacagctccgtcttccttgctcccgaaatcatctgatacacatcataattattttgttcgtattaaacaatttgatcttacgtacacatgattacgtaattataggttgattattttggaatttgccgtgcatggttttcattagccagtttagttcgtgacttcgtgtgtgatcactggaaaataataatctctgtgcatacgggcccgtccccccccccccccacccaccaccgtccccaacatgtcagacatttcttcttcgccgtttctctattcctgttttgcgagcccaccgtcgcctctctcgtccgccgtcgtctgtccgcagctgggagccgtctgcccgtccgctgtcgctcgtatccaaatgcccgagggatccgccgaccacggccgctgccatttttctcgtcgcgcaggatgccaccgacgctgtctgccgtgaatgtgtctgcctgtgcctggccgcttaccatcccgaggtcatcaacagtggattgcttcaggaacaaagaactagtttcaaatgtatgctctctctctgttggcttccttaggattgatcctttaaagaaaggacttcagatgtatgattattccatcgtcgtaactgtacatattgttatcgttattgttgtttgtcaaattctttggttagaccacatttatagaaaaaaaaaactaacaacatctacaacacggaattagtcccattgaatttaatattgaataaattttgatgcaatgtttgtttatactacctccatcccaaaataagtgcagttgtgggtatccgtgtctaacgtttgaccgtccgttttatttgaaaagtttataaaaaaacaaaaaaaatgttagtactattcgtgttttatcatctaataacaacaaaaaatactaataaaaaaattaaataagacgaacagtcaaacgttgttgatcattgaatataaatagtgtaagactacacattttagaatggagagagtatttttctgtaaactttgatcaaatataaaaatgttcataggggtgagtgtgtgcacgttgtgagcgcctgcgtttgtactgtgtttctaaaaaaattgtttgataaaaaatcaaacgatttttaatatgaaacggttggagtaggtcacatgactgcgactggatgaatgactagcggttggcgtcgttccgctgtcccccagcggaaaatattgatggctgacaaaacggcgacagcgaagaacgagtgaccgtcgtctttgcatcagcgttgatcagatacaaacgtggtacggtggtcggtggtagcctggtaggtgtgctcttctgcagcgttgtagaatttgcgctgccctgatggctagtttgggcctcaatttggcccttccacatgtataggccgggagattgaactaaaattttggcctatacacatgtattgaggcccaccaaaacgaggcctgtctgcgctttgggatgagagctttgcccactgaacacagtgggccgagtattgctgatcagtggattgtgctgggccgatccgggccgtcatcgaatacgtcaatttaaaatgttttgggattgttattgctaggatggagttgtcgtgtctttatcgacaaagactttaaaataaaaaaaacgatctaaataaagttataaacattatgcatcttgagtgcttattggaaaaggacagctgaacattttctcggcgtattgatctcatgttgttgctaatataaaggaaaaaagaattcgtattactgcttgtactcgatataaatttcataaaaaccttatacattacttagtactatgttcgtttcagattacgagacgtttttacaaatcaaactgttttaagtttaactaagtttgtagaaaaaatagtaacattttttaactcaagacaaatttattaagaaaatatattcaattattgatttgatgaaactaatttagtattataaagagggtgtgatcggtaccctcttttcccaacccctctctctcgttttccgcacgcacgcttttcaaactactaaacggtacgttttttttgcaaaaagtttatatacgaaagttgcttaaaaattcaaattaatctttttttttaaaaaaaaatagctaatacttaattaatcacatgctaatagatcgtttcgtttttcgtgcggaaaggattagttcccatccaaacacaaccttagtcaaacttgaaacagtttaatattgactaaagtcaaaatattttatacctgacacagagggagtagctaatataaaggaaaaacaactcgtatattactgcttgtactcgatgtaaatttcataacgaccttatacattatacctcgaaacattgttcatgaattaacgtaagtcacaatattattctcttaaggattacagaagcctaagttttcttggaggaaacgtagaggagtttttaatcaaggtttccttttcgttacgtttcgtgcgcagcgcgtccaagtcgtataaccttttcgttacttaaaaaccaacgcaaccccacaccttttctcctacccaccacccgtctccgcaacccacacatctccattgcgccaaggaagaagaaaccctccccctccctctccccaatccaatccaatccaatccggcgagtcgcgtgagtttccgctcccctcttccgtcgattcggcatcgggttcgccgatcaggggggcttccttgtccgatttggtggttgattcgtgtttttgctcgtgttctccaggaccagctcagtctctcgtaagggtttgatcgagttgttgtgtttcgttgcgcgattggcttcgatcggtgtgtttctggtggttaattttttggggggcgctgatttggtgattgtgtgcaggaaggagcgccatggccaagagctcgttcaagctggaccacacgctcggtcggtttgttttcttatcgtgttcctctttttattttttcctatatgtgctttagtagtgtggctgcgatgattgcgtgttgggtttatttgttcgataattgattgaatgtgtgcgaagacgagagaaagagacacaggaatatgttttttcccccggtttaaggggatggcttaccaaaacatctgaatgtgtgtggtagcaactgtttattgaattgtgcatgttctgtgcgaatctgggagtaggagtaggttgcgattgctacaaagttgtgtgactgatttgaatttggtagtaataatagtagtacatgccttttcataatgggaatagtaggttctgtgcggatggatagagggatggttaatggggaaaatatgtcatcattactgatgaatcaaattataaagagcctcaatgtgtctatctgaatttctgatacaccagttttaactattatgtaaggctgtaaaacccaatatctctagtattgtagactataaattaacagttgacctgacaatccagcatcattagctgattctttgatttgtttttaagacttatgtggtcttgttccttttctgatggatcgtataaggaatagactttccaattcaatcacccaacactttatgcttgagaacatggttttggtagtctattgcatgtttaggggtgctgtaaatcctgcccaatcttctgtgaaagggccctgatgtttagtatcatgctttttttcactgagttatttcttcctgtctaattttttatcttttaccttctgtgcttgaacaatatttaagttgattaatgtgtgtgccaacatgatagcatagattccttttttgagaaatagacagcataagtattgcacttttttggttgccctttcttgtaatcactctgttattatagttttctctacagtgatttgaaatctctgatttctcgttctccatcttctacaaccttgatttatgtatacattttagagatgtttcagccttttagtcagttcataataaccaaaatcttgttcttcttgtgcatgtatttcagagaggaggcaggctgaggctaaccgtatcagagaaaagtacagtgacagaattcctgtaagcttgctcttcatattgctcagttatgttgtttccttcattgtggtttttttgctctaatttgttacatatctaatgtaatgtagtgattgttgagaaagctgaaagaagtgatattcctgacatcgacaagaaaaagtcagtttccaagcatttacgaaaccatagcatttagatttttatttagttagtctattgaaccgctaaaggaaggaatattg

SEQ ID NO: 69454 - DNA, 6825 bp, Oryza sativa
aactgtgtttgttttatttacatcagcagataataattgagcttaaagtagtgcaattgaaaagttcttggaaatatttttttcaaaaggatcccagttccatattttttttgatgtctcatgaaaagatagatgatagatatggccagaggcgtctccaatcctagtggaaagcttacaagtccgtgattataattaactttcggattttttcaagtttctgacaaggtttgagtgtaagtggatcagtttgcctttgattaatgtaatgacatggcggccaaagtggacaaacaacattgagtagaggacaaagatcagacgtgtcttgtgacatgtggtttgtatggtcaaagtagatgacagtttcattaagaattctcatacaaagatagtactacatgacaacattacttcttctcggtttcaaaaaaacaacattacttctgcatgtgaagatatagatcatctgcaaggctccagctcattgtagaaaactaggcttgcattcgtttcttttagacttgaaatatttctcttcaaactttgctgctcccagtttctatagctatcctggatatatactgtcatactgatgctcatgctagatgagaaatactctagctcagaaaaaaaaacacgaatattaaggaaggatctaatataaaataaatagaaggagtgaggtttcgaacccaggccggctagtccaccaccttgtggctctagctcagaaaacgtctgttgacaaaatagtcatactgcattatcttcaatcggatacaaggaagtctcgcacacgtgatatatttgaatatgaaaggtattgatcacaagattcttgaactttactttacccttccctgaaaaatggttccaggtttcgaccgcgaatactgattgatgtatcccgtatcaacatggctacaaatgtcttgggcttcaacatttccatgcccataatgattgctccctcagccatgcagaaaatggcccaccccgaaggtttatccaagttgcattcacctaattctttcctctttattttttttttcaaagcaatgtttctcatggagatgtttatctgacatgcaggagagcttgctactgcaagagcagcttctgctgcaggaacaataatggtttgagagatatccaaaagcttgttatgttttttttggtctcaaaatgattaattcagtgttctgatgctatggctcaacattatgttttttttttcagacattgtcttcatggtccacttctagtgttgaagaggttaattcagcagcgccggggatacgtttcttccaactctatgtatatatttttcttcaaaaatacttaagatgtaatgaggagcagtgttttcagtttctaaaccttagctgagttacctctgtctttactaggtttacaaggataggaatatagtacggcaacttgtcagaagggctgaattggctggttttaaggcgattgcactcactgtcgacactccaaggcttggtcgcagggaagctgacatcaagaacaggtcctaatctagcaactctgtacacaattactgtatgctttaccacgttccatactgtcatttcatcaggggctttacagtcttaagtatgtattctgaatttccgatgtcttgcagattcaacttacctccacatctggtattgaagaattttgaagcgctggatctcggcaagatggacaaggtttatctaaaactgaacccttatgcatctatatatgaacaaaattttcttatattcttaaatgtgttttatgtttttattcagacaaatgattctggccttgcttcctatgttgctagccaagttgaccgctctctgtcttggacggtatatgcttcgataccatccttagttttgtgcaccaaacaatgaatcagaaactgggatactgtcctggttcttctggcacttctctgtggcaatgagatgctgatgctactgatgcacaatgcaggacgtgaagtggctacagacaatcacctcgttgccgatcttagtgaaaggagtcatgactgcagaagatagtaagtgcagtttcagagttctggttgctcattgttcattgttatggcatgccatggtctgatggctgatgatcacatgaatttggtgcaaaatgcagctaggcttgctgtcgaaagtggcgcggccggtatcatcgtgtccaaccatggagctcgccagctagattatgttcctgcaactatcagctgcctggaagaggtatatgctattaattgctaacccagctactgtcataaaatgcacttgtaaacatcttcagaggaatcttcagtgcaactgacatattcagaaattctagcaagaaacttccctgaacttccatgatctatactgaaagtgtcgagcaaactcaggtcgtcagggaggcaaaggggcggctgccggtgttcctcgacggcggcgtccgccgtggcacggacgtgttcaaggccctggcgctgggagcttcaggagtatttgtttgtccccagagcctgcattttcaatcaagttagtacagtaccatctgaatttacagcccgcttaacgccatgagcatttgggtgttcgtcagattggcaggccggtgctgttctcgctggccgtggacggcgaggccggcgtgaggaaggtgctgcagatgctccgcgacgagctggagctcaccatggcgctcagcggatgcacgtcgctggccgagatcacccgcaaccacgtcatcaccgacagcgacaggatccgccgctccaggctgtagaggctaagctctgcagcggttgcagtgatcgaattgtccatgtatggtatgctagtccatttgagatgctactgctagtagttattgtgatccctcccacatttgatgatgccgggtaataaggagagggaggaggctgggatgtgtgcctccaggtgtatgtgttcggtgttcctccgtgatggaggagtatgtagcagggaatttgtcactgttgctgtcgttggcagggaatttggtgattcagagtagtttgtgttggaaaaaggaaaatctgtccaattctgtctcgacactgactgtgatgctttgcatcgtcatttgtcgtggacgaaacgaagcttttgcctctgttcatgatttttttaaccttttttattttaaaatttaaagataaacccttccaaaacttatttccaaaatataaaccttctcatcacatcagccagagtaacgtggccaaataacgctgccatgtcagcgagattggcgtgacaatattgttttgccacatcagttcagctagcatggtcaaaatgttcggattttgaaaataagtttgtgtagggtctatttttaaaattgaaaattaaaggttaaaaagattaaaaaaaattctctgttcatagctcaggaaatcgtttgctctctgataaatgggccccaggcccactgtcagtttcacatacactcctccccagtcacctacgaattccgccagcggcagtggcggcggcggcgctcctcgccgccggccgctcgccgcctcaccgatgccgttcccgcgcctccccgcggtgtaggtccagttcctagcagccagcgcttgctgcctgctggcctttcaactgcctccaaggctccaaccctagcgcggcgccatcatcatcccaatcgtccgctacagcctacaaatcgcggtgatggtcgcgtcagcgtcgcaagctaccgaactagcgccgcttcgtcgtcctgccgctgcggcttgcagggagagacagcgagagctgtgctgatgaagtgatgaaacttgtgggcttgcggcttccaggaccaaactgcaggtaccagcaccaatttttattccaagaacacgcgtgatactctcctctagtaaaatacttcagatatcagtcaatctttggtgtcttgctgatggggaaaatctgattcttgaatacaaaattagtacacaagtaaagatccttcctacctccaagatattctcccctgtcactgtcggtagatcaccactctcttcctcatccacacagatgaacacaaagaggaaagagcataaaaaagccccccaattcctccttccagttcaagagtacaagaaagacacaagcacagacaaaattcctgagccctgccccccgttgcttagtaaacagtgagtcctcttgctgatctatcgtgcagaaattccaaaactacacctttggttttagtatacttctttttcatgcatgtcttttaatttgatggatttgtgtgggggaaaatgtttcgcttgagcttctcgcatgctctattcctgttttatttcatcaaattttgtgaatctgtaagattaattcgattcatgggtaattggtaagcacgacatctgtgccattttatatcgtataagcacctttgtactgatgcatattacataagggccatcattttttttcatgttgcttttgccttccatactaagctggtcctgtagcattttggagtttttatggctgtgctgaagataataatttgagcagggagatggctctggtcacaaatgtgtgcgaatatgaagaacttgcaaagcacaaactgccaaagatggtttatgatttctatgctgttgacgcagaagaccaatggactctcagggagaacagtgaggcattctccagaattttgtaagttgtgctctaaattggtagggaatatctgaaaatggagatagggaggtcctgattttgtgttatattcatagaagttattgttaggatgtagcttttagttattttcatttgacattgtgttttgattttgaaataaaatatattacccattacttcgtctttcaaagtatattatggtgtcctttgtggataaatgatgttaggtttcagccggttgtattggttgatgtgtcctgtatcgacatgtctatgagtgtcttaggctacaatatttccatgcccattatgattgctcctacggctttgcacaaattggcacatcctgaaggttctggtttgctacctttatatctttcttttggcaatcgcatatttcaatgagaagttcctttagggatatttatctggaatgcaggagagcttgctactgccagagctgcagctgctgcagaaactataatggtttgaaagatcgtaacaaattttatgcattttgatatctacgtctgacacattgattcaccaactagtcatattttcagacattgtcttcatggtcatcttgtagtattgaagaggttaatttggcagggcctggagttcgtttcttccaactttcagtattacactattttctttcttagattcttcacctttcttctttaggatttatgctcccttacttcttatcaatgtcttgttcagatatacaaggacaggaacttagtgcaacagcttatccaaagggctgaaaaggctggctataaggcaattgtactgactgttgatgctccatggcttggtcgcagggaagctgatgtcaagaacaggtcctcatcgtgcaaccgtagtgtttgacttgtgcattatgcattatttaatgaaaatctgtaccctgcatcaatatccttttcttaaaggcacctttattgaaagaagaaactccaccgcaaactcattatctgcattatactttacattacattctaggttcaccttgcctcaaaatgtcatgttgaagatctttgaggggctggatcaagggaagatagatgaggttgtctaaaaactagtgccattgtgtgaagtagtcatgattctgtttaacaatgccctgaatcattctatttatctgatgtttcagacgaatggttctggtcttgctgcctatgtcgctagccagattgaccgctctttttcttggaaggtattgcagtgacactatgacttgtaatttccagataacaaccagttaatatgaaagattttaaccatcagaacaatgtcatatctcagacaattcttaatgtgaatgaaaccgtgtgatgttgatgactcatcctacaatacaggatatcaagtggttacagacagttacatcattgccggtcttagtgaaaggaattataacagcacaagacagtatgtcctttgctttcaattaccttgtgtaactacatgcctcattatccaagctgcagatctcacaagacatttacaaaaatgcagctagaattgctatagaatacggtgcagctggtatcatcatgtccaaccatggcggccgccagctagactatcttcctgcaaccatcagctgtctagaagagctatgccatatgtaactctcttttcaatcttaatgaaatttggtcggctccttcaccgactcagcaatcagctgtgtagaagaggtatgccattgataacccaatctgcacttcagcttattgtgcttttaaacacattttaactgaaaacagcacgaatctcaggttgtcagggaagcaaatgggcgtgtgccggtgttcatcgacagcggttttcgccgcggcaccgacgtgttcaaggccctggcattgggagcttcaggggtatttgtaagtcccctagctagctactgcttgaatgaaagatgatgctgaattgctcatgacacggcatctgcatacgcttcttgttctgtcagattggtaggccggtgctgttctccctcgccatcgacggcgaggccggcgtgaggaacgcgctgcggatgctgagagacgagctggagatcaccatggcgctcacggctgcacgtcggtgaaggagatcacgcgcggcc

SEQ ID NO: 69455 - DNA, 11873 bp, Oryza sativa
agtagatttatctctaggattctatctttaggactctatcttatctctaggagtcaatctctaggatatatcttatctctatatttgtatttgactcttatctctaactaacacattatatttctaacaaaagacatctttgcagattgcaattgatgtgattctgtaactttgcgttcattgtcagatggagatggttgtgtttttttagaaacttagtacaatcaggcatgtggagaatggtaagtatttagaaacacaattcaaacataggcgttcataaccgcgtacgtataacatactcacctatatgaacacatacacatggagaatgacaagttttttaaaaacaaaattcaaacgtgggcattcataacgatgcacacacataccctattatactgaaaaaaataattagtcgtagaggcgagcatctgtacatcaagacaataattagtcgtaaatgcaaacacatgtgttgactctagaacttaattcggatggattaatttgaccataagaaaccaaactagttgaattacgccgtaatacagataaatcctaatagatctattttagaagatgataagttcataaataatatccaaattcggcatggttcacattaaaattagaaattatagacgaggaaggaaaccaatctgctgccgtgttacacggtaaccgcagtttgcaaccgtcaataggagaccctatccactacgaaatccgttggatccctcgtgctccgcaatctcagccgtccgtttccccctatagtcccccttacctccccttctacagttctacgaagtacgatccaaacaccagcggcgaaggcgacgaagacgagggcaaaaacaccagaaggggaaaacttttgctctcccggcgatctcgagatctctcaagatggtaatcccccatccaatttctctctacttttcctcggatttgcgccgcactcccgatcgatgtcttcgacgcggttaactgcgatggatttgcgcgagatcggatcctatggtctagaatttcgagtcgattaggcttttttttgggtggtgttttgcgttgggtgatttcagattggaagtagaacggggggacgaggattctgagaagaatctactggtctttgtcgtactgaatgctctcgatttcctcctgttttgatcgcgtctgtgtggtttggtctggtcaggtggtgctgcaaccagatccgtttctgagcgagttgacgagcatgtacgagcggagcacggagaagggatctgtctgggtcaccatgaagcgatgtgagtgcgcgctttcatctggcaatctggtttgtgatttgggtggctgaagaactgatgcttgagttgatgggggttgtttgatatgtgcagcatcgatgaagtgccaggcaaggttgaagaagatggcggcgaagggagaggcagtggagtaccggtgcctcgtccgtgccaccgatggcaagaagaacatctgcaccgcggtacagtgactgtcctattgtcctttgctgtgctgattttgaattattattttgcttatggttgtagttttgtgcataatggttaccgattatctggtattcgatgctaattatgccaccaggcggtaagtgaggaatgtgaatatgacattaggcgcttttggtattgcactaaaacctctcggatatgaaatttcagtactgagccagtttatttggtattcaagtcaacaaggtatattgttttaagagatagataaaagtatggaactgtagaagtgctgcaataagtatgatccaaactgtgaactgtatatatagtgaacatatattgtagattggtctatgtagaagatatacagtacgttggtttcttgcttaagcttctcacaagcatcctttcgcggtaacatgtgtaggcactcgtgaagcatgatcataaacagcgaggtaccgtagaatcagatgcttactcataggacatcttaactcgcatcctattgaagtagaatgtgtaacataatcataagttggaacagactatactatcacatgcttagttgtagcatggtaaattgataataaacatgaatgaactttgttcaatagacaaactagccaagaaaacgtttagtgccattcatggtgttaatattgcatgtttgcctgccctacactaccgcagtctcattttcatcctatgctaagataactctcaagttggtgtagatattgagtatgaaactcatttgtgtgctcttgccaagttttgattgcattaagtagtgaggtttctcattaattgcaccatcttgcattttctgaaagcgtcatcaagttgtttgagcttaaatttatatggtgaaagtattgtttctaatgataagactgtagtatcgatgggcatccactggccactttttcccatgtgattaatctttaccaccaaacagttgggtcgataatctttttccacaagagtaagaacgccatgataagttcagagtcccaagatctatgttctgaacagtttattttctcctctaccctatatgtggtgaaaattcacatggtgatgtgaggtattccatatgaaggctaaaaagttggtgattatatctcccatgctgttcatgtagatacagaataatagctggtttggaaccatgtgtgtccatatctatttgtccctgctaaattacatttgtcaaagctcgcccaatggagcatttatttgcccctgctattgcaataatgcctcctaggggtcgatagtgcaattacgagctgaggtaaactactatatttacttagatgttagtgatactatgtttttttccttcaatactatttataggacagtcatttgcaatacttttttttttgtaattttgatgaaaactggatatctgagttgactaattacatgttcgtagttttgatgaaataatggatatttgaactgattaatgatggatttattcatctttctgaagccataaacattagccatacttatttgagatgcgtaaattattctcctgtcacttccttagctttttgggctacccaataagtctaacttaaaaagctcgccatgtctttcagctctctgcaaaggagtacctgaagttccaagcttcatatgccacagttcttaaagcccatatgcacgctttgaagaagagggagaggaaagacaagaagaaggctgcagaggttgagaagataccagagaaggcaccgaagaagcagaagaaagcaccgtcttcaaagaaatctgcagggtccaagtcgtaagttactgaaagaatttgctaagcccttttttggccacaggcctgagtaagatgggtgtagtcaagacattatcctccattttactcttattcatgtctgcgagatgaagcatgtgaatacctttatagagctgtgccgtcgacattagcaatttttgaagcagctttggttgtctagatgtaagccgccctggaattttctatttctatcatagaaaggcatctcttaaactgtgcctgatctgatcgtcaagttagtgcaactttcaattgacagaattacgtctggaacatgaagttatgcaactaagactgcagaaggaaattgcagaactgttatctggatgtctgtgttccttcaattttgtttttctggttggggagaaaaagtgtgaaggtatgtctgtgtcacgattcccacatgcaagtggtgatcagaatataagcagattccatgtttaggttggtgcataagcaaacggcgtactactatgggcctatttggtagagcttcaactctggattttagctctaggagttgggtctggagtggagttgtagagctgcctgaacctagctctatctctgagattttcacccttctattttaagtggagctgaggtgccaaacaggccctatctctcagcaattgctgcatcaacatggagcattggagggccgtatgcccgtatcctgtgtatgggcacagcattgtcggttcctagctatttgttctgccatcccccggtcccaactgattctcgtatcggtccagacaagtccaaaagctccaagctccagtttttacaccatttcgtttttctttaacacggttagaatttataaaccatatcatgtggtggtatttttgtccagagattcacctcagaagtggcgaattttttatcgtaccaaattgcagagacgaatctttgctgagtaggaggcagcaaccactatgagcagccgtcaccatccaaccggacaaaatcccatcaaaaaataaacccaaagaaatcaaaacaaaagcgagcacccaccgatgatcactcactgatctctcatcaccaaacgcctccgacctcgctcgcgtcgcgcgccgcgcacccatccccccggcctcgccaccacccactcccgatcgcccccgtcgccacccaccccctcagaaatctcatcttttccgcctcctctcgccaaccaaacccgcgaaacccccacaaacgacggtggtgaaagaagatgagagggctactcgcgtgcgccacgctcgcccgccgcgccgccggcgcgacgtcgacggcgcggcggcacctggcgggcgcggccgaggcggcggaggcggagctgaagaagacggcgctgtacgacttccacgtcgcgcacggcgggaagatggtgccgttcgccgggtggagcatgcccatccagtacaaggacaccatcatggactccaccctcaactgccgcgccaacggcagcctcttcgacgtctcccacatgtgcggcctcagcctccacggccgccaggccatccccttcctcgagtccctcgtcgtcgccgacgtcgcggcgctcaaggacggcaccgggacgctcaccgtcttcaccaacgaccgcggcggcgccatcgacgactccgtcgttaccaaggtcaccgaccagcacatctacctcgtcgtcaacgccgggtgcagggacaaggatctcgcccacattggggagcacatggaggccttcaacaagaagggcggcgacgtcaagtggcacgtccacgatgagcgctcgcttcttgcattgcaggtgagcggtttctgtttcttgccctctttcatctggggaatctgttggtgattttagtttgcttaattgattgcctcaattgattatacatttcggaaagggatttagcaattgattatttctgggatttgggaatgtcatgctttgagatgagtagtcaatacatggataaaaggtccattcctgtcagatataaggtgggatgtgtagtcactagttagtggatgatggtaagcgaagaaagattcgcttcatatgaagtagtaattttcttgcctacttgaagaaaaactacatatcgtttttattagctggaggattagagaatataagctgttaggcttgtttctttctgcagttttatttgttatattgtcaacgcagggtagaagataaggcttttttcccaggatgcacaatgccttgatgtgcatatgagcaataggtagtaaggcagatgtttgaattttgatggcgtgttggtggaaacatgcggtgacttattatttgttgtttaatgtttagtggcattttcatgatcagtaaatttgatttctggttgtcaaacaatagttctttgctaaatcattattttatttgttatagtgcttttttggaactgactatatattgatttgttgaggtagtggttgagcaagtttgtgtgtccttttcttggttggtggaagtaaagcttcttctagtcctgtgggtttatttttagtgtaatacagaagtgtctaggccatattgtcacaaaacaaactttaagtttcctatgcaatcacgatacaatacacataacctggtttcccttctatagcaactaatttcatcaagaaagaggcagatggatgtctgtgcaaatgtatattcatggatagaaacattgcgcgacatattttgtactttcaaattttcatgcaagattgctgcagaacttgtccctcaattcctactccctcagcctttgtggggttttatcatagtgatcagctttcactattacagcacgtagaaatttaatttttcctgacggcattacttgtttttcacacgaacagggacctcttgctgcaccaactctccagttgctgacaaaagaagatttaagcaaaatgtatttcagtgacttcaagatgattgacatcaatggatatgcttgctttctcaccagaactgggtatgcttcatttgatcctttagccaagttgttaacaaccatgctactacctttgttttgtggaattattttgaacactatgtcaatattctgagaatttcttacagttataccggtgaagatgggtttgaaatctctgttccatcagagaatgcagttgatcttgcaaaggccctcctggagaaatctgaaggcaaggtgagactgactggtttaggtgcccgtgacagtctccgcttggaggctggcctctgcctgtacggcaacgacatggagcaacacatcacaccagttgaggctggtctctcatgggcaattggcaagaggaggaaagcagaaggcggcttcctgggagcagatgtgatcctcaagcagctccaggaaggcccaaagatcaggcgtgtcggtctcctctcgcaaggaccgcctcctcggagtcatagtgagattgtgagcaactccggggagaacattggtgaggttaccagtggagggttcagcccctgcttgaagaagaacatcgccatgggctacgtaaaatccggtttgcacaaggctgggacagagttcaaggttgtcgtccgtgggaagtcctacgatgccgtcgtcaccaagatgccgttcgtgccgaccaagtactacaaaccctcatagatttgtacaaaggatgctccttcggttgaaattttctcatgcaactctcttgtcgctgcttgttctgcagcaccgcaactgtaacttctgtaaggtctcatcttacagcttgacattttacctctgcccatctaataatatgaaatgtgatatgcagtatggatcctttcccacaggtaacccatattttgtcttcagaactggttgtctgcgttggcagttgcaaggccaataggccatgttccccgtctgcaacagatgtcgcagaaagcaaattcagcatctatttgcctcctgtgtttgtctataaactcagatgttcttcaagaaaagaacacttgatagccaaacattaaggaaatcgagacctgtagttccttgatgcaaaagagaataagaaatgtagagagaaaacaaccatgaacttgcagaaaaacagtggacacggttccaattcatagatctgggtgattctgcgtcagcatgataattccacttcagcgagaggctgaagaagctctagggaagaagctgctgaactgttgcgaccgggcctactggtgatggcaccacaggtcagtgaagcaagccatcggtttaaaggggctgtttagttcatgaaaagaaaatttttgggtgtcacatcagatctttgaccagatgtcggaagggctttttggacacgaatgaaaaaaataatttcataacccgtctagaaactgcgagacgaatcttttgagcctaattaatccatcattagcacatgtgggttactgtagcacttatagctaatcatgaactaattaggcttaaaagatttgtctcgcgatttcccccctaactatgtaattagtttttttatttatctatatttaatgcttcatgcatgtgttcaaagatgtgatgtgatgtttttaggaaaaaaatttggggtactaaacagggcctaaggtttaccttcctcttcgtctactgtccgattaaacttaggcggctgagattgagggagaaccagaggtaaaggtgtctttgcattgggaccctcatacaataccgtattgctttacactactaggtccccaaaaagttggatgtccaaatgtcgttctcgccatataccgtccgatctcacataggcggtggatattatgttgggggactcggagtaacgtggcggtgacttttcatagcaactctcgtactgcactgtatgcgtagagcataaaagttggatagctaccaacggtagcgatccagattgccttcaacatgaacaccccacctcacgcagtcacgctcacgagctcacagcaatttgggttgttaagttgtttgggggattgggatcctctgtcgtagcatgtaatacaacagatagttatagtatattgtatatagtatatagtagtccctcctttcctaaatgtttaacgtcgttgattttttaaacatgtttgaccgttcgtcttattcaaaaaatttaagcaattattaattcttttcctaccatttgattcattgctaaatatacttttatgtatacatatagctttacatatttcacaaaagtttttgaataaaacgaacggtcaaacatatttaaaaaagtcaacggcgtcaaacatttagggaatgagggagtattagaggtattgtgtatttttgaatgtgattatagatggccatatggcatgaggcccatggcccggtccaaggcacgccaatttggcccggcccaagtacggcacggcccgacagccagaccatgcttgggccgctcccttggcacggtgggctggcccggcacgtcactgatcgaaaaaaatagtagaggaacgtaaaatagacttaattaaccatataaggcgaggcccaaagacatgaggaatacaaatagacttatttccaactatatgtgcataacccacagagtttagggagcaaaaatatacttattctgtggagtaaagtgctactattcttttcttttcagaaaaaaaactgtgtttattaatcaaggacaattacatgagttacattttctagtgggtaaagttgagagaatagctagttttacataaaagcccctaagtgatgggtaaatacacttcaagaataacatatacgaaaaaaagacctacaaagataaaataaaaagcaatcaaatccttgcaacaaccacataggcgatggcaagatcctcgcagacgacgacggcaggagcaaaagaaacatgtttagttgcaatgggtagagccaaggagcatacccgaacgaggcctcttgatagaggttgaagccaccttggcccataggagaaatcatcagccacattttgcaaaacaaccgtcagagacgaattagacaaccactataagtatgtgagacttgctgaatatggagtaaacaaccgatgcaaccttttgttagacatgctagaggacaagctttcaacccaaagcaaaactcccaattgaaagcattggaggtgaacccaacattcactaggcagaaagatgacgctagcaagaacgtcaatgaggttcgccatgtccatcaagctgagacataaaaatcgaacgtcggtgaccctcttgaggtacacaaagaatgggatgaacccgagaacgaaaaagatctgactaaacctaaacctatctctagtagtgggaggaaggaaccagaaccctctctcctccacccacacacacaccacacgatgaccagaaggccaccggagaaggaaggaaatgggcaagtagtcgagttttttctgcttaagacacctagagcttttaaggcgaagggatcaaagtgctactactttactgcatttattcactgttctcctcgcatcaacaatccccctctaggttactatagaggaaccggatcattgtttaggcgagacgattcttcccctcccgggaagaaccgaagaagcgcgctctttcaacgccgcactgtcactatcagagctagggatggcaatcgggcgctgcgggcacgggtatgggtaggtgtgcccatgagattatttgtgcctgtgggtatacccattattacatgacgggtaaggatggttgcccatgcccatcgcccgcgggcgccttgtgcccgcggtcatgcccgtttacccaccacaacaaaagcagtggaacaaaaagtctacaagcttctaagttcgaatcgaacttaaaacatcaaatattctccgcctcggtgtggtatctctcctctggcggcgatagagtaagggggagagaaataataagggaaataaaagggaaaccgtagaaaacaaagaacgtggcttatgtattctagtggattttgctcttagcctacatataagttagattttgcgggtaaacgggcaaagcgggcatgggtagtgattaccaatacccatgcccatttactcatcgggcatagcttttgacccaataagatacccatgggtataaaatagagaataaacctaaccctaatagagtttttacccacgagtaaacggacaaacgggcacaattgccatccctaatcagggcgggcaccccacgactcaggcccggggcatattcagatattctcgtgccaccggtacggtgtgccaccaagtctgccagctacacggaattgggcaaatagcgcgctgcagcccaggccaggcgcacagaccacgacgactcgaaggcaacagcggcggccgcgcctgacctcctgcgctagcctcaccaggccgcgcacgcgtgtggcgtcctcgtcaattccgcgagctcattggcacgcgtgtacgatctgtcgcgccaagctaggctgcaccacgccccgttgccgcggaagcctcacaactcacagcgcaggtaggtcgatcggttgggctccgtctctgcacaattagtcgtgcgcccacatgcacgcgacactactacctgcgatcgagccagtggtgtggccgctgccgcttgtgggcgatgcgtgcaactgcacccgcgggccgcggcgccgatgacccaagtctcgcttcgcgggcgcatgcacgatgatgcgactggttgcattgcgaggtgcgggtgtcagtggtgtgtgggcgatgcgtgcaagtgcaacctgccgcagacagccacagaggagggggggtctacaagctgcgcggccggcgcaggggagaggcagaggcaggatcgcggtccatcactccactcgtgagcacgagtacatgccatgcttgcttaattaccctgcctgacatcgttcactcgccgggggtccaaacgtacgcacgccgcctcccccggcccctgccaacttatgcttcgtgtcgggcaccaaactctacgattccggagtaaattttctgactaaagttactcggatatatatcaaccttaattttgcatcctctgttctgtttgttccaactgagtcatggtcaatgcaactcgagcacatatctcgtctgatgccatgttgcttccaacatgggaatattttcgattcctatcaaaattggaactatcttgttacagcatccctccttaaatataagagattttgattgaatgtgacacattctaatacaacgaatctagacataaagcctgtctaaattcgttgtacttggataaatcatattcaaccaaaatcatgtgtatttaggaacagaggaagtaatttcaagccgaattcaagaaaaccttaaccgcgaaacactagtaccgcttccaccacctctctcctggatttttcacattttggtccttttaaaaaacttatttcgcaaatagacccctgaaaaaacttatcccagaaatggtcctttttggggcgccagagtggctggcgccgtcttcaacaggacggcgccagcctctttggcgccgtccccctgccgacgtggcggggccatgctgaggtggctagggggag

SEQ ID NO: 69456 - DNA, 1656 bp, Oryza sativa
ctccccctagccacctcagcatcgccccgccacgtcggcagggggacggcgccaaagaggctggcgccgtcctgttgaacgacggcgccagccactctggcgccccaaaaaggaccatttttgggataagtttttctaggggtctacttgcgaaataagttttttaaaaggaccaaaatgtgaaaaatccagcacctctctccatgcaattatgtaagagtagttagctgcacctttctgacagatccataccaagcggccagctaaccatcggttgggccccaagtgaaattatcacatagaatctgcaaggctagtgacttttacttgatgtaaaagaaaaaaaagtcttcctcggatgcgaggtgagcttcttgcttgcttctgcggacatatttatgtcgctcagggcagttttcttcagagagaatggcctgcattttattgcccatggttagttatgtcagtcacctgtccagtgccatgccactgcctgactggcataccagtagacagtagtaggagtagtagcctttgatcataccaccagtactagtagacagcagtactgtactcctactccctatgtgcctccctccgtcccagatattttgattttttctcgcactaccattcgtcttatttaaaaaaaataaagttattatttattttatttgtgacttactttatcatccagagtactttaagcacaatttttcgttttttatatttgcataaattttttaaataagacgagtggtcaaacgatacaaacagaaagtcgaattcccttatattatagtacggagggagtactggatgtggcacatcctattactacgaatatggacatacatctgtccagattcattgtactataatatataacatctatttctagatttactttttttttacggagggagtatgtgcttaagttaatgatctcttttgactactagctccaacctctcctattacaacttcccttgagagcaaggctaataatatagctgacttgttggctataaggttatttgcaacattctctcaacccactcatataatagttaactcgttataattaatacagggaccacttgtctctctcacatagtttcttggttcttgtgtccaagccggctgtaagtttacagcccgcttctcctctctctcctccacctcagtatttagtcggtttaaagcctcctattatatttgctctaagaaatagaatggcacattgcatgataatacatgcatgacgctgttgctgctagcactctaagggcaagtactataaacctctacgcacttgcccctaggtgccatgcttaagctcacacgataatgtggatgagagatatgaaagaagagagagaacgagccacctcttatgcaaagagcaacttctacacaaactccaagagagatgagaacaagagaccaatgaattgataggaaacaaataaagtaaaattaatattgtgtattggggcaagtgtactagaggtaatttgttgtatatattgcctcttaattaatgagttgatgatgtggactaaattaagggtgacctccactgtaaaacctgactgctggttatcgtttgctactgccaactccctctgtccatttttttaaaactagtaacat

SEQ ID NO: 69457 - DNA, 1465 bp, Oryza sativa
ccagtttactgccgctttcgtccgcttctgcgagctcctccgctaccacgtctgcatcagattgacttcacggtttttaaaaatgcccaatcgtcctaacgatcattgggcgtgcgaaccggttttgttagttagttagctccgcctaatgaaatcactaccaaaccgccctctcttttgtttagttagctcgcatcgatgtggtggtgccaagtagacatgggctaagcactatgccgttttgcaaattgctgctggtgctgctgagatggtggctagagaacggcactgtggttaagatcaaagcatttcactagatgtagtgggcgtctccctttactttccacccatctcctctccttttctttctctggggcttcgggtgctcgttgattgcacagtccccgggttattttagaggcgaacaaggtcacgttctagagttcgttttctgcacgcacactatgagctgtactttttggacggacatgcatggagtacatgctcctcttctctctctctacctcgcttccctgcctgctttattcttgcttcgttttggttcttttttcccttattagactccagcactttcgttttttcgaaaagaaaaagttgacggcagcagttgggtcaatatcgtttcgatggtggatattatggttatccgtcagttcgacgggcgggcaacggtcgtactcgtacactgtcaagcaatagctcaaagatcaatcgtaccctgctgcgcccttttggaaatgaacacggcagtctttgcacgtgctactgcgatgttttactcaggagatcacaaagacaactctaaactcagtttttttaaggtataaaaattactgtataattaaagatttaagagatctttatattacctgtcatatggtgggggttcttttagccatacatgcacatcatatttatgcgcatcatgaaaccatgaatgtaccccttattctaagcaccagggttgtaaacaatggtgcacatcaccatttcagagagaatgctacataatgtttttttctcatgattatgtgaagtataaagaaagaggagagaaatagatatcatacttattaatatatagaaatatactccctccgtttcatattataagacgttttgactttgataaaagtcaaattgtttcgagtttgattaagtttatagacaaatagtaatatttatactaacaaattagtttcatcaaatcactaattgaatatattttcataataaatttttcttggtttgaaaatattactatttttctataaacttggtcaaacttaaagcagtttgactttgactaaagtcaaaacgtattataacctgaaacgggagtagatagtagtcatttaaacaattttttgtgtcctgcaataaatagcttaaccaagcattaaaataaaacggtgcaaaagaagattccaatggtttttaaagg

SEQ ID NO: 69458 - DNA, 5683 bp, Oryza sativa
  unsure (1)..(5683): unsure at all n locations
aaaaaaatcaagaccgataaatccggtctcggttttttcggtctcggtctcgatcagaccgaattcggaggagccgagccagagggcggagacgacgctggcgacgtcgaggcggagggcggagacgacaccggcgatgtggaggaggagggcgaagtggcggtgcggcccgatggatccggcagtcggcggtccacgcgaccggcgaggcggcgtggaggcggagggcagagacgtcgccggcgatgtggaggcggagggcggaggtggcagcgtggcgcgatggatctggcggccagcggcccgcgcgatcggcgaggcagcgtgaaggcgaacacggcgccgacgatgtggagggcggagggcggaggtggtggcgcggcgtgatgaatccggtggcccggcgcgaccgacgaggcggcgtggaggcggagggcggagtcggcgccgacgatgtggaggcggcggcgcggcgcgacgcgatggaggcagaggaggtgtgctcacacgggatggaagggagggcggcgcgatggggatggggatggaagggagggcggcgcgatggctggatggatggggatgcagcctgtgggttgtctctagggtttagtggtgtactgggcctcctggacctattgggccacaatttgattttctcggttaattcgattaaccgagcccaataaccgaattacccgaacaaatttcggtctttgacatgttgagaccgaattactacccgaatttctcggtctcggtcttttcggttcggttctttggttcggtcttattttgcccacccctaccaattaccataatccattttttcaataggtaataatcgatggttcaattgatatcgcccaatataatttgttaccactgtcccttttttaaattgttccaggagtatgacatttggttattatttgttagattgttccagaagaaaacatcatcttctcttgaaggaattaataaccgtccaatacaaccaactaagacaaaaattaacacatttctgttttgctttatgaggcctagtggtaatgggacccactgcttactccaaaggggaaaattaaataagctaccgtgatcgcgatcgatggaaatgcattgtaatttttgcaaacccgaacgacgaagtaagcgcccatggatccatccgtctcctgattgggacataattaagaagaaaacttggttatgatacaaaacttacaaaaagggaccacttgaaaaaaaaaataacatactgatatctgatccaattctttaggctgtgctttgtacggggtttggaggagatcaaaatttgaatatcaagcacatagattttacttcatatatataaacactgctaatctcaggaacaaattagtaaacacagggaaacatgttgattcaatgataaagtcatgggtacatggctcgacttgatagagttcaatcttgatgactataaatattacatacatatgtgtgtgttttgaatagaaatttaatgagcctagagttttttggaattttcttggaatattatgcataaacgtgtacctttgggtttttaacgggcctaaagaaatttcaaaatatacgcattgtaaatattttcatccgtttctttaagaattagggagggctgatctccgtctatttaaactgtttgttccagaagctgtgagtgtggtatgtaaaagtataattaaagagcgaaaggtgatatttgtatcattgttctcctttgtttgttgtgttgtgttgcatttcttatctttggcttggcaaaatggcaaggtgcgtgccgtggtatccaccttgtttgacgtctcattgtttagtgtctcgttagatgttgaggtggtgatttgtcagcatagacgtgcagctaacagattttacttgttcgatagaataaacctagaagattacagttggtgcgattaaattagaggactcttatctcctttcacgcaaattaaatatagctactagccaacgctcacgccggccggacaagttgaccgtgtcattgaaggaaaacgtaccatatatacaaaagagaggcgaatttgatgtggatttgttttttatttgaccgtgtgatcttcaatgtatgattggaggagaattcgttaggtctacctcacttttttaagttgcgtttgccaattgtcaattttgacttttagatattgattcatagaaaaatacagcataagaaaggtaaacagcgtggattaattgggctgagttttgggtcaaagggaagaaaaattacctcagggtcaaagggtagagtttggcttgtagagactgataggtcaaaaggtatgattctactggcaaatttttgaagttttcttcagattgcaagttgggtgtacctgcttttgaaaagattatggatcttatagcagagcattgatggtttacatgttagtcctccatccatgtagtcgcaaaaaatatatatttgtgaatactccctccgtactttacgaaagtcgttaggacagcgacacggtctccaaagcacaactttgacttcttatttctataaaaatatttattgaaaagtgatatatgtatacttttatgaaagtatttttcaagacaaatctatttatataatttttatattttcaaactcgacaacttgagagttattcatgatttatatttctaagttttgacttaaacattgccctaaacgactttttttataagtacggagggagtactaaattacagaaacttaatggtaagaattaaatttcagaaactaccatgttttatgtccccacggtctcaccaatatcagaactgcttccctcattagaaagagtaatgacttgctgtcatttagtttttttctattgatatatacaaagtcataaacgttgtaccaattacaagatattcatatctttatgttgatactttattttagtcaaagagtaaacaattcgatcacgactcaaagtattcacgaccagatcgaactggacgcagtagctcattacagtagcggattaaaaaagaagtcgttaggctcactagtcaaatatatagtatgtcaaatttgttacaggacactaaaagtatgtggactttaatacgagaccacctaaagaacgtgtattttttcgtggacattgtaaaatatggtaattagctattagacacccctggattattttattatatccggtcaatatggagagaaagagcgttgaaagtaccattttgcccctaggttgttttggcttgtaaagacgactaccactggttccaactagacccagttcactccccacgcacttgatcctctttgctcgaaccctaggttttggggcaacgatgacggtgcgaaggcgacacggggtcttgacgctggcgtgggcttcatggtcggcgccgtcggcggcacgttcaccacttgtttaggggccttctgtgactccccgtgcggctgccactttgccggcgccatccatgacggcgttcccgtgtcgccacctgctgggcccgccttggcgtctatagcgccgccttttctacccactcgtgggcgaccgataggaaggacgacccactcgtctccatcgctgccacgggggccatcgtccgcttgtgccacgagccgctcgccgtgggacatatgccacactgtcgtcgacacacctaaacctagggtttggaggagaggggattgtgaaactgaacgggcaattggcctgcttcgaacgtgtctcggacgggttaaacaacattggcccaagggcaaacttgccttttatttaagtttctctctccatcttgactggatataataaaattatgcgaagggggttcatcagctaattactacatgtttgcggtgtctcacaacaaatgccataaactcttagtgtcctatagcaaattttgtctatatagtaatcccttcatccaaaaaatagcttcagttttaacctcttagttatctctactattattataaanattgaagatgttttcgtcaatactttggtacgtcgtctttatttgtgtttgtttttaagttcgttcgtttttggaaatacataaagagtcatataagaaatccttttaaaaacctcgcatgctaacttcggacgaaaggcggactcctaattgctatataattctcgctagaccataaaagcaacgtatagaatacgatcatcatcccaataaggatcatatcataataaggattccgaattagatatcaatactatcaaaataaaaatcccatatatactttttagaaaaaaaattaacaataatacaattaaaatagccttcacccgttgcaacgcacatgcattttttctagttctaaaataagtttttttatatgctcttatctgtcattatcgttagtccgtaaattaataaattttatttttcaataccccttagagcaagtttaatacaataatatatccaactattagcttaaaaattgaaacatcatctgtagccaacctaactcatacaatagttagttgtagatatgtactacattatttatacataatttacacatctcgcttgcatagtttattggaacccgtgctatagttagttataaatttgtaggccgagttttttctctctcctccacataaatataaacgtgatgtgacaacttgtacaacccgcttattgtactcgctcttacccacctcttatataccactcattaatattgttttttttattaatgaggatcacattggtatttctccgtcaccttatttaattttgcaccacgtagttaaagttattttgtgatggatggagtagtgtcagagtgtgttataagaacattttccaatttctaatgtgcattagtagttttttttttgcatgggtattagcactccctctgtttcatattacgagtcatctagagcaggtacaatagcaggctataagccagctataaacatattttaaagagataaaagaagagagagaagagcatcgggctacagatctgtagccagctgcatcacggactccaagacgtaatgtgtgtatgataggtgggaccaggtattaatagtatagtaagcaactattgtatgaattggctattatattggctatagatgatttggagctagtagtgggctatactattaaactttctcttataatgatgcacatctaatcaatatttttaaaaacatactatcaaaatatattttgaatttagtaaaattaatttggtgttatggatattgttaattttatttataaactaagttaaatttaaagttttactttaaaagaaattaacgtgcgtcgtaatatgaaacggatgaagcggtggattagctatagcctataagtcattatgacccccgatacttacgtgcgagctaacacgcacaaaagtcaaaagtcaacacagggagtttgcacgtctcagccgttcgatcccttccgcgtgatagaataatcctatcgagcaggaagagattattagctgggcgcatctcaagtaggacaaacagtctcatcaccaccagcgacgtggcagttttggcaccaatgtcgtcgaccgatttttccccgtaactcctcccccgcgcgcgcgcgactacgacgcgtacccacgtccccgcacgtttactaattt

SEQ ID NO: 69459 - DNA, 4352 bp, Oryza sativa
gtgaacccaaaccaacgcgcatgcctacacaggcttggggggctctctatcccgatacggcaagttaaccgttccgttcaacaaccgcgaacggaacacggtggacggagagacgcgcacgtaccggtcgcgcgcgcgcaaagatacaaacgcgtccctttctctctcgcgcgcgcaccacggaaaattgagcggcgcgtttacgggagagaacggcgcgccgagactcggttcgcacttggcatgtacgtaccaccggccggtcagcgtcacccatctgctgctcggccgcgtggttgttagcccatgcgcgcgccgccacgcctacgcggttactcccgatcgccaattaaaccacaggtttctcttacgtgatggtcgagctaggtggaattagatggatatatatccggccggccgtacgcatgcgtgcatgcaccgttggatcactgtacgtacagtgtacacacactgtgccacgtttcgattctgtattcctgcgcgtacgtacgtacgctcccacgttggtgtggccattattgattcttcacgatcgaacagtggcaggaaaggtacgtactactttcttcgcggtcgctgtagtatgattgtctgcgcgcgaccgtggaaactgaaaggcgtacgttccgcgatcgcgaaacatagaagatcagggaaaagcggcggcggcgcgcactcgatcggttggttggctgtttaagcaaagtgaatccctcgatcgatcgatcgcttcttcttctgctcgtacagcccccaaatcgttttcatgacagcgagcgacgcccgaacctgcccaataccggccatctccagcaatttttttttctctcttttggccctttcgatctctctctctctccccctcgcgtctcgccgtgattgggtttggacatggacaactactaactcctcttgtccttttgtttgctccaaaggttccctcgccgtctcgcgcacgtacatgcgagatcaccaatgagccatccatgcaacagggccactaacgacgcggctgtatgagagagtgaatcttgttggaatgaaaaaaaaaaagcgagaaaggcgttgggggcagttaacgctccacaaactccagagctgagggtgacagccataatagagacgatccaggtgatggctttacacgtgttagcttattttcccgaaggaaagagcattgaacagctatctaaccagggcccccttttatttgaaaactcagcacctgtaccttgtagatgaattcacgagttttctttatgttaaaaaagaggggcccgtgtttagttaaccaatggcatgtcacggtagatgtgttcattttgtacttgtgtactagtaattaatccccctgttgtttgatcccacgtgagtactttggctgttatatatgtcacttagcaggagtagtagtacagcaactagcagtattctctgtcttccagcgaattgcatgcatggctaaaatgattacagcagacgttttgccatcacgagttcacgacatatgattactcccactcccactcccacaaccatctctctgcgccagcgctatcacgtagccaacgccgctgcatggcaaaagttgattgctccctgtgcctgacaatgagatgggcaaagaggtacgagccggcccattggttggtgttacgttccctcgtcattgatcccttaggcccatagaattgtggaacctagagtgatttccatgggaacatcgcctctgggtttcaagtttccgcactaacaataatttcccctcgcccaagaaattagaacacgcaagtcacctgaaagtctgatagtaatatggccctgtctattttgcacttggtattgacagcattttggaatatattcattttcaaataagttcaattaagattcatatatttcagatggagatagttagtttacagggactgttttatcttaggtgatgcattgtgcaaactgcgaataattagatagaagagtgcgaggacgaacttaatgggctatatggcgtttggaactgaaaacctttttccgctgggctgtcacggaaggaataatggaacttacaggctgtccctggatgatgacatctatgggctatagcttaggctttttgacgtcgtttgtgccgtgataagtctattttgcgtcctgcaactcttgctcctagctgaatcgcatccctcaactacaaaactggatataacgcatccttttatttaaaaatcggtgtaaattgcctccttaggtggtttggaaggtggttttatctgacgtggtagctttgacctagttgactggctaactcaactgtggaccccacctgtcaatgatatactccatcctatcctctcccctctgtctttcctcttcctcctctctcacctcacatcagaatgcagggaggagctcgtcggccatgctgtgcgggggccgtgggtgggggggggaggtgttgccacttttgccagctagttgttctcgtggggaggagctcaccagccgcgacatgcacaagggggagggggtccccagccagtcgagtgcgcggggggaggggtcgacaaccatggcgagtccaggggaggggttgccggttgcagcgcgtgcaagaggaggggtcaccggccgcgccgcgcacgtgggaaggagctcactggcctcatgaaaggtggaaagtcatacatgttttttccatgtttcactgacatgtagggcccactgtaatatggtttttcatatctcacagacatgtgggccctacatgcaaaaaccacttttcaaaccatagaaggagtttatttgcaccggttttagaagataggggatgcgttacaccgggttttgtggtcgagggatgtgcttcaatcaagagcaagagattagggagtagtaataaacttattcctttgtgccgtgtgttgcacacaccgcacaacagctgacctaaataaaaggctttatgggccagccattttagcgtcgaataggcccaaatatcggtcatgggcccaacaaaagcagacccccaagaaacttacagaaaaaccttctcctgttgcctttcaatcattccccaatcaaaaaaagggtaagtttaccatcctttataaagtagaaaatatggtacctctagtactaatactatgtatcttaaggtataaggtataaaaaattttagtataaaatttaggtacctcaagatactttctcaaggattgtaaaattcctcgtcgaaaaaacattatacatgcagcaggagtcatctcctttgtgttcagattttccattgaaaaaaaaatcacgaatattagggatggacctaatatcaaataattaggagtgaggtttcgaacccaggttgtctagcccatcaccttgtggagctagccggaaagcggaaaacccttagacgtttctcgtttaaattttccattgacgagcgattaaatttacgtttttttgcgggtaattaaatttacgttttgccatatgcaggtttcaggtaataccattgtataagctattttgtcttaaaatacggcatggcaatcaatttcctcatggtgattatctataaaatgttatcttttttttgggggggggggggggggcaatcttgttgtgggaatttgtcaatagtaatttccaaacaatattaacacgcatttgtttaagagcaatttcgtcataatgttcacataattgtcaagcaaaattttcaagagtacattgatactcatttttcttccgattatcaatgtataaatgtggacaatcaatactatttctgctacatcacatgaggaattgggctagtggagtagaatcggtagaaccatgatgacgatagaataaggggataaaatgacatgtacattagcatttactggaactttcacagtttcactcgtcgatggcatgcaaaatgcaaattagacaattgccaaggggaattttttgatgtaaaagaggcccttttgctctccaaggagtcattataatgtttacccggggcttggaacgctcaaactatcttgatctcttctgaaaatcctgcgtgacgaacttaaaattcttactggtagttacttgaatgtagcacatgttcctagatcgtcagttgctttggcacatggtacctggtcgatcgtgggccaaaactcaggaaaagaagcacggatggacgggatggtactggtaggagggggcctgtggagaccattggcagatcgggttcatccatccatacgcttttccggaaaaaaacctcgtgacacccccgaaccaagcatggccgcgacgccaaccccaacccccggtcactg

SEQ ID NO: 69460 - DNA, 889 bp, Oryza sativa
tctccttcaggacggcgaccttggcgtcgatcttgtcctggccgatgcacccggcggtggagagcgcgtgccggaacatctgggagcccggggccacgccgagctggatggcacgccgcacggcgtccttgacgtaatccgggtgcatggtgacaagccgcggcgcggccacgagcagcttggaaatatcacgagcacttagcccgcattccttgaggaaggagacgttgggctcgaccaccttctcgaggtcggaggtgaggagccagtagttccagtcgctggcctggagaagcctctccgatgagccgaagagggggagccagaaccgcaccttggagacgaagctgcggcagaggaagtagcggccggtgatctgggcgaggcgggcgatctgggagggggagaggccgacggcgcggagctccgagcagatgggtgcaagggagcggtcgatgcgggcgcacaggatgcgcgggttggaggcaacaatggccgcgacctccttgggggagaggccgaagtcggcgaggaaggcgaggacggcgtcggggttggagcgggacttgaggtgggcgatgctcttggacgccttgtgggcctgtggctgggtgagattgcagttggagatgaggtattcctcgacagagaagtggttgtcgggcgcggtggtggtggtggtggtggcggaggcggcttcgggcgcggcgcgggagaggagctgcaggcggaggcggcagcgggtggggaggtggacggcggcgaggggagtggaggcgaggaggaggagaggcatgggagcgaggagcatggccgctcccatggccggggaggggagacgtggcggggagagagtgggtgatttttttgaccgaggttgtgtaatccg

SEQ ID NO: 69461 - DNA, 1824 bp, Oryza sativa
ccccaccctctccgcccccgtaaccgcgcatcctcctcctcttccacctctccccaccctccctctccgctcctccgcctccgcctccgcctccgcgtgctcccgtaaccgcgccgccgcagcctccgcctccgcgcggttcctcccgcaagcggcttctccgccgcgcgcgtccgtttctctcccgatccccgccgcccgggggggtgccgtgcactcgtcgccgtcgctgggcgcctgccgtgtcggcggcggccggtgggcgagattttgtcgccgcgcgcggggcgggggcacggttggttttgaggcgagattgattgccaggtagctggcgtattgtcttatctacgtttgtcctcgcttctcatctcacctaatttacatggtttgtttcggttgaattgttcatcctttgttcttgtataatgggcgacttggagaatttaggtcaaatcagtcggatgagcaatccgtggttaataccggtttgatggcactaattgtagcttacttggaggggtggagttttgggactaaagcatcttaggcgtcagatttgccgtcgaactttcaaccatggagaattatatggagcaacattaattttcctcaggcatactgttgctgcacgataggatttttgttctccgcgacctgttaggcatcatgttaattttatttattttataattgcttagttagaaccgccagcccttgttcatctaggaagggatacatcgcgagacagaaaaaaaagctaattacacagataagttgatttgccctggaacttgatttggtttgatgataaagtaacccgtacaagaagtatacgaaccatttaggacccaatgagagcaccactttgttcaacttcaatttctatatctttaatcgctatcctcaatgattaatggcaactcctaaaaatgattggttgcagtggttcacattttagttccgaaagatctgtgctgaagtggtaccgtggagtagctttgggcattttctgtggtttatcagtttcatgcgttaagttaagacctaggtttgatttaatgaatgccatgttctatttattcacaaaaatgatgtttcattaatcgtttggccaagccttcattattaatcagtttttgtgaaatttaatttgtcttgttcttggattgtaaattttaattatatagatctcattcgactgaccttggtgaagctcttcacaatatcttgcaaattgagttatgtatacaaatgtgatcatcaatttttccacacagtagaatgatattaatttatgatctcttgcaggttcacaatgaatacagaaggcctggattcttgtgtataggttctctcttctgagagacatcactgaaaattctcacagaatgttggagggtcaatcttgcttgatctcaaggtctttgccaagctcctgtgatcaagaatccagattagcatacatgacctaccacctccttgagataacgaggagtaagcgcatatcaagtactccgaggattgaacctgatagtgttgctgcagtagcagtactgaccaaacgacctaaatctgccaggaaccatgagtgtgagcagctggattgtcaaggcagcaatgatcagggtttttcggattcaagtaccctaataagttctatcggtcgagataactcaatcagttgcctcgcccgttgctctcgttcagattatggctccattgcatcagtcaatcggaacttccactcacttgtccgcagtggggagctttcaaggaacggcgtcagttggggattgcagagcattgggtctatttctcctg

SEQ ID NO: 69462 - DNA, 2049 bp, Oryza sativa
  unsure (1)..(2049): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtagttacttgaatgtagcacatgttcctagatcgtcagttgctttggcacatggtacctggtcgatcgtgggccaaaactcaggaaaagaagcacggatggacgggatggtactggtaggagggggcctgtggagaccattggcagatcgggttcatccatccatacgcttttccgggaaaaaacctcgtgacaccaccgaaccaagcatggccgcgacgccaacgccaacccccggtcactgtcgagtcccccgcctagctactcctcccggcacacgctcgcagctcgctcatggaaacgtcgatgtcgacgccgctccatatccggtaaaactctcgagcagatgctcttccgattcagtagcaagccgagttggcgtgcctctgcgtgtgatgatttgatcggtgggtcgcctgctttgcacgctgcaagtcctcctcgtcgggttcacgcatttccctagttcagatggcacatcacagtctcaacagaaccttaattgtctgattgattcctcagggcatggtggaaacagaggacatgcctcatgtacgggtcaagatgcactatgtactatgtgcagtacatgtacgggtacatattgactctcgagcagtacaattcactacacttaatccaataatatctccgtcccaaaataagtgcagccgtggaaatccgtgtccaacgtttgaccatccgtcttatttaaaaaatttatgaatttttttttaaaatagtcacacataaagtactattcatattttatcatctaataacaataaaaatagtaatcataaaatttttttcataaaagacgaacggtcaaatgttgaagatgaatagtgtaaaactgcacttattttgggacggagagagtagcatagattcagagtactactgtaccagggttgctgccatccggactcatactcatggttcagttcggcgcagagcaagtaatggacgaagtcatgcaatacgctgcagaaaaatgcagaattgaaaacgttagaggctgagacgatgttgagaacaaagagtgataaccattcttgttcttcagaacgaagtcgtttcttcaattcttctacacacccagcaccgtagaagaaagcataaataagatcattacagcaaccaatattgttacttcatcagtcctagtatgaaacagtcgtgtaattcccctgtacacgttctacgctaacacaacaccctcaagcatctcacaaaatcacactacagatcccgcaaaaaagctcgagattttcagcaaagcgggcagcgcacgagcccattctcgttgcagtcggggcagcgccggaaggtgtccagctcctcgaggaacaccttgcagctgccggagcactcctcgcacggcacgaaccggacgccgccgcagccggagcacgcgtccagcgcaatgcccttgcccgcggcggccggcggcgccatctcgcagtcgcccagcgccttggacagctccccggactcgtgcatgcggcggacctcctcggcgccacccaggtgcctgccgtccgcgaacacctgcgggaggctgcccggcgcgcccagcgcggcgtggagctcctccttgaacccggcgtgcatcgacaggtcgcgctcgtcgacgagcacgccgtagccttgtaggatggacttcgtcgcccagcagtcctcgtacgtcttgcggatgccgcggaggctggtgaggtacagcaccactttccggtcgctatcaggcggcggcggtggaagctgcggctctggctccggaggcggtgacggtga

SEQ ID NO: 69463 - DNA, 2904 bp, Oryza sativa
gaaggggctggacgtccacccgagagaatagaatccatcctccgcttgcgcctgcgcgtcgtttgacgtttggaacgagagcgagccggcgtcagaaagtttgagccggacccggccaaagcttttacacagtctaacaccggcacgtcgttctcgtctactactcgtaacacgctcctcgcttcccacaacatttgaatctttgaacggctctgcacgatcggagccagtctgggttagaccagcgcaagagggatttgaatatttccaagccttttccgggcaaaggagtatttgagtagtatgtttttttagtagtatgatgcgtcggttggtggtgatcggtgactactctgccgacaggcgaggtcaggtggtggacgtgagcgagcaccggtttcctccgttcccttccagatgagaactgagaagaggagagtggtagtcttgcttggcgcgtggttggcatgtcgctcgagcactcacctgcccaggcgtccatccatccatctaccagctcggcttcttcctgctttcctagtagtcggtggtttgtccgattcctgctagccttttgtttttgcgtagtgcactgcacttcccagctacaaaaaggagtattgctgtgcgtgagcgtgactgcgtgttgccaagtcctcctgatgagaccgaggtcgaattttttactccctggtccgaaacagggtggatccggaacggacgcatgacagatatgcctaatctaccgaattggagctgatcgggacaggggatcgggattgttgctagcacagttggaccaccgaaacgggacgggggtaaacactgaagattggggtcctatcccggcaagaaaattgacatttagccactttcaaggatgggctgcgctgtaatgccattccgccaagttactttgctaaaatgccattcccacgctcgcgcaacacgctgcttcgccgttttttcaatttcattggattaacacacaaaatcacgagtgttgtgaccaatgtgcccttggtcattctttaggtcagtgagacaaaggggattgagagtgagagaaaggggatcgagatgcgtcagctcttgctcattgtggcgccctagatcgatctcgtcggcatcgccattccacccgccgccgcaatcacctctcgccctcacccagctgtagctcacggcggcgctgccatcgccattccacccatcgccgccgcctttgccgcagtcccccctctcgctgacgccgaggacagtctccggatgccgtcgtccctgacatgagataggaacaaggtggagtcgatggattgtactgcacggcgacggcggcagagtagagtggcggcggtggagcaaagcggcacaacacggcggcggagtagatcggcagatcggcgacggagtagagcgacagcgtggcggcgctggagagagcgctggattaggacggcgcttgctgcttcatttggcgcaaaacgaccccaggggcaatttggtcagcagacaactcacttacgggcttaaccggtgaaattggaaaaacgacgaagcagcgtgttgcgcgagcgtggggatggcattttagcgaagcaacttggcggaatggcattacagcgaaacccatccttaaaagtggctaaatgtcaattttctctatcccggcagatgctgaactcacactgctgtttagtgcagtggaagtagcatctacaccagtagtacgaagctgtttgtcactgacagttgattaaattacggtttttcctttttgttggttgattgatttccagtattatattaggtagattttgcaaggtctatcgcagctccaactctccaaggaatgaatgaacaatggagctatgtactccctccgttaaaaaaaaagtcaaaccctgaatttccgtgtcaacgtttgactatccgtcttatatgaattttttttataattagtattttcattgttgttagatgataaaacataattaatactttatgcgttacttatctttttaatttttttcatatttttttaaataagacgaacggtcaaatgttgaacacggaaacagggtttatttttttttgggacggagggagtactgctttgcagcagatcattaaacgagcacatgttatcaatgctggaagcctgaatccggcaactcggcccggctagtcgcggggatgtctctcatccatcatggatcaaagctgtcatgttcgcccttagctaatccggacgaattgaatgacacacaccgcctttcagttagctgcttgcctgctgaatcaggaaaagggaaaaggctgatgatgatgaggatgcaaaggtcgacgcctaaagtgaaccgagatcgagtgcaaccggaccgaagctcgtgggcgaccacttgccgctacagctcatcgcttccgttctttccagccatcccggttaatctaaggctcatcagtccatggctgctgctgcactcatggtatcgattccgaggccgtctttgccggctcgtcggatcggtatcaccatctaagctggtgatgcgttcaattatctgaaaaagctagtgatgtgtaatgtgttatactgtacatgtccggagaagctagtgtgccttcctatcactttctgggcctccccgggcacagttcggcgtcgatgtcgccatgtcggtggtgggtcacgtacggtgtcgtcgacgacgtggtctgttcgtgccgagaatctcacgcaggaggatgatggtgttgccgtgttggccatggaccaatggacgacgaaacgagacgagacggtgcctgcctgggatggacatacactggagtactggacccatgaaaaccctgtttgctatttattgggcttgttattgcattagtagatgggctgcagga

SEQ ID NO: 69464 - DNA, 2061 bp, Oryza sativa
ctctcttcgcccgtgactccatcccctccctagccgctgccctcgcggcctcgccatcgccaatccctccatgccttctcgggctcatggtggaggggcgggggctgccttcggtggagggttacagccgatccccatcaacagcgcccgcgagtgaggatcaagccgccgctatcgagccaaatcaggcggacaagctgagctgacggtgtatacgggaggtagagatggacaccagcgacggcggtgcgttcgatccacgcaaaagtgaccttgatagcatgtggcgggagaggatcggcggtggcgcctgagatgtcgacagggaacatgcttgcagatctctcttccgtcaatggctaccacgagggtcttcccatggtgcttgcccacattgccacctacgccgcgcttgctcttcccccaactgtcgacgcccggcaccatagctgccgaggccaagaagatctggaccatctggtcatctttggcgccatgaatccggccacttccgccaacggggctgctgccatcatcgaccgccgtctcacacggttcaatgggcatcatcacacgcctatgcttcatgtccttctttactagcaggttaaaaaatccttatggatttatttgctaatcatctttacctaatacatatctggtataattctttgttgccttggttttattactatatttttaggtcatcaggtggagaagccatccatatgctaaataggtctcaagataggagtgagcagcaagttcggttttcattgggccatactcctcatctgaacaaacaggtttacatagtttacatagttgttttacagcctataataggaaaaagaatattggatagcttgttattgtgaggtgatcttgtttgttgttggatgatattaattgattgattgttttattaggaattctcggcaggtgtgttgatttctattttgcttaattttgtttaattctgcagccatcatggcccagggagtataaagttgaatagagcggttgcgatgacggcagctcagctcaacaatggcactgggcgtgcactgggaggtatgcttaaaggagagtgttgtagcatttgcatttttggcagttaagtttgagcactggatacaaatcattgatcttctagaagtaacattttgattcctgcaaactaatgcggcacctctgtctcaacactgtcatcaggccagtctgctccccagtttggcactccttgtggtaagggaaacgaggagaaagaaatgaccgaccaacaggttgtgaaagacaccaacgacctgcatcacgcaaataaacaggtatttattattttggttagtttggtttgttgtgcagatattaattaaggccaggggtaggggttgaagacttatggatgaatccggtaccgtaaccttcacatttgaccgttcattagtagctaaatggacggctaccatgcatctgatacatcaatctgtaggctaatgacatatcttgagttatagcgatactttctttaaacaattgctatctttttatgtactgaaatttgcataatccttatgatgtgtttttctttaatcatatttatgtaattaatacatgtagaggataagaagagagatgattagcttctgcatttctgagatgtgaatatctaactaggtatccagatcctaagaaaaaatatcttcagagaatagtatcaagcaaatattcagagaaaacagtgggcccattttttttggggtatttcataccattaatcgtagcattcggcagttctgcagttatgtatactttgcacttctattgtgcaaatgttatgttacaatatatatgctgttctgaaggtccatgaggaaattcttgctgcaatcacagaaacagaggagggacctctccatttgaaatgctctaggctacataaaaaactgacctaatcatatgaaaccttaagatagtacatattattattagacaatatgttggtcttttcttgctaaacctgaattgttatattggtgcatagtggaattagtaagatcg

SEQ ID NO: 69465 - DNA, 6686 bp, Oryza sativa
tggattacttctagacaaggtttgcttcttgcttttctatgactgacatgttatagctccgctaaatgaagtattattacaattttagtggagcattatgatattagttatgctgatttaaaatgcggtaatctattgctttagacatgggaacatacatgatgaattgacctcttgttatagttttagtttcatcatgattttttagaaatatatataatatatgaatattcacaatgcaacatcctctgccttttcttctttggatatatcacactgagataaaagggaattattaatatgttagattgtgctatcagtgttgatgtgaaacaaagttatcatcggtattttttatcatggatttctattttctaatatccgtttcctatctaaccaaaggagggaacaacaatcggtgcatgatctctctacctgatttagacaggtaacactatcaaacacaacttgcatgggatttctatttttctgttggtcatgtgggttagtaatgaggcatgagaaaattttttcaaatttgattactataaattattgttactctaacatccctactcatgttagatgatgttctgaaaaagattctagcctgtatagctttatgtgcaatgcctcttgaggatgctgcaggttgtgtattttctgaattatttgttgtaaataaccatacacacatggattcttctttatgtttcttcatgcaccattgaaactttgatgtgctatcagccagggagttgccattttcctttatacattctgatggaggtaaactcaacatatatgtgtatgtgaaaccatgtcattaatatattttggcgtatttctgatataatacttaaaacaagtgcttatcagttttatttcgagggattaactgaatctggaaaagttttatttcgagggattaactgaatctggaaaatggaggacctagattttctaaagggtcatctgataatatatgttattgaacaagtgtgatctttctttatttttgctaatttattgataccttgccattttttaagttctatttcctgtaccaatttcctataatcaatgtagttttttttatttacataagtctctcaaaggtattgtcaagcttctgaccatgctaacattgaggctgccttgtaacagtgtacctctcctcaaatatcagaaacatggttggaagagtccattctaaatggcatgatggccacaaagtttgtttgctccaaggccacaaatagtgtctcaaaatatagtataaatttgtatgatcttctctttaaattctaaacacggtttttgacaactgacaagtatggataaaaaattcgatgcctaaaaatatgcaggagcctcaagtgatatctttagaagggatgagtttattgtaataaacatgaatatatgatgtaggcttagacaatatttctagattgacattttaatttctatataatacatgattcatgagtttgaaatgtatatgtagttatttatattttgtttttgtctcatgtgacattgatttcatgcataggcatattttatgattctccttgggctattacaaagtaccgtgcattcggattacatatttgtggagacgtgcgttgcacgtgcatgattactagttactttaaaattgacacttgtgaggatgacatatgagaccatctgaatgaatgaagatgggccagggtgtcaaaataattgaaacctatttttaaggggtgttaaaaattaccaaatctcattgtcgaggccaccgtcgttttcctctaaccccgttgtcgttgctgcaatgagaagaaaatgctgctcccttcgttacaaactaagttttctttaagctgttcccattttgcctcaaaataagttattcttagtaataactatattgaagtttgcgaaagtaataaataaatgtatttaaagtagataggggcataattgcactaggattcgataaagtgaaggtattttaaactttttttaatggcatgtgtggtatgggtgaaaatgaatttattcaggatgaagggagtagtagtaatccacttaaggggaaggagcaacgtacatcgcggcccgtgggaagctaagtggtagctgtgtcggctaccctagcttctcgaagaggagaatgggtggcggcaagacgagtgtcttatggtggccttgcgaagaagcggaagatacaacgagcaggagaaagcatgtcccgacgagaggggtgggaggttcttatttgtgctccagcttcatcattgtatcaagtggagctcacctggcttgaaagttatttgcgcgggttagtgcctgcaaatctcagagaaagatgagactatagtcacttacatgtgtctcacgttattttttatttttttatgacttggctgtcacgccagccaagctactcttaaattttaaactggttttaatacttcgagaggcgataaaccaggtttttgctgttgaaagatgtgaatcggattaggtcaatttttggagggaattaaaatagacttttatcaaatacagatgatacaggctgaactgctgatacttaccagaagcccatttcaaattcggcccaaaattgtagagacccaacaccagaagctcccaactccccaaggcaagagcggcccggcgtgagaagcggattagccgaggccgagagccgggggaagaaccgaagaagattgccgtggcgtctccgtctccctcctcgccgtcacagcgcagccttgcgccaccgtcttcgtcgcacgccggattccaatctccccatcgcgccatccgctcctcctcctcctcctcaccacatgcccggctccacggcctcctaaccctgcggattccatcccattccccctcccgaggccgcccgagatgtactacgcgatgcggctgcgctgcctcctcacgcggccgccggtctccctcgccatctcggccagcgcaggcggcggcgagggatgcttcgccaggagattcggcgccgccgtggcgccgcggccgtggggcgcggggcggcggctgtgccggttctacggctcctcgaagggcggcgtgggcagcgccgaggcgaggagcgccgcggcggcggaggggagcagcgggcgatgcagcgagcaggagcacgcgaagctcggggagagggaccagcaggagtggctgagcggcgagaggttcctcactgattgcaagcgccgggagtcgccgttcctcaccagacgggagaggttccgcaacgagttcatgcgccgcgtcgtgccgtgggagaaggggaacctcacgtggcagaatttcccttactacgtcaagtatgacgcgcgcaccacctgttcggtactttgtttgagtgagtcacatcagttttctaacgacgagaaattgcgtttttacttaattttggatcgcaagtgagaatgcgaggcggctgctgagggagtgtacggcgtcccacctgcggcacaatggtgtcacatctgagtatggttctcgtttgcaatcctctggggggaggatattgctccagagcttaccaggtattgagcggacatgctgcagatactaagtgttatcaaatgcttgtgttgagacctatttaatgcaggaactgagctttacagggagagattagtaagagctctcgcacacgagttgcaggtgccgctgctggtcctggacagcagcgttctagctccatatgtaagatactgcacctttatacctatcaaatatataagagtggttgcaaacttaatgtaactcctaacttgtaggattatggggatgactattcagaaagtgacgaagaggatgaacatgatgagtcagaggacgaggaatctgatattgaagatgaaggtgatgaagattggacaagcaatggtgaggctaaaaccgatgaaagtgacgatgaggatgctctgaaatctgtggaagaactgaagaagtctgtggatcgcctcagaaaattggttccatgtactcttgaggaatttgccaaggttatattctgttagcctatccaacattccaaccataacgagaaataagtttttgtatttctcttctcacaaaatatttcataattttgtctgtttttctagaaactatgatttttcttattcaatataaaccatgcggcatcaattggtgtccttttccctgcaatatctgcaaacaataggtcattctaagtttccaacgttaaacaatctcatggaagtaatacaataacataagtaaaataccccgtgataaaaacataactttttatactaaaaatgtgtgtttcttccaacaactaaaaaacatttgtgttgtcattctagcatggacctgaatcataaccttatgcgctggttcttttatcctttcttacttgaagaaaattaagctagaataatgcattagtgttttccagtatctgccccgaatgctgagttttctttcacttgtatgtcttgttgatgatgcttcttcatttggttatgattctagagagttgctggcgcagaagaaggcacaacatcagaatcatctgaaagtcctgagtcatcagaggaagataaaaggccttaccaaaggggtatggtatttcattgagtactctattttaaatcaagttaaaattctctcttccaaactaccttatggttcaatggaaaaattggaactagttacttatttcaatgcctattatcaggagatagggtcaagtatgttggatcctcagaagcctttgaagcagatcagaggtgatcattagatgttggctcttttgctctttctatagtttttcatcatgacaacctttgatcttgcatcgagtataagcaattccgcagtgatttggattacctttcttgtttcgtagtttggcaccaaaaccttagctatttatttagttttcctgatttagaaattttaacatctagcaacacagggctccttatttctgaagttttgcaatcatatttaggtgtctctaagtggaaacgctccatgttcctattagaagttacaaagtttatgatgtgcatgcctgcacataattatgtattgcatgctacagggtgtgggtgcccacatgcatctgcttgtaattttcatgtctttacatgtggtgcacacaagaacatggtgggttgatttgtggtttagtcttgtgggtttgggtggattagtataagaaagtgagcagtaagtttacttatgttgagcttgcgcacgcacacaatggtatattatattttgtccactcgtattagtgaaacttgaaaaacaaactttacttctggttgtttgttatttctactacatgttagaaattacgccactatctactctttaccgtagtttgaagttgatgttcttcatgcaaacactgatttgtaccatatgtatcatatacaggatcattttagggaaagtacctactaaagatggctcaagaaatgcctatacctttattagtggcaggtgggtggatatatctttcccatgtgaaacaggataaaaatggttttggtagatctaaaacctcagggaggcattgctctctgtaattttgaatattttggaacttttgcaaatccgatcagttgaaatatattagcaaaagaccctatgctgcagttgcttaggagaactggtttctccatttgtctttttgatcctcttcatttcaagtggtgtttttcatagtttcttaaagcaaccaagctatacactctcttactgttctgtgtaaacttatcattaccatgaatttgtgaaacaagggtaatgtttctaccattgaaaattacaggactttatcaaagggacaacggggagaggtatatgagatcaatggggatcaagtcgcagtcatattcgaccctcttgcagagaagctgcatgatggtgataatgatgcaactagcaaggaggaaaatactgaggcatccatttactgggttgattgtatgcttctatcctttttcatgaacagttttgtgttcaagtatttgatttggaaatttcaggcgccttgacttcatctcgtttccttgtgcttagctcaggacattgttcatgaccatgatactgagtcagaagattggcatatcgcaattgaagcactttgcgaggtgatttatcaaacgatgtattgaattttggtgttacatacccccaacatttctattttgttgttggccaaccccatgtaataatttttacctgccttacatgattatgaatttaggttctgccatctctacagccagcaattgtctactttccagacagttcccagtggctatctagagcagttccaaaatcaaatcgcagagagtttatccaaaaggtagaggagatgtttgacaaacttactggaccagtagtaatgatatgtgggcagaacatattggaagcagaacccaaggacaaggataaggaacctgtaagctctgcaaacttctatgcatttgaatttaaccaataaaacagtttttgttagttcttatttctgttgtggacatgtacagccggcgctgatgttccacaatctctctcgcctgtcttcgctggtaattgcttgggatttagttcaaatcaattcatgtttattttctagaacaattttgctataatcactaatcaca

SEQ ID NO: 69466 - DNA, 1606 bp, Oryza sativa
tcttcattgggtgtagaagtagacttacataaaaaaacacaaatcccccaaaaatagatccaatagctttttgttatgtttttaaaaccataatccactcttacattattgtccaaaggttaagtttaaatagctactacctccatcacaaatataaaagtctggatgtgatacatcctactactatatacatgtccactattcatatttgtagtactggaatgtgcctcatccagaactaagttcttatattttgggattggtttgtgtgaattagagttagaactccacccttacagctgatagttaaaaacctctttgttataaaccacaaaaccaaaaaaaactcataaaagcctaaactaaaaaaagagtctataataaaatctttcggcctaagacttaggcaccattctaatctccaacttcaaactataacttttttgtttttttgttagcacacttcccatttatacgagttaacagcgtgtttttcgttaacaatacggtgcattttctaaaaaaagacattttataaaaaaacttctttataaatacaaataaattcattttcaagttttatagtaataaattaatcgtgcgctaatttctcgttttgttttccacgaccatgatgcttaaaaaaatcatttgatctccttgaacgaacgcagccttcataatacctgctggctgctgcgatcaaactacttgcaagttgcgatgatgtcaagttcatgtctgaagaaaatatcgagattctttctatgcttggtacttcgtgtgattatcaatatttgcggatttgagaggatcaaatattttctatggtttatccagttgatcgggggcattttggtcacggggggcatttgggatctagtagcagcagttgtggattcagtacggagatgactcacctaccgaggactgccacgtcggagtgacgacggggtttggtggtccgggggagcatcttttgagggatcgtgcggtcggcggatgcggaatcgtgtcgccgacgagtcgacgggagacggtccagcttttgcacctgtcctgcaaggctgccctgcaatgtagcaatgtgtttgtagattttgctagaactcaatgtgttctggtgaagtgtatttttggacgcaaatatgcttacaccacagaggcatcaacgtgtgtgtgcatcagatcgtgtgtgcctctcaagtagtacaacgctatcttcgggagctcacgaacggctcacacatagcatgagctcagagcattcacttcacacaccattgcaaaatgcaaacgcacgttcatgtgtactttcataattagcggacatcagccccaaaactataagggcattcccaaaccaatgactaaaatggtgtccatagcattaaataagttgccacctagaacaaaaaatgacgtggcaaatgaataaatgaggaaagagaagaaaaccatgtcttgcatgagacatggtttctacacaacatccaagacatcatgtgagataagtaatattaaattgaagtatggaatagtggtgtttgcattggaagagtagtgtctggtactaatttcttgatgatgtggagtttatgaaaat

SEQ ID NO: 69467 - DNA, 2763 bp, Oryza sativa
atgaatagggtgcatgcgctatttacaactaaaatttgttttgccctctctagatcaagtttgaactactcttttgtgagatcgattgatccctattgtattattatcagtcctattttttctatagtttttcatgactgtttagttggtatcttaaaaagtgaccagcatgagagagcgcatctaattgtaatggaaaaggcggtgctagaaaaaaaatgtacctcaatcttatgggaacagaatttgcaaccttcgatttcgatgaaaattcggtggcaccaaaatttcatgaattttggtacttttttattgaaattatttgaaattttaactaaatttgaataaactttgctcaaattcaacaatttttttttgagaaaatccaaaaatttcaggcgagataatgacttgccggagggtctgaaatttccgaaattttaaactaaaattgcaatcactgtatgaggctcgtaaggaaatcagaactaaggccaatgtttgccgatatattttattgtgctactccgttaagttttatatggcttatttccatacgttgtacaacatgtgtactaagtagttagaattatattgcagaacagatggattgttgtttccttgctagaaaatgggaaaatttagggaagctttaaaagtttatagcggtgaagttgtacaacctgaaacgactatgctttcaatatatatttaataaagttgtgggtttgtttatgtacatgtgtacgtatataatggtgtaagtgtgtgcaccttccatgtaatcgaaaggaaaaagaaaccttggaattctctcttctatgtgatactgtaatatgagactagtccaaagtattcaggcacgaaattaagccaccaaccacaagacgcatgctcattgagaggtggtgtggtagatgagtcagatgatggaccaactcttttcaaagttgttctcaaaaaaaaaaactcttttcaaagttgcaatgccaccaaccacaaacttcaagtgctaatactacgaatcgtggcccggtccagtccaaaaattaacatataacgatgagagagagacataacagctaattcggtctcaaaagaaaaaaaaagagggagatgcatggagaaattgacatattttaacgggtcaaatacgttagaatgttagctcaattaaagcagaacttttttttgaatatatatatatatatatatatatataatatttactactacaattttcttcttcaattctcaattcttttatatatataagaattgagaattgaagaagaaaattgtagtagtaaatattttacgccctctacctacccccttgtctctcttcaactgaagtgaaatctgaatatataactttcagcggatggatgttgaacgatatgaacattcctgactaaagcgtgcgttcgaaccggtcaatgcattcaggtagagggtgttcaaagaagttgccccaaagacacaacatcaatctggacaaattgtaacatcttagtgttactgtatcgactatcgacaaaagtgttttcagttagatttgtaagtacacggcagcgcaagtctttcaaaaggatctggggagtaacttttggtgaaaccgccctcttgtatttctttgttattcgctgcccttccatcatttgatagaatcaattggttatattagcaagcagtgatgtgactagtcacatttcacaccagtctttcttcgaactatttgttgatagataaaattcattccgactatactatgcgtgtatatacaatgtaaatacgaggagtatgacttatataaacaaagttgtaatgagagatagttgatagggccttttttaggtttagaccctgtgatgaataatgaccctaccgatcatgtcatgtttggccaaagactgatattttttcctttactagaaaaaatacccgtgcgttgcaacgggtgaagtctattttaatcttattattgttatatggttcagttaagatgaaattcactgtgggagttcgcttatctctactattataaaaattaaagatattttaatcggtattttggtacgtcatcatgagtcggtttttaagtttgttcattttttgaaatacagatccatgtttgagtcagtttttaagtttgttcgcttttagaaatatagaaggaatcgcataagaaatctttttaaaaaaacttgcctgctaacttgagacgattggactcctaattgcagctcatgattttaaaaaatatatatatccaaacgagttcccacaatagatttcacgttaactaaaatatataacaataataagattaaaatagcttttaatacacggatatttttcgtgtgtgtgtataatcatgagttgcagttagaagtctgatcatttcaagttagtatatgagtttttttaaaacagaattcttatatgattccttctgtattaccaaaaatgaacgatcgtaaaaaccgaatcaaatacggatatgtatttccaaaagccaacgaacttaaaaactgattcatacacggatgatgtaccaaaataccagtaaaaatatcttcaacttttataatagtagattaatattacaagtataaagtatgaggatggtaaccttaatatatgtagtagtctataactatgtcgacgtaataccctgataattaaggtggttagcagtatgttggcgtaaagtcctaatgaagtggtcggcgactagcttctggatctcccctaatgaag

SEQ ID NO: 69468 - DNA, 3083 bp, Oryza sativa
catgactgtggatctgcataaagagcattaatttgattggctgcctgattaattgattaattctccagctgcatcacattgatcacgtcgtgctcaatcttgcgaattgcgatgcctaccatgcgatgcgacgcaaggatgaatgctttgctagagtggtcccgagtcctgactcctgagaccttactcatgagagcatgagcaatggtatcctcaacccgtgtcttcgcaaacgccgtccattttccgtcgccggacccctgaagggaggcgcgacccccattaaaggaacgggcgcctccactccctttttctaagcatggctcgtggtcccgtctcccctgcctcctccctttcagattccccttcttgcccctctcgcctcggcccgctgacgaggcctccatccgccggagcagagcaagacgagcccacgcgcagctacagccgtcgtcacgacctcctctgtcgatgccgcgcccgccaccgccgtatccatcccgatctggccgcggggagggggggtgggcagaaccgcccacgatggcaccagatctgccgcccccggctggcgacggcgtgaggtggaggaggacggcgacgacggagacagagcggcgaagctcgcccgccgtcggccaccccacccctcgcgccgctcgctgtcaactagcgtatcccgcgtgcggctctccgttggccaccgcgcggagacgggcggcggtggtgctggcgagagggagaggcgagcggctggcgatagagagagggagggaggcggccctccgggcgagcggtggcagcgatagggagaggaagaggcaagcagcggcggcgagagggagagggagaggagaggtgaggaaaagagaagaggagggggcggcggcggcgaaaaaagagaagaaagagactaggggtagtgaagtaaaaatatacatggagctttgtgggctgggacactcgttgtgggctggagtatctccaccaagttgcttgaaattttaaggagctcatttaggatatcctccattaagagagaagtgtctcaaagagtactctcagttagtggggatactctaggtgtgattttaggtgtgattttggttatagatgctctgagtggatctttggttttaaatgccctgagtagatctttggttgtagatgccctgagtggatcagtagagatgcgagcctgcggtgtcaacgttcacttgttcgaactacttccacagttccgcactcgctttcccggacttaatttcatcttttgccttaaaaatgggagtgggactccaatcaatagtgatcacgatctctgcaataagcagaatcaaacgataatttatcacttaccccacgagctatcacgttcaccaaagcagcctctcatgtgtgggaaccggttcccgggtttcagcagacgaacattcaacttcgaagtttttaatattggccagtcactgagtaacaggaaaaaaaaaacaaattaaattttaaattttagttcgtagccttgcaaccggtaacaacctaagcggtctctggctccactctagtaactagccagttcccatcgtctttttagggagctgcctttcatctccagaactacggtccccgagattcaatttacatcaattacacgagtatttacatccatctgcttctaatatcagagaagcatacattggaaaatatatttgattgagttccaccatagtgtacatcaatcaaactataattcctggagcatttacatcttgatcaggctgaagcaaagacggagctacttatggctccttttgaccttttcagtccatctaacctgatttctgatcttctcataattgtacaatgataacaccagccggtatggaaggtaaaaaagaagccatttcattagatatttttctatggtacaaaatgattgcaacgttataaatagctctaaataaaaaagggagacctcctcctgtgactaggcagcctattggtgttacaaatacaacagggttgaagaatcactagtacagatgtgtatacagtatgtcagttgccgaacccaaaaggtgatctcgtcctgctgccaccttcaccatactgttcgttccattttcttaattcgttcatgctcgtcgcatcatacgaaacagacgggcttacctaaatgggggaaataataatcaatgtgaacaaaatactacttgcagagaactgcgctaaaagaaaaaaaatcttaagtttgcagtttgcaataccttggcttttgcttgaatgaaatcatcaagtctaaggggtcttagacccgtattttggctacacggacctccctacagaagatgttaaagttagtgaaaatgagagaccacataatttccataattatagaattgtttaccttcttttcttcttctaaaagttcatgaactggcctatatgctgaagctatacataggttctgcagaaaaggaaattcagattgcctgctcacatggcagaaaagaaggaccagaacaattccaatttccacaggaaaaaagatattatgatcgttggtgtatgtgataccttcaaatcacttcctgaataaccttcagtggaattggcaagttcatcaaatctgaaatcagattccaagttttctttagcaagtaaaatcttgagaattttcattcggttctgtgcatctggaaggtccacgtatatcctgtagatcatgaaagtcaataaccaatgaaaatcttgctagatcaccatattactatcctggaagcaatagtgtgaatgtaaatttaccgtctaggtaaacgccgtattacagcatcatctagatcaaatggacgatttgtcgcaccaagaataaggattcgctggctctctttggaccttagaccatcccaagctgccataaattcgttccgcatccttcttgttgcttcatgctcaaatgcaccacctcttgcacctaataagctgtcaacctgttatgtcaaaactaaattatatcataccaggagaaagcacataggaggggaatataagcacttgtttgtttcatttaagtaaacatacctcat

SEQ ID NO: 69469 - DNA, 3564 bp, Oryza sativa
cacatcagtagcttcatttgttcatgcaaaacagcaggagacatttaacataagagaaaaggcctcaacctgtcaactacattcgtataatcaatgttttaagaaaaagcaggacccactcagttcacatgtgaactcagaagtctcaatttggcgtgtgatgttacaaaacgaagcaaatcttttgaaagcttaaattcgccatcttaaataggttgacaagttggtcccgtagatagactgcccttttatctagaattgtatatgcagactgtttcacttatcctttgatttttgatatgtctattctacatgtgtgtaaaactttaaaaagaaactgttttgcttcaccttttatcccttttggtcatgggaaacataaatctgcacagaaaagtttcagatccaaatcaaacatgtaaagtttattctatgggccaaaaatggctgaggggtcagtttcttgttttggccatcttcctgttcttttggcaaaagtcaaaaaaaatgttgacttagctggcgactagtaaaaagttgtcccacactaaagtcgtgttcaaaattgtctaaaagctaataggtaagtatggaaatttaactagttgaatgatgtttgtaatttactgggtcacaccaagtacgccatccttaagagctttactgcaacagcaacaagtcaaatcaaattacctttgatgtgagtgtagaaccagttatgctgatgaaatttgctccagcttctgttgcaagtgcctttgccaggagtgtttttcctgttccaggaggcccaaagagcaaaacacctttgcagggctgaaaaggggtccatgtcacattaaaaattcagctaactcaattcaagtatgtttaaatcccgaataagatgaatacaacaaattactagggcatccaatagtcagattaagatagctgaattctaagcaacaatttgtcaagaaccaaaggaaaatagtaagaaactagatgacaccctgtgcgttgctgcaggatattagtgcgtacagtgctgttgcaaatttgttagatatggaactgagaaaatgattaatttaacagccaaaaaaggactcatcaggttagaaagactatgggctaatctgaaccgttaaaggatgtcaaagaaaagtgatgatgtggcttcttgcagtgacttctttgtagcaataactgcactaagtgagttgcaaatgtataggaagaaaggatgatgctttcaattgcagaatatcccagtttagttttatctatttgccttgaaaggcagcatgtatttcttacgatgtttatagacattgctatacttgcatcatcaactccaccttgcatggcaaataccataagcactagcgctgaacagtcaggatataagtatgtcatttatagtatgattttaacatatttaacctaagagatcagaaataggtccaacattcaaaagagaatcaactagttgaagtccatgaaatactgataatgattccgtaaagagtctttaacaaatattttagggtcaattcaaataccaggcatttttttacaatctcattttcccctgatatagcaactgccatcggaggaccacttgagtaagagtaacatctccattctaaaaccatgtgattactacacattatggtactcaatgttgactcaaatacaaaggaacttttggaaagattatgcaaatgtaacaccattttaaagtattagtctaaaactgatgcaaggaggaaaacaatatattattcctgcaatccatcacacctcgctttctgagctcataccaaaataaagtaatttctttctagaagacaatgatgacctaaatggatgttcaagatcacatggtatatacagcagagctagtgaacagtcataataataagtttagcagaaaacgaaggcgtacccttaacaaattcccatgggagaaaagttcaggtctcctcattggaagagtaacaagctcatccagcgtcctcttaacatcctcaagtgccccaatatcatcaaatttcactccaatttcatcaggagggacaacagcagaaatgaaattgcgttcatactcgtctttagccaaattctgaagttagggaacttatgagttcggataggagtaggactatcagataaaaactatgaaggtggcagataatagagatgtggaaaaggtcaacttgcggaatatagaagctaaatacctttatattttgagagggtctcttagttttaatgccctgttccttcaacctttcaatggccacgtccagacttcacaaaatgcatcaattagagtaaatacctggcaaaaggaaattggcctagtgccctagtacaataactatcatcttgaaatgaagtacctctcacgggggatgattaatctgtcacccttaatgttaggaagaactgctgatgaaagataatgacttctagcccatccaacaaccttttccgcttctgcagacaacaatacactagctggtaagggaggaacaaaataaattttaatttagcatccatagcagattagaagtggctgtaagctgttgtattttgtccttccaacttatttgcaacatacccattaatttcaaaggataattaagatatctccctatgcagccacctgactagaactctagaagtctataaccagtaacctagaataagttttcaaactttcactgattcaaaatccatattccactggttttacatgtaggagcaccaccacatgtatagactcagtaatgaaacctatgacttaattgggaattgcatagaaaaaatcacccaaaacatgaaagcagcatctaatcaaaacagttggcaggaagcccaaagaactttttaaagaaaagatctttccttctatctatttctataatgcaccagcacataacaaaagccaacaactgatatcatatgaaaattcagcacatgtctgagcagaaaatattgagtagacatactttgtcttgttaaaacaacaccatcagatttcacatgcagaagctcaacacatgatagttcatgctcttgaagtacctgtgttcatcaatcatgatttactgttagttacatgagaggaagcagtaatgctacatgacataggcagcagataactggaagcagaagcattgcatccaaaccttgtgcaattcaacaaggttatgccttgaaataataatttttctatcctcttcgatctggttattgaaaattcgtcgttgctcatcttcctgtaagtaaacagagacaaagtcacaggcggtaggccctccaagctaaagctcactagtacggatgcactaggcattgcaagtcagtgattcaattataaacgccatcatgacatcaacacatatgttacttaatcgttcattccgaataacataactttgtaaactagattagcaaatggtacaaacctcaggaagaggaacgataagactatttgtgaacagcttcgatatgccactggatcttgagtattttggtctcccccctaccaatcgctctgggctgcaggaa

SEQ ID NO: 69470 - DNA, 1911 bp, Oryza sativa
ttgttataatttatagaagttgaatttgaacttgcatgtttgggaagtgatatattacatattaacctatcatgttaatttttttgaaaatttttcataactatttagatgacatgcaaaaaacgggtggacatccacccgagtgtttaaaacagttttccggcgcaagcgcggtgttttcttatcgaagaagagtacaaaagtgagacacatgtgtattactctgcggtacaggaggagcaacggcgacgggtgatcccccgccgcaacgcatcgctcgtcgctgcactctcccgctgtgccgaattcaagttcaggaacgcggcgatctgcagttcaaggttgaaacgcgaccgccgcatgtttgtagcaggttttaatgctacgcgatctcaagttctcaacgtcacagagtagtactatacgtgatactagtacggcagaacacccaagaaaatttcctgaattcgggtgcaacatcatcgccgattcacgtcaacccacgagtattaaatcatcgacggcccttgagaaatcacgccattccggcaccattccggcaccgcgctgacatgacagtgcaccaaactgatcacactgaattgacgagctcagcgcgctgctgcctgctgacgagtgacaatgaacgaacactggaatagctccaaacactctgctccaaataaaaacgacccaaacctctacgcaggggtgcgcacccgctaatccaaaggcctgatcgctcgataaccgacgtggataaatggataatcccgtcaccagcctggctaacgccatgtttgattcagcttagaattattataatctggattattaggagtaagttgaaacaaacaaatagattattatgctagattattataatctataagccagattagtataatctagtaatcttctctagaggagctttttatggattattgagtggctaaagacccactactattagatatctctaataatccagagaaacaaacaacttacagcttattataattcagtttagagtaatttaatttaataatctagattacaataatcttaaactgaaatcaacatggcctaaatgacgtggaattgtgagcgggcaatcattccatccaccttgaggcgttcgtccgggaactccacgctccacggaggccacgcccccgaccagaaacgcgcgagttaatacgcacatttacgcgcgagaaccggtgcgtgcccgtgacccgaaacgctcctcgctcgctttctcccccccgcggcttaaagcgtttccctttccctgctcgcacgcacgcacctagctacctcgccggcctcgccatcagatctcgcccaccgccgcctcccccaactgtctttgtacctcgccgtcgagctcccatcgcggtggcccacctcccgcgcgtgcatttgctccggccttgcagggacatcgacctctcctctccgcgtcggggcgtgatggtccagtgatccaaggagtcgttcctctgccggtgagtggtgcgttcgggttgtattggtggcagtgcgggagatttttggttggttgtttggtggagggatcggggatgggctgcacggggtccaggcacgcgttccggggtggcgtccggggcggcaagacggcgtacgcgcggagccgctccggtccggccgccgtgcaccacaccgtctcgctcaagtcctccacactgggttcgctcagcctcgagcgggaccgggacgaggagatgatgaaatggcgcgacgacggcggcgcggcgaagaccacgccgccgccacagcagatggcgaggcggcagaggcaattggtgctggccaccacggcgccggccaagacgccggcccgcgagccggaggtgataaatgtgtgggagctcatggaaggcctgg

SEQ ID NO: 69471 - DNA, 7151 bp, Oryza sativa
cgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggtggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggagtcggaggataacaagggccgccttcccacagtggcttcggggccgtcctgggggtcgggggctcctggcgtcgtcggacaagcgggcaaagggccaactccggtcgtcaggggccttaggcctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgggcagagggccaactccggtcgtcgggggccctgggccaccgttcggctcgggagcctctcctccctgctctctcccgggccaagtcggcacagggtggggaggcgtgaaatgagaattgtcctcatcgcgctccacaaccaatgccgcactaactacttgcggggtcgccgctaagtagagtaacaagggctcgtctggctccggggcgaccagaactggggagagcttagacatgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctggggggcgcatccgctctatagcccgtatcttctcggggttggcctcaatgcctcgggcagagaccaagaacccgagaagcttgcccgcaggtacaccgaacacacacttatcggggtttagttttatgcgggcggagcggagactctcaaaagtttccgctagatctgagagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataggttcctatgggggtaatgaacgtagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactctggatggaagacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatatccaccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgctgcctcggggtggcgggggcggaggcgccaagcctctcgtcgccaccctcgggcttgtacgcagcggcgaggtggtccgcgcgctgctccagacaagcgagcgcgactttgaggtcgccatggacagagatggggccaccgcggcccggcatcttcatctgtaggtaggcgtagtggaccgccgccatgaacttcaccaacgcgggcctccctaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggccttgatggcgtcaaaggccgcaggggaaaggatgttgagggccgctcccccatcaatgaggacacgcccctacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcgagggccttctgcttggcctcacttcgccgattaccggaaggaaacgccggggatttgccctctcggcgctcctgcctcctctcctcctcccacttcctcgtctgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgggcatccggttccccacgcagatcttcccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggcgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgccggctcggccattgggctgaacaggaaaagcttggcgcacacgaaagagtgcgagagctcagaaaatccctcgcagagacccctacctggcgcgccagatgacggagcgcggggctcctcaccgggagaccgcgtaggcccccctttgccggttcggccggggactcagggtgagattctaagctctctgtatgtggaaggttcgcgagacaggaaacacacaagacacgggcgatgtatacaggttcgggccgctgagaagcgtaataccctactcctgtgttttgggagatctgtgtatgaaggagctacaaagtatgagccagccgctcccttgttctgggttccctatctggaaaaatcagtcccctctctcagtgggctaggtcctccttttatatcttaaggggataccacatgcaccatttctctcttttttgtggggacttaccccaccttttcataaatggacggagatttgtatagttgccgtccgagtcaccttctgatgagacggcccacaactacctccactttcgccgggagcaggtgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagcttcagctggggacgagcgcctagaagccctcgtcctgacgggatggggcgaggcgtgcgtcagatcgcctgtcgccacctaacccgcgatttgaccggtctgtgactggtcacagaccggataaacgagtgcactgcactgcgttacatgcggcgtgacacgctcagccaaaccgcaataaatgtggttaggtgagccccactgtgctcacctaacccatacacgcggatcaaaaacccacgaggggtcggggtgcctcggccctcggggccgaggcgggtgcggcccgaccccctcgggggactaagaggagggcgaacacatcaccctcgggcccgacgtccctcgggggtgccaggccacgtgtgcgattgtgtctgcctcaaacctctagtcatgatactcctgatcccatgtcaccgacagtgaccgaccgggaaattctttctgggtactcacgcttggcctagaacaatttgggataggtgaccgaccgggaaattctttccggatgcacacgagtgaggacaaagtgtacagaaaagacttgtgttggtctgtgagggcagactatgacctatgaaagttgccagatgtaagcgggtccggtataggagaggcgagacattacaaattgtatgtatgattttttgctgcgtagttatacataagttaaggaacaggtaaataagaccaagtaagatattggcaagagaaggttgagaatgcaagttgacaacatacaatatatggagcaaacctttcacggtaatgttcgaatagatgttttgaatcaatatacagaacaaacctgaagtttgtctacttttcttgtattcttgtttttttttcccaaggccacttatttatctcctgccattccacgattttttaaagctttgttactactagaacgatgatgttaactatgagtaatatctcttgtttggtcgttgtctcagctatggctgcaactcatatttacccttgctgtagtataggctactaaaaaatgtttatgggttataaaaccacttcataacatagataatagagttcctcataaaaagagataatagagttaaaaaaacaactcgctatactttaagttgcaataacatggttgtgtaaaagtggcaatgagcttttggtaggtgttgttcaaggttttaggatttatccccgttcattcgaatacgtagttagatggttatatatgcttacaatgtttacttccgacggtgtgcacataagcattcatacttctactagcttggaatagagtgatcatg

SEQ ID NO: 69472 - DNA, 6943 bp, Oryza sativa
tccccacgtggtagtggcgtgtgccgccccctcgtcgccttgccttttgggtgggcccccagatggacggcgcagatgctgatgaggcgtgccgagcgcccgcagcctgtgccagctgttgagtgacgtggtccctcctatgatttctgagtataaacttttttaaaatttagaacaattaaggaccatttggaatgaatttgctggttccacaatcagaccaagtttagttctaaactttatgttcaaacttttaactttttcatcatattaaaatttttctacacataaactttagtttttccgtcacatcgttaccatttcaaccaaactttcatttttgacatgaactaaacacaccctcactgtggaaatgaaggctgctctgtatttcgatttcgacgaattttttttatttgagttagtccatttaagtttgattaataccactccgtgtgattgattctttagcaaagtataaacgaatcgttttttttaaaaaaaacgtacggaatagtacgagatgtacgcatgcctgagtattcctggctttctacgttgtctctagagtccacagttccactctccactgtatttgtactcccaaacaacgtgtcaatttcattgcacgacatgttccgtactagtatcactgtgtatccaaatccaatcatcatatggcaaaaagagctaaccgattagacaattcccgtgtttcttaggcctcctttaatggttgagctagtgtactagctcatatgcttgtccacctcatataaaagatagcaacaagtctaactctctaataaattgtctcatagcacattgtttaaaatgttttggtttcacaattcctctcgcattttctttaggagcttagctcttgaagaagagttagtgcattctctctccttatcttctctctcttccacatcatacaaaagctgatgtggaaatttatgagctagctgactcatccttgttggaggaggccttatgctacctgtcaaacatatttttgccaatatatcgttccctggatataaaaaatcagctcccggcgcagaagaacggagcgctggcttctgcttgattacggttgtgtttagttccgtacaaagtttagattttggttgaaattagagatgatgtgactgaaaagttatgtgtgtatgacatgttgatgtgatgaaaaagcactgaagtttggattcaaactttagatctaaacacagcctaccgagagggaatggaaggaaaaaaagaccaagccaggaaagacttccgctgctctccaagactcggcacgctagctagctcttcgttccccctcgtttgctctgtacgaggcagcagctgaggtgagcgtcacatgccgctgaactcttctttttctcggtcatatggactcatgatgcggaagaccaacacgcgccgcacaaaaacagaagcgacgacgcatcacgcatactcctatagcctaggaaaacatggtccctttgttgttaggcctaacatgggtgctagtagtaagattttacgggagacggcgtgttttagcatgggtgcagcaactgtgcaagtcctaatcaccagtttgtgcttgtgcactcgactttttttgctgatgaccacgtctacgagagtccgggctatagctgtaatcagggagcgaaacggggaaagtgaaaggaaaaggggggcgaaaagagattcgccccacgcgcaggcaggcagcagctgcattgttgctgttggttgggaaaggtacaccggtcggcgccggatggctctgcttgcaaggacacgtgttgctgctacagggagagagacctttgatcatcctcggctcatcgccctttcctctccagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttaaatttggacgaattttattaaaccgtaccgcgcggtacgggtaaccgtacccccgcggtacgggcggtaaccgcgcggttaccggcggtttttcacaccctgttcctctctcgcctttgttaggccgaatgggcttctttctctctgggatttggacggtgcagaaaacggcagcccttttgggaaagctagtcctctctctttttcatcaggatgaaagtagtcgtactagtgtttagggggtgtttaagaactagagactaaactttagtccatatatccctaggagagggacttatgcttttgtgagatgggctaaagtttagcccctctctcccaaacacccccctactgtttaaccttctcaagtaaaatttctttattggagcacatatgctaacgggagtgatgctctgtttaattctgtaagagcaggtacaatagcaagctataagccaactgcaaacatattttaaggagataaatcaggagagagaagagcagcgggctacagatttgtagtcagctgtagcacggaccccaagacgcagtgtgtctatgataggtgggactatgtattaatagtatagtatgtaactattgtatgaatgagctattagattggctatagatgaattggagctagtagttggctatactattgaacttgctataagagcaggatcaataataccgcccgttgctggctataaaattcaccatgtcatttaataggctatatagtatatagatgtagcttgcgttttcttccttgggcaggccaaaagctgcatgcacaaaccgattgctgttcaatcaccatttatcctgaacagctagtacccaatcactatgcgtaagcaagggtatggccaattacagtaaattcacctagtcttggaggctacgtgcagccggcgttaatatagtcgcccgcttaagttctctgtccttgattccctccgccaactcagctttttgccatgatggatatattatagcctgcttaattctcctattgtacttgctctatgagcttaagttcctgtgccgagagatcaccagattagagcaaggctaatggtatagcccgctgctggctaatagcctactcctaaagccaactataagtacaataacttgttcattggatgactacatcttataatcaagtaattaattataacatgcacatgtcaatgtgtaggatcaagagtgaattatatctctgtagccatttgtgttgtgacatgaattttattcatcaaacactaccattaccatataaaccaagttctatgtagtatggaaactacaagcactaatagataactcaaataccatagcaactaactagattaacccataatattattatcacaggcagggaccggaccgtcgctgcctttggagcttctctcgcttcgtctacgtcagggacgcggggtgccatgctgctgcacctagctctagcgctccaggcagggccgcccggcatgcgtgcacctgctgtttgacaaggacgacgtctccgtgcccaccgcttcccggcctgggagcacgccgctgcacctggccgcccacgtcggtagcctgacagcatccagagatggcgcgctggagggaagcggagatcgagcgagcgccgaggagacagagatcgcgcgccgcatatgcgtcgatggggaagcagagggagcgttgcgggatcggctgtggtgtgcgccccacaaaccgcgttttttatcgccagggccggctgcaatcgagcggtagcgcgtcgagaaaagtgtatcgcccgacgacaaattagtcatccgcttccttctctctcatctattctctcttccctccacataggaataagatgatgtggcatatttttgcagcccgcatagccagcttattgcacctgctcttagcagggctgttatgattagaaggttttcttatattctgagaacttttaattgactctgctgctccgtgaatccctttggagaagcaggtggccattgattcgccagcacagcttgaaagttgacaagaatcatggctcgagtccttccctgtgacgtatttaaaaccttcgctttcccgggtagctggctggggaagacggccacctggctattttctggttgccacagccatttgcacccgtgaaaataaaagctaaattcaacgcatttaatctttcttggtcaatggtcagatatcatttttatttctttttttttcatttttggatagagatctttgcatttcagacatgaaaatttttatgcgtgcaaaagtcccaaacactatacaccatataaagacctatgaagttacaccatacaaggacctaggaagattttctagaagataaagaagatatcgataataaagagtcttattgcaggggataaaaaggataagatatttatttatttatattttatccgggaagtgttcgtgcacgtttcttcatgtcaaatactcaaatacaatacttgatcaatgcatgtacgcttcttgatgcatcatgtatatgcgtgccaggtagctagatgaaagctgaaaattgttttattatattaattattatcatgttaatttgtgcacgtacgtctagctctgcaccttatataattcaaatcgattttgctatatatttgtcgacaaatttttcccccaaaatttgacagatgtaattacagtacaatcgtagtgtaattacactgtaacttgcatgtaattacactgtaactatagtgtaacttgtatgtaactttcaaaaatctctccgttacatgttatttcggtaaaatggaggtcgtgggaacaaattctttcacatatgtgtgtgctatgatttgttttctttctcaccaaaacaaatcttgtaatagatccaacgattcaaaattatgtgaaacttacatataagttacactgtagttacatgcaagttacagtgtaattacatataagttacagtgtaattacactacgattgtactataattacatctatcaaatttttggagaaaaatttgtcgacaaatgtataggtagtcccatcatgggactaatcaacctgatttatacacatggaccaaacaaatctttgttggctgtgtgtaaatctttatggtttgtatagctaatggcagatatttggtgtactatgtacatttacaacgtgtcgtgccctacgcgtacaaatttaactacaaaaattatcctacttgtttatatctcagtgcaccattcttagcctaacgatctgatgcagtgaggtgctcccgatcgagtggtacttgaccacgtcctcgaagcatccaatggatggcggcgatggcggaggtggcgccgtcgccggcgccttctgcatgtggccaggatcgcattctcctacggttgccgccgctgtcgacgtgtcgctgaccgcttgcgtgacattgacaatgtcgtcgtcgtcgtcgtcctcttccaccggcgacggacacgggtagaagtccttgctctcgacgagctgcattgtcacgcgcccgccccggcggcgcgcgcggatgtactcgtgacgccgcctggcgccggcgggcgcttcggtgaccacgagcctcccgtctttggtgcacgtccgcctcatcgcgccccggagcgacgggagcggcggcggcagccggcgcatcatcccccggcgcccgtacgccacccagcacccgtcctcgccgtcgtggacgtcctcctcctcatcatcatcactgcagccgttgcactgatcccccttgcagctcgtcgtcgtctcctggtgaaccgcgacgatcgtccgcgtcacgacgcggccgcggccgtagcccgcggcatcggcgacgaggagggatcggaggccgaggctgtcacggtcacgggcacggcaaggcaatctctgcgcgggcatcgatcggatcggtgtatctggctcggccgatcgatctcggcgcgagccccgggttgacgcggaatttatacgtgggggcggaggaggaggaggacgcgtttactttactctccgagatggcaggaagaggacagtcgcggcgcccgtgatgccgacctaattaataggccaccggcccgatcgaccgagcagtcgtcatcgatccaccgcttcctgatctggttttatttgattacgctgcgttggagcttatcttatccgtccattcggttgttagatattgctgcggaacggatagaggcggatcggacggctgtgaagcctgtgcttgcacgtactccctccgtccaaaaaatctcaacctagaactgtgatgggacataatctagcatgtctagataagttgtactagattatatccctttatatctagatacgttgtactaggttatgttccatcacagttctaggttgagattttttgggatgaagggagtagttggcaagattggtatacggcgcatggtgagaaaggtaaggctgatctttagtatttagctatggcctatatacttatgcttttaattataggccttgctaacttccgctatatatgcattggattgcttcagcccatagctaacttccggctcagaatagtatatgggcctgagctagagtgaggcattttttttggcaaaatttgctacagtacactcaaaaaacgtgtaattggctgggaga

SEQ ID NO: 69473 - DNA, 1513 bp, Oryza sativa
aagtgtgacaagcgtataggtattcagttcagttcagtcaatcacagctaccatttcagaattcagacacaaacatttcatcgcaagagaatggacgggtactctataaaaatgtggaaacacgagttggtagaccgacgtttcaccctgctactgagaaggcaacgatcatcaaaaagacccgagcttgtgccacaactcgacagttgtccgaaaccaccgacctaatcatggcactgtcaaattcagagacgatcaaatcaaatcaaggcgtcagaaacacaaagcatcttccattaacctccctcttcttcatccacaacgaaacttgctcgccacagcacacaacgttagcttgtcgttggcggtggatcaccaaatatctcgagtcttagtctctctcacagccctggtatcctctgtgaactgatgctcaaaccagtacatgaacaaaggtactctatttctttgcactttttctatcatagttatttaccacttgtctgaaaagttacactttcatcttgttttcttcttgtagagtatgcatctaccattctaatctactcatacaccggcatgaatgcaaattgattacatatttagtggagctttcaactctcacttagtaggaccatgactccgctactgctagtagcagaaaaaaaagctgtttcagataggattgtgcatagcagcataaacaataattgcccatttggcatatatctcaggcacactaagcaagcatgtttgccactaacagacctgcagatttgcaagatagagacaaacatcacgcagcattgcagcatcaatatttactgccaaatcattggggaatgtaaagaaaaagaattataccagggaaaaaggggagaaatggttagtggagtagagcacctaagatgcacacccaatcatcagttaatgaggcagaattcagtgtaatgcaaactgcaaaactcttttctgaaggctcagaggtaacggatcagattccaacttgcataatagacaacaggggtgatgattttcagttgaaaacgaatgagatgttgatctcctgggtagataaagacaagttgtggtgtcttgatgcagactattataattatagtaggagtaccaattagcagtattcagaataccagctaattaggtaggttggtgtcatcccccgtatcaattcgagcatagaaattatccattacttctggtaaccttctttatgtgattacttttatctcagctgcgtgagtgcatgtagcatatattaacattttaattgtcacatccattgataagaatataccatcaccgaatttgttttcaatgctgattaacatactagtcaggaaccggagataagattgagcttgagggggtttggaaactgacccctacaccctccattaaaaaaacaaaattctgattacgaatctaaatatatatcgtgtctaaattcgtagctaaaaattattattatttatgatgatgtgagtatatatgt

SEQ ID NO: 69474 - DNA, 9898 bp, Oryza sativa
accacgtcgtgtcttccctttttgcttgaaatttcaggtttgtcatagttggtgtagcctggacttttttcagatttcactcctgtaaatgtatgcatatgcacataagcaaaatcgtgtttcctagttcagccgaggaccaaatcaccaaaagatacagtagtaagcctgacaaatgcagccttaacaaagattcagctgtcagatgctttgcctgccaggaaatgtttagcagctgacctcgaataattgggtgcttccttcgtttggttatccctgtctgtggattgttacctgagattctgagaatatacaaaccatatgcaagtctcatgcaactatcagatgctgtatggatgggaattctactattttctaattgtgttagttgatccgtaagtcaaaggagaattctaatttctaatcgtattggttagcaagtcagagtattagccaaccttctcagactagctaatcacaaactcatgacctctaatggggtgcaggtgccagtttatcaccggaaagtgcaaacagtaattaccctgcttgagaaccagagacatttagatgaagagacgtgtcaagattttcagaaaaaaagagttgcgtctggtgctccacattttcacaacaactgtcatgtgacaacgaccatcgtttaaagaaaaagctccgtgcttccgtctccgaccatttcaacctccaaggataatcttttactatctgtattaaatccatttactatctgtattaaatccattcatgtgctaccctttcaaaactcaggaagaggagtcattttgacgtcaacagaagaagaaagaattaagattaactttttttttcctgactggagatgtaaataacgtgcaaaactcatccaagctgctaaaaatatgcatcatgcgtgtgtgtttgttcagaatcaaaccaatcttttgtaccagtacaaccacttccagcgaagccagcagctagagtagcaatgtatgcgcatgagctcagccgcagcagcagtggcgcaggagaaaaacaggggagaagacgccaacgatgaggcaggttcacgcggtcaaaccagccgtcgccgacgtgcagttccgacgattgattccatcgtctcgggcatagaattccccgcctgcttctcactttcacaggtcgcaaccatggatggctccgtctccgtctccgtgctagtggaaaaaataattgaggcttctcgttgggtgtatctgttaaattaccgaggaaggaagccccagtgtgcctgtgccccctcctcgtctttcgtctcttctctccttccttcctccccttctcttcctctcctcccaccgagtcgccgccctctcgctttcaacccccacacggaagcaagaattgttcatcaaaacccgatctttggcgtggccccgtggatttcttgcgatctgtttggtgctatggatttctgatccggggtttcttggatcttggggagtaggaggtggggggcggcgatctggccgggagatggccggcgggaaggagccgatcgaggtcaagttccggctttttgatggtacggacatcggcccgagcaagtacgacccctccaccaccgtctccgcgctcaaggagttcatcctcgctcggtggccgcaaggtgagaggcagaagattcctgcatcaattcgataagagtacacggattttttttttcttttttgccctgatctgctgcatctttgattcggtgaaagcacacgatggcttgtgataattcttgatcccatgtactttcttggatcatgtatattgctttgcgttgcgccgtcttatttttgcgtggtgtttatgtggggcgtttttttttgtacttttactaccctctctttcctatggttttgctcgtgtcacatgcttacacaactgttaattggtaatctgttcttctctgaatggatacggtgaccaactgagtcacgcgtaactagtccttttccaccttaactttgtaaaactggatttgccagataaatacatcgtgaattgacaattccccttctcagagtatgttcatcatccatgaaaaatcccgaccacactacttgggatcttgccagaataatatttccgctagtttgcagcataaaacctcccaaaaaacacatttcaggcaatgatttggatcacaaataagtgcgatgaagggccaaacaagaaagagggtagtcttcctatgtcctataaagagtaaagacacaaagaagacggcacaatgccatgttaataacagtattatgccttttgtatacctattgctttcctacattatctgaaggtagttctgctagcactatagaacttagcacatctttggtcctttgcgtcaatatgattgctgggccattcacaagtaaacggtaaggatgaactctggacaccgactgtggtgctaatgtatcatttttttgggtggtgaaaccatcaggacggatgtgacgatttcaaccacagctgtatttctattaacactatggaacacataaatgatttggttgtttgtacacttaagcataatgatcagcaagggccacatttgtcatgtggcacattgaagttactgacaaccaccagaatcttttgcatagtgcaaccttttgtctggctgatgttttgccaaaaaagatgctgctgtataaatggatgtccgtttacattaattgggaccaccggagaaagatttggtgtgtagaatggaaaatctaataactgaggaaatggataggccaacaattgtaaaaaaaaaaaaccatctgactatcacactcagacaggagttcttttcttgatgtgcaatgcttgggtgaggtgctccttcctgagtaaactagagcatgtaaaattgaatcctttgatcctttcccagttgaatcagtgtctgcaagcaagatattcctcctgcagtacttttaccttcattgaacacacactgcattacaaactcgaaggctggaaatggtgcaatttcttttttgagatactattgattacaaatgagaattaacgttttctggatgtcctcagattgacctgcattctgaagttctctttgtaattttgtaaagattcaatttcttcataatccatacttgttatccttatattccaaatttattttattaaagggattgttctttatctttttatggcagataaggaaataactccaaaaactgtcaatgacctgaagctcattaatgccggacggatattggagaataaccggacacttgctgagtcccgtgttccagtaggagaggttccaggaggtgtaattacaatgcatgtggtagtacgccctccacaacccgacaaaaacagtggtattgccgccaattttgtttcttttttttcacattgtttttctggctgcactgatggcctatttcgcttctccgttgacacaaaactctattaaattcaacgaatgaaattatgctacagctgggtatcattctaagactgtagtgtcctgtcctccaaagatgaacatgtatagggatagtatctgtaatctgaatacagtgtcccacaagaagagcccagccctttttccaatagcggtttgttccttgttttattttgtgtagggtttaattgatcaaggtatattgtttggtcaattacttgcatggaaattgtagagcagctgagctggtgtttcctaagttgatagaggcatgaaatgaatatttcgagttcttttcgcaaattaacacgcttttatgatggataggtctatggtagtcttgtggcataagaaactgtattaacttttttgatagcttcagtttagatttgttacatgttagaagatttaaataggacagtttggcgccgttacttctatagattgaaatgggtgttgggttggttctcaaccatgtttacactttgcacataaaactacagcctacagattcacaaaacctttttgtttatagacatctggctagaaaataactacttattctaatgaactaaagtattttaaaactacgattctgcaactatttttggttttgactctcatggaactataattctgttgtttatatggtagtatttggctaattaaatgcttaaagctttcatctagaccaatttgacacctctatatacacatctataatgcgttgctggtttctcctttccagagaagcagcttgcgaattcccccaagcagaacagatgtgggtgtaccatactgagatacgccgcctgcctgatgatgatgtacaatgtctcgctctaggattttgtatctgctttcctgtgttcgcagctcttgtgaattcattttgacatccaattttagagccattcaaatcctagaaatatacatactttaacacccgtcaaatatgctggggagctggaactgaaggttcctggaggatgcgtcatggtgatcttaatgttgtaacgagtgtgcaaaaaacagggattggatgctttctgttgtataaattgtaatgtgaaaacgaaaaaaattctctcctttttcttttttctcttgccacattgacattttatcgattctttttagcactggtgtttgtcatgtaaaaccagaatattgtactcatatatgtaagctgaaaaaaggggtgttttattctgttacgtggacggaaaaaggaaagaaaaaaaatagaatctgtcctatagttatcccatctggaaacacttttgggccaaatttctcattatgccaaagaatcactttgctactattttcaacccaattattttttggcaaagttaaaaaaaaagtagctacatttagtttgctattaaatttagttagtaagtacatataaaatcttgctaaaatttagcaaccatactaaaacttggtaagattaaaaatggtaataaagtgaacaagcctggagataccaaaaatctgagttgcaagataggaatttaacttaactttatagtgtcactgacatgtggggcctggctgcgatgtgtcgatgtgacagcaacagctttacggcccggcccaatatatctagcggcccatttaccaaatacaatagcatctctcccgcttgttacaggccgtccgattctggccgctcgcccatctctaccgttggtttccgccgcaaggctcgcgcggctcccgggctccgcctccgcgccgcttctccgcttgcgcgaacccaaccccggcgaccccgccgccgcaaaacccttccaccctctgctctctctctctccggctcggcgtcgcgcgcgccgtggaagaggccaccagtcgcgggggcgcggcctcccgtcggtgatccgacggcgctgtataagcgtgatcgcttggagcgtccggacccgtcgctggctcgtgtgcgtgtcaggggtttctccggctgtccgtgcgggtgcccgtccggtacgggatcctcggccctcctccgctgtctccgccgagggaggaggcagaccggccggtcgctgactcgctgcatcgatttttggtttggtggagttcagccttaaagacggcttacgccagatttgatctcttccaaggttagcttccgctttccccactctggactcgtaatttctgataggtttgcttgtgaacggttgaataattgagtctagtcttatccagagctttagggctcactatctgttgtgcagcgaatttattgttaattgttgcatgctgctaattaaccgttgcccttttctttgttgtaaaaggttctgcagtcgaatagtacttgcgatttcattttattgaacgagttaggcttaccagcatgccagtgtggctaatcttcagtttttcacacgtaggatttgtatgctacaaatattttcgaggatagcaacacgaatccctcaacgagtcatctgtgcatcgaattcatatagttcaaattatcgaagtactagcacaagcagtcccatgaattcaaatgaaatgctgggagctcaggaaacggtatctactgaggggaacaacagctgttctagtgttcagtccactcctgacatagagaagaagtatgtgcatcgtgtatatgatgccatagccccacatttcagctcaacacgctttgcaaaatggcctaaggttgcaggattcttgaattcgttgaggccagggtcagttatactggatgctggctgtggtaatggcaaatatctgggcttcaatcctgactgtttattcataggatgtgatataagcccaccactgattgatatatgtgctgggagagggcatgaagtgttggttgctgatgctgtcaaccttccatacagggataattttggtgatgcggcaatttcaatagcagtactgcatcatttaagtactgatgccaggcggaggaaggccattgaagagttgatccgtgttgttcggaaaggtggtctggtgctcatcactgtctgggctgtggagcaggaggacaagtcacttctcaacaagtggactcccctctgtgagaagtataatgaagagtgggttgatccgagcagccctccagtgcgtaatcaatccaatactgtgcttgaaagcatatcagagactgatgaagacacaggtgcagtgaagcaaaggaatgatgatctgaaaataagtaatgatggtttggatgataacgccgatgtaacttgcagcaattccaacattgatgagtatcacaaaacccagcaggagtactttgttccttggcatcttccatttcaccgagctgaaattggtggtgcatctgctgctgctcttgaaaatggatttgcaaaaagagatgacaagaagggtactgtggtctacaaccgctattaccatgtttttgttgaaggagaacttcaaaggtgaagcattcttactctgagctttagtataaaatgctcctctattctttctttttttcattttccccaattttttctatgaaaatgcgtgagttaagatatatcacattatatataagttcaccagaatatctccatttcatgttgttgactgatgatttgaaatttctattgtttggctttgagatattttcatacagtttagtagtttactagtatcagtttttgtgtttagctatgcaacaatggtatgatacacaatacttgcgattctaaagttttgcttttactccctccgattcatactataagtcgttttgacttttttcttaatcaaactttttttaggtttgaccaagtttatacaaaaatttagcatcatctacaacaccaaattagtttcattagatataacattgaatatattttgataatatgtttgttttgcgttaaaaatgtgctatatttttctataaacttggtcgaacttaaaaaagtttgactaagaaaaaaatcaaataacttataatatgaaattgagggagtatgtttgatctctggtcttttggttggaaatatctcctatctctggcacattgtctcattaatttcatttcaggttagttgctggtataaacaatgcagttgttgttgacaattctatgacaaatcaaactggtgcatcgttcttgagaagctttgaacatgcagctaaaagtgccggggagaaactcatctggagcctgtgcccttgtatctttgtaaggactgccagttgtaggcgagcacggttttgcgctccaaatgtacgaggcctgacacaaaaaaactgcattattgaatttagcatgtcataattctctattcacttgttggtgaagatcacttttgcccgttgtcatcgcgggaatcttcaggttgatcttttcaggattgcccaattagggtcatccggatttgcagaagtttgtacttatgttctcatcgaactggtgaattttgcaggtttgcttgtctctctcttatgagagtatgatgtactgttgtctgatgtatacgctaattggacatttccgccagctttcacgcttttcctgtgtacgcaatacgcccgtaagcgtgttacagacatgttatttccgagtggcaaaattgcatcgtcaggatgcatcacctgcgcaataacgtcttaccaggttgataaactgatccatgaacgtcttaccaagttgataaactgatccatgtacaaagaaaggtaagctatcagaacatgcgcacgagatgcgaacaacaatgagaagcgatacttcagaaacctcaaggttactgacagacagaattgcaggcttgcagctatacgaaagaggagctgaacaaaaaagaaggaaaaaaaagaaacccctatgctgattttacaacacaactatgaaatctacaagactacaagcagcattagccgacgcacaaaagatctcagcattcacataaagaaaactgcgttatgagccaatcaatcgctcgtatctccaaagatactgctatagacagttttagagataaattaattgcattctccgtgctgtcaggcaacgcagagtatgagcttgtaagaactaactgaccgccccatcacgcagcaacttgccaaacgcttaaatttggcttgcttgaagtgtcagttccagaattgtttgcggactccacatctggcttgcttgcagagtttttgctgggtaccgtccggggtttcttgtcagtgttgccaaatgcctccaaagcatccaagaagaactttttatttggaacaataccctgtgagttcatccgtttgagcaacttctgaataagcttcttgtcgtttgctttggtgtaggccttgtaaagcaatttgtatgtggaagcactgggcacagcacctttcttaattacagaatctaacagctgatctgcttccatgggcaagccgttcatgcagtacgcatcaagcatgcgttcactgatgacaggtgtacattattttgtgagctcacaagctcatcgaatatctgtctggcccttgagacacaatcacaatatgcatacatcatgattagacattcttgtgtcacatagttcggtttgaatcccatttcagtcatcttatcaagcacacactctgctttctccctgagtctcgctttcccgtagttggttatcatggaattgaaagttgggtgtgtaggcttctcctttgatcgtagtaagctcttgaacacctgctccatcttatcgaatgcctgctttcgcccgtaagaatctatgagtatgttgaatgtgattacatctggacgacattgattgcttttcatccgtactagcacagattccatctctgtgatcatgccattcttcccgtaagcgtccatgactccattgtaggtatagatatcaggagagacagggctttcatccagatccttaaacaagatgtctagctgttttgtgtcaccagcctgagcaaaagctcttaggagaatgttatatgtcacaatatttggttggcacctatcaatagtcttcatcttttcaaaatagccgagagctttcgccaaagccttgctcttgtctcgcgaatgcaaatgtgtgccgataagagaattatacactgaagtgtccggcctacacccactgttccgcatctgagagaacagccacattgccatccgtatctggcctttccttcccatcacagatatcagcttcgaatatatgccgttatcagcaacataccacctttgtttctgcatccatctgaaaacctagcaaaatagaagagcagtaaggaaccagtagatatgtccaacttacaggaacttcaaaattcatctcttgttgatccacatcaacaccctaaaatggcacttatgatagcaatcaggggattagtacacaaaagcaggcatactgctagtcaattgtgatttgagttgggctcataggcaaagattatatgtgacacgaa

SEQ ID NO: 69475 - DNA, 1543 bp, Oryza sativa
tgtgctccctccgtactcgtaaagtcgtttagaacaatgtttatgtcaaaccttaggaatataaatcataaataactctcaagttattgagtttgaaaatgtaaaaattatatgaatagatttgtcttgaaaaatactttcataaaagtatacatgtatcaatttttaaataaatatttttatagaaacaagaagtcaaagttgtgttttggagaccgtgtcgctgtccaaaacaacttcctttactagtacggaggtagtataacgttttatggcatattacctgacttacattgaagcaaaagttcagggcacgcataaaacggaacaccacatgatatattgatctcgtttatcagatgaaaacaatggcactttctatacatatctgcaaactctatcggcaggtacataatggaggagcagcctcgctatagtttagtatttgaagcaaattacaagggcaacgaaagaaaagagaattacattggctccggccaaaaaatgaaaagaaatgcagaaaagaatgttgtcgtgatcgtcatatgtatttgagcctcctccattatatcttcagttctgaaggggatgaggaccagcattcttgacaagccttcgagattccctgtgacaatggagctgcaaaaggatgaacagtctgtcactaattaaactgcatttgcatattagattgacaggtttgcagattataagagcagcctcatgtgatcacaaaagccaaattccttcgccactttgccctaatgccctcacacttatgaactactttcaatgattgttttctctgctccatcgcacaagacaatcttctacagttctactctgaacttggcagagcaaatctattgaaaacttcccccatgaggccgagacatggagctagtgaacgcaacacacgctactctacaaattctgctaaaaaaaatatgcaggccaagataatcaaacagtgcaaattttggaatccagctatgtattatttcagcagtaatgcttaccaaacattcaacaatcacatgagagcaatgtatgttgcacttgcacaagagtaagagacaacaggaggagaggacctaagggccaaggcagcgccgccgggagggtggtggatgccgatcagacgtcgagggttactgcgggcatctcgaactcggaggtgatctcctcgatctgcttccggacgctcatgtcgatgaggctggacccgtcgcggccgtactggatggtgaagccggcgatgagctccgggtcgatgcgggtcttgacccggacgttcttcgcgccggtgagattctgcacctgctgcgcgatctgcgcgaggtcctgcgactcgagctgcacgacggaggtgacggtggccacctcggtgccgggagcgagttgaaggcgttctcgaactcccgcacgatctgcgtcatgaggcccgcgcggccgttgtccaccacgacgttgaggaagtcgacgccgtgcgcctggagctccgacgacttggcgatctcgtcgatgagctgggccttctcgt

SEQ ID NO: 69476 - DNA, 3329 bp, Oryza sativa
aatcatggagtggcatggttctaattttagaagatttacaggggcatctacccgataacgtgaatagtagtggcatttttctgatttgccacatttgcagtggcatggatccaattaacccaaaattgaatgggctattcagattgatgccaatttttggtaaagttgacaaaggtgtgcatacatttattttcttgctaaactttgataaacacatgagaaattctaccaaaattttgataatattattctcaaaaaaaaattgataatattaccaacttattaaaatttttggcaatacagggtttattttagcaacaatctgaacagccccgtggtagattctagcacccatatacagtaggacggaacgacccatcagaaaaactgtaaacattgaatgtcgtgctctatgaaatcccgtagcatttcaaaacatggatacaccctatcaaagccaactctatgcattgcattctatcaatttcctcctccttgctgggttttagctgtagcctgtagacttgtgttaacaccatactggaactctccatttctctaccaaattttgtacttcctccgtttcacaatataagtcattctagtatttctcatatttatattgatgataatgaatctagatagatatatatgtgaaatgctacaatgacttacattatgaaacggagggagtacatgacaccacaacttcaattcttcaaagcaggaccatcaactaaatatcaccagcatttctctcttttttctcccccaaaacaggagaaaattttctgtgctgtaaaactgcttaccttgaaaaagcaacttcttatttggtttcctatatagataattctacggatgggtataaccaataaactctggtacaaccagattaacaaaccggcgcaattactgaagtcgtcaatgcactaaacagtaatattcatgagctggctatagatctgttcaaatcatacagaagcatcggctgacaaacaaattgcagcattgcagcgcaactccaggctaaaacattccttaagtaagcatgcaaaaatccttgtggtgtgcgaggcattaaaatgagaacaagagtgcactaaaattagatgtttgtctcaaaaagcacagatgaaatcacaaatacagatcgctagaaatcatctaagaactgagcaagatgtaaaatgcagaacattatcaagttcctaggcagaataaacctccagcatctctgttttagatttcaggaaacattttcccttcacgggcagccagataagctttttcaagtcctggaacagacctgtggtatgggagaaggaacttcttaaaaaagctctcttcaactattttaaccatagagtaaaaatcagtgtctttcttcagcaggcccttttcattcagaaccttcatgacatgataacgcggcatcagccgtttctgaatgctatagcgagcaatgctgccgggagcacaatgtactgaggctccaacccaacctccgctttcaggaattccagtgagcggctcagcttaacttctgagtatgtcaggattagtggaaacctagacaccgcaatgtgtagctgggcatctgagcatccaataaccatcctcaagaaatcaagttttgcgctgaccctcactgggctgatgccggtaacagccatcagggcatacctgaaaccagctgactcacggggcataccgaacttgtctgcacacgccacaatttccttgacatgctctggctgcataatgagtatcctagagccagacatgaggatcttggcaatatcacaagtagttaggccgcactgctccaggaatgcaatgttgggcttgacctcactctcgatgttgtttcgccgtagaagggaggaattgttccgaagggcggagtgcaccctggggtaggagcccaaaaaggagaggtagaattcaaggcgggagatcgtgcgaggattggagaggatgcagggggcgatggtaatgaggcggccaatctcgggagtggataggccgatatcccggagccgggctacttgggaggttagggtttcgtccaccttgagatggaggaaccgcgggtaccgtgagcttgcggcggcgatgtcgtctttggagaggcggaagtcggcgagaaaggcgaggaaggtgagggcggcgtctagatttgagggtaccttctgtagacgcttcgaggccttgagggcttcggctccggtgaggccgcaggcggcgacgagggcgtcctcgtcgacgaagcgggtgggggataaggtggcggtggaggcggagagaaggcggctgctgaagtgggaggcagggagagggaaggcggcgcgcagggcgggaaggagctgcttttggaggcgctgcatagcgccggcgcggcggcgcggcggcgaagggtcgcgccgcgaacggacggcggtatcgtgccctgtggtgagggagatttgggcttcagtcttcacgggaagaagaaataaggcccgtgatcgagttccatcttgggcctacggaacacaattttagcccaaagtactgtaacccatgaaatcccggatttgttgggcctactcaactccacggcatcctttttcactctctttattactccctccgtttctaaatatttggcaccgttgactttttagcacatgtttaaccgtttgtcttatttgaaaatttgtgtgaaatatgtgaaattatatgtctacataaaagtatatttaacaatgaatcaaatgataggaaaagaattaataattatttaatttttttaacaagataaatggttaaacatgtttaaaaaaaaatcaacggtgtcaaatatttagaaacgggtgaatgaagtatatggagtagtgctttttctaatcttgggttgcctaagtttttgctttgcaacagtaggcatgcaatccaagaaacatgctagtatacgataggaaagcctctgcctatccagttgaacagcttgaaaaataacctcttctaaagcttcagccgcaacttgttctatgccgtagaggaacactcctcattctgatgatttgctgagaaccagatcaaccttttccatctccttatgtagagtgttcttccctagtcccgcaatttatctagttatatctttgctcagatggttcttcactttctctcgttcaacttggaattggaagatgcacatcaggacatcgtgatcgctgatcatgccagaagccagctagagtgtaagcctgtaacaaagaaaatgagtaccataggagacgtaatgctcacagattttatatgaaaacccactgaacattgtt

SEQ ID NO: 69477 - DNA, 5244 bp, Oryza sativa
tcacaaaacaagtcgtcgttcctcagtggggtatagtttggacgcgtatgcccctgatgcgagagccgagtgacgagcggcgaggcaagaaacgaggcgacgtgattaatgccgccttaagctgaatggacgtgattaatggcacacgcacgtcgctcgcacacgctcgccgctcgcacacgcgcgtctctcttccttgccgcccggctgccgagcgccatgatggagtacgtcgagtcgctagagtacgtcaaggcgccggactccgtcgacgcgctggacactgttgacgagggcccaaacgagcaccatgcaaaatcagcaaaaaaaacaagcccaccaggaatcgaacctaggcactaagccttcaaacctcactgcactagctatttgagttctgtttgtttctcaaatgaatgcacccgcaccctcatttaataagggaaaacatgaaagaatagccctgattaatcactccttggtaaccacaattttgttttaaacgacttgttttgtcggtatggagggagtacgctgtacgcccaaacctgtcctgttctttgggccgtaggctccgccctttgcttgtagcggtcgcccatcaacggcctaattggagtccagccaatttgtccggctgttacgctggcttgcggcccgtgcggtcacgatcatttttgcaaaattcagctgtagaatttggtttgcatttggatgttagaaacgtagcagcagtgataattatgttggtttccgcatgtttgattcagcatagaattattgtaatttaaattattagaagtaaactgagataaacaagtaaattattactccctccgtctcaaaatatatcaacttttacttggataagatgtaccttatatcttatatccagattcatagtactagaatacgtctcatccaaccaaaaattgctatattttaagacggagggaatatgatagattattataatccataagtcagattagtataaacttattatattatagattatgggagacatataggacattttttagccacccaacaaaaaatcactacccctatatatctctaataataaaacaaacaaacaactcacaacttattttatatcaacttattataatctagcttacagtaatatgatttaatattctagattataataacattaatctgaaacaaacgtcatcattgtgcactctctggattaacttttcacattctggaagattagtgttgccattgccagcgttaagtgacagtcacagtcgcacagtagcaatggcagcgttgagctttgaattataagttctatgaccacaaatgcatatttcctcgacttcgcttttttttttctcacacacatttgcattttttttaggtccctagcacgaatctcaataaaaatacaattgtcaaaaaattgcaatatctctaacaaaaaatcttgcgatagatgtataacaatttcagtgtttatttgtaggaaaaatactataattgcgttgacatatttttagtggattacagttgattttcatggcgtttgatttgtttaccgtgcaagatacgattcttcagtgcaaactatggaatatatagtgtaaatgcatattgaaaattataattatttttaagaaaagattatatcaacataaatatagtcggtccaaaaaaaatctggcgtttatattgttgtgtatcttcacttttgcactagatcaatttgaaaacttccttccaataacttataaatagatatgagaaagatatttaagtcatgcttgacatagcttcagattttattatacataagaaacacaacggggtgtcagacggtccaagaacatatgcgatattccgtgcagatacgaggagctttttttaaaaagaaaatcccaacaggcgtaaaactctccgaggagccgaaaaaaatcaaaaaaggaggaaatccgtaacattacaactgttaatggctagttatatccacggtaaatctaaagtttgtatgttaaattatagtggtttaaaattttaaaaaacacctaaaataaaaacgaaataacttatccaaatattatatatcgacgtgattatagctttatcgatgatttatcaagtatttgtgatgttaagaatactcaatttaaaaaatcttggatcgggagatgcgtcaaaagagagcctcaatgtttgatatcaatttcaaaatcttcctggcggcccttctttccttatttattttttttagaaaaaaagaaaacaagcttcctggccgccgaacgcatgcagacgtgccctttgaggctggcgtgttcggaaccccttctcccaaccctctcgctagttctctgcgcttatgtttttcaaactgctaaacggtatgtttttttgcaaaaagtttatatgaaaattgtttaaaaaaattaaattaatctattttttttaaaaaaatagctaatacttaattaatcacgcgctaatagactgctccgttttttgtgcggagagaacgagttcccatcctggagatgcaaacacaacctgagacttaatcgagtgcgtgcttatttacttcgctaggctacgacgaaatcacgaaaacccacctactcaatgtatgataatcgaattaacaatcttcatggccaccgaacacatgcaaacgtgcccaatgagacttttgatcaagtgcttacgtgccccaccagggtacaacgaaatacggatgtgtgtctgctcaaggtcaatttccgcgttgattagtcagttcgttaacaacatcgactactctataattaagttaatgattgggtaaagacgcaggaaacggatgcgcatgtctgggaaggactagttcaagatgtcgtcgtcagtcagtcaatttcaaaatcttcctggctatacatttttttagtggctggtccaaaggctggacaacgtcgccacagcagcatgcatacatacatacaactacagcacaaacaaaacacgcagcgagaggcccgacaatcaactcacgccatttttaacatttttcacgccgcggctgctggagaacgattcgctagttccgtgggacaataggtgggctgcagggcggtatatagaatagtcatcagtcgtcagattcatgcatgggtgcgttgcgtttcctataaatacatttggccagatggccatctgcaaatcagcagcttacggcactagttagctactgtgcaagaaccaaacagttaatcgcatacagaatctcaattagctctgtgtttcttacccttggattggcgattgaattgtgtgcgttcggcgatgggaacagccaagttacctgcattgctttggttactagcaggcgtggtgttagcacttgcagttaaccccgctcatggcgccaagactcgccactacgatttcttcgtaagtgatctacttgaattctagcgtgttcactgatggatgccgatgtacaggcatgaatgcacgaaatgagttttgagttttaaccatgcgtgatgccccccctgcagattacggagaccaactacacgaggctctgccacgagaagagcatcctcaccgtgaacgggcagttccccggcccgaccatctacgcgcgcaagggcgacctcgtcatcgtcaacgtccacaacaacgggaacaaaaacatcaccatccactggtaaaccacatccgttttgccacctgctgcagagaagaagagcattatccttggctcgaaacttacggtgttctcgatgattttactgtggcgcaggcacggcgtggaccagccacggaacccgtggtcggacgggccggagttcatcacgcagtgcccgatccggccgggcggcaacttcacctaccaggtgatcctgtccgaggaggagggcacactgtggtggcacgcgcacagtgacttcgaccgcgccaccgtccacggcgccatcgtcatccaccccaagcgcggcaccaccttccccttcaagaagccagacaaggagatacccgtcatccttggtatacacaagccacaacaaactaatcttgttaatttgataatgttccattgcgcaatgcaatgcttcgtacgtgttttgatcttaaccatctctatgatgttctgcaggtgagtggtggaatgacgacatagagcacgtgctcgacaaggcgcagctcctcggcggagacgtggatccgtccaacgccaacaccatcaacgcccagcctggggacatgttcccctgctccagggacgacacgttcaaagtggccgtgcagcagggcaacacgtacctgcttaggatcatcaacgctggactcaccaacgacatgttcttcgccatcgcggggcaccgcctcaccgtggtcgggatcgacgcccgctacaccaagccgctcacagtcgactacatcatgatcgcgcctggccagaccatggacgtgctcctcgaggccaaacgcaccttgggatccaacagccggtattacatggccgcgagaacgtttatcacgttaccgatcgacactatccctttcaacaatagcactgccacggttatcgtggagtacacgaacagcgtcaccgcgaggccggtcgggccaccggaattccccgtccagctgccggccatcaaggatgagaacgcggcgatggcgttcgtcacgcagctcagatcattaggcaaccaggaacacccggtgcacgtaccgacacatgtcgatgagcacatgctcatcgacattgacatcaacgttcttccctgcgaccccaccaacatggcagagaagtgcaaagaaggaccccaaggcaaccggttcgcggcgagcctcaacaatgttagcttccagagcccggctatcgacgtcctcgacgcctactactatagctctggccacggcgtgtacgaggaggacttccccaacaagccgacagccttcgtcgacccgcccgtcaacaacggcagtgggcccttgatgacgaagcgtggcaccaaggtgaaggtgctggagtacggcactgtggtagaggtggtgtttcatgacttgtccagcgagaaccaccctatgcatctgcatggcttcgccttctacgtcgtgggacgagggaacggcaccttcgacgagagcagggacccggcgacctacaacctcgttgacccgccgttccagaacacggtctctgtgcccaggtccggctgggccgcaatccgcttccgagcagacaatcca

SEQ ID NO: 69478 - DNA, 2023 bp, Oryza sativa
tgtttttacagtcacatacaacaaaaaaatacaaatgtaagtaggaattaattatagtgtaactaagatgtaattgatatgtaagtagtatgtaattacggtgtaatagatatagtggctactggtgatcctcttcgtttctcatcatgataatgatgaataatgaatactgatcaatcggtcatatcaacatgcatgtttggtagactggcagaaatgttagaaggctcaggaggcacgagcaagtttcgagaaaggaagccaagaaaagaagtaaaacgcatgcgtgaatgctcagcaaacacaaatctctataccatcctaaagctgaaaattcaactgtgttttgtgaaaaaatttgtcaccataattatagcaaatcagaatgaatattcaagggaagagatttcaatccttgcgtttacaataaaattgattgctggacttcttccaaagctaaatgacatttgaccatctaatgcgtgcatctatcctcaaacatcctgctgatcacaacaaggcttagtttctccttattgattactccacacttgcgtgtagctttgtacagtgtactccaggatttgtttttagcctttttggtcctatgtcgacggtttatctcaatgctattgttcctcacattcttgatggttgttatctcttaccaaagggtttcaaaacatactaattaagcaaaggtttgtgttagacttgattgggcatttcttaaaaaggtttgggcagagttgtctcagttctcagatatggctgggatgttcggcaagcttaaatgtagacatgcaagtaaattataaaacatggctaagtgtatgtgcgtatgtgctcacacccattttgtaatgcatatattggcatatgcatattatcttcagtgagatattatgagcatgtttaccattttgtaaagcatatattggcatatgcatattatatacctctggatttctaactgtcttctataaattctcagacaaatgatgcacagctcagtacaatggtagcagagcaggtattccttgacatctactatgaactgccaaacttattagttttaatgctattgttaatgctttgctcgagttacggtttctgctactatcatttgcattcccccctcaatgtttgtctgttggattatagtttttctgtatgtgcatattttatcacttataggttgagcaagcccatgctggcatcaatgctcttgcactatctcaggaaacaataaacaaactacgcgagaacttcatagatatagacaagtaagctaaaatatttttatctctacattttcttatgctcttgcatgattgatatgctagatcacttccttgaggttatatgtttctcctcatttctcagtcctgtttatcataaatgtctggcaggttgtgccaggagtgtcaaacattaattgagaaccacgacaagattaagcttcttagcaacgcaagaaataacctgaacacacttttaaaggtgtgctgaccttactttagcaataacaactgtattaaggttgtacttgcttgttttttactaacgttcttatcaatacattaagctaaccaagttatcgagcacgaaaatttcatctgacatgttgattgtcaatgcctattaggatgtgggaggtatgatgtctatttctgttgaagcagctgcagcacgcgactcgctaagtgatgataaagagttaattcgcacttatgaggttctatttttccctctttggatcactgatcaataccatgattgatattatagctctttttttaaatcaggaattgatcatagttatatcctacttgcctgactttgctgtttgatcttatttgttgaaattagagattaacagctcttgatggaaagagacgttttgctttagctgctgctgcatctcacaaggaagaagttggtcgattgaggtggtgtttctcccctgaaactagctaatattaatgattattcaatgcatacctgcctcctcccccccccc

SEQ ID NO: 69479 - DNA, 1300 bp, Oryza sativa
ttgttgggcttacagggctcggggaggcaggagccaacccaacagaaagcgaagatgctagatttggactcctccttactatatccgacgattccccaattgtcgaaggaaaaaagaaaaatgagagagagagttagtgtgcagagtgattgcagagtcactgatttggaggtggagcgatggtggagtcaccggacttggagtttgatggatagaatgaggtggtccaaattgtaacaaaaatgtaaagttcgtttttgtgtagataaaaagaatgtttaaaggatgatatcacatcaaaacttttaaggatacatgtacaaattgtaatttatttatttttctctagcacaattaaatatgagttatctattagcaatagtctcgtgctatggcaagcccactataatttgtctccacggtatgattggagatatattgaaatattatgtgaattatgtgggatgatgattaaacatgcttgtattaaaattaataaattataaaattatagataatatagcatgcttacatgatgtttaagatgtaataattgttagtggatgatgatgttatgcttttgttagtaaccctctgttaagtgctataaatagactattttaccgatatgaattgttgaaagatgaataaaaatttttactcttttaatcaacgtaaataatttagcgtaaagagcaaactacaaattagtgtaaactaatggaaagagtaaaagttttagtgaacttttaataatttgtaggggtaaaatgattttattacaacactttacataggaatgctaacgaaaactcaataatgatggcatttctaaggcaaaaacgcttgtacttagaaagttaagtttatcgatgacatttattagattttctctaaaataattagattgtgcttctcaagcgcatgaaatgcttagcagacgcaatggatttggaggtggttccggttggaaaccggatcctctgagggacgtccgaccatgctgattcgttcgatcggcatcggacgggagcgatggaacacaggaacgaacaagctaagctgtcgcggcccacgtaagaaaaatcggcccacgaagaggcttgactgccgtccgcccgtctccactctcgacacagccggagcgccgctggaaggggaagagaaggcaagcgctgccagtcgagctccggtgtgaggaggtcgcaggagtcccgggttgaagtggccttggctttgtccggatcttccctgcgctccccggcacagctcgcgcgcacgggcgcatgtggtgaccaag

SEQ ID NO: 69480 - DNA, 2701 bp, Oryza sativa
caattctcttagggcgtgaattcactctactcgaaagtcgcagcatcatttactgtccaagcttgctccatatgcctttccgtgctgttaggcacttcaatttgccaaacacaaaaccagacttttgagggttcccgtctacaagagagttctcgtatatttccctgcactcttgtacaacctaagaacgaggaatgaacagtgaacacgtaattatcaattaaaaaattctgactaacagtttttctaatcactttcaaaaggcataatttgaccactggaataggtctaatttgcactgtttcgcacaaaattgaaccgcacatgcatatgatgtgaaaaatgttatgttcttacctctttggcttccttccttggaatgccttccctcattcccacaagcttctcaacaacctcaggctacataacgtagatatcaagttcagcacatcaacagaaatgaatgcactactaaaccactaatttctggcaaaatcgagtagcttgttgaaaaaattaccgggcaatctggttgatgttccagaatatttgtataaatgagagtaaaactatccagactctcagctgaagcaagctcccttagatcagccagaatccgcactctggtttcaactttctggagcacaaaatcatagagtggttaaagttacagaaccaacaaataagcatttgtgaagaaaagtctaggattacagatgttcgatgctaaaattgtaaaatccagtttaattatacaatagcacaaaatacatggtatcgtgggtagcttggactttgaatgaaagccacatgaatggaagttgcaagtatacttactgtcacattaatgtgttctctgaaaaaatccataagcacttcttcatcaagcctcatcctttcgattgtttcttcttttatatggcctttctggaggtgcaaagggaatacatattatcaatttgaaataaattaccagccagcagctgcataagataagtagacatgtagtgtgaaatgatgggtgtaattggtaaaaagattgtctgacccagcaacagctcagtacagaatgatttatgaaacattttccaattcatatttttgttaacagtcatttttgtacagagaaccacaactggccaagtatacaactattcagtactaagggcagttctgcaaacctgagtaaggagatgatcaacgtataccacaattgtttgctccaggcaagcctccacaaatcttcgaaatgatctttcttcaatatatctagaaaaaatagacccggaagtcttcaaatcaagtatagaaagaaacatgactaactattatcaggaataagtgaccgtttacatgccacaaggaacacaaatgatctacaaaaggttaagaatagaacttatataacaaagaaaaaaaagtaaaaagtgtacgtaaaaattgcattggagctacctatgtttatatactttttgagaattctcacttgcatttggaaaattatcaatttacacattttcactatttggcaaacaatgtatgaaaatggttcatgcttgagatttggggttgagatttttcacgtcgtggcacacaatttgataggatgagattttctcaaaatgtgtagagtatcatatattcataatgaagacataggcaaataaaataaacataagtcagcatttcttagggaatgtatccttccgttccataccacttatattcaattatatgagaacttactgtttgacatccccaaaataatcagcaaatgttgcgacaagatattctgtaaccattccttccatccaatctgaataaataaaaagaatcaatgttagaaaagagagagagagagagactcacgaaaaaaaacacttgtgcacactacccattaaggttaaacactcaggaacacactgtaaacaagaaaagactagtacataaaatatataaacagtgttgtatatgatccttggtacatcaaaatctaatatatcagtttcaccaaatcacacatcggtgatggctatacttggtcctaagcacaaatttaattgtgtaagcatacatgttagaaaattctgggtgcctttctgggcttgtcgataagactctcacaagggaacaggagtcgctggtgctttcaattccaaatctaatcaagaacatgacacaaacaacagaagaaatgacagtttggaactaatattgcaaaagaattacctttttggtaaactttcactagtagatcctgtacacctgggtcttcaaaaataacgctgacagtttgaaggactgcctcctgttgaaataaccaaaattctagttaacaattaccttttatagtctaaagatgtagctaaatcaaataaaattgctcgaaagaaagccaaacttggctagttctcaggacattcctggaaagttgagttcattggtgcccaataccagttgtcagataatactggataaaattggctagaaattagcatcaactaccttgaactaaccagctccgtgctcacttaactattcaagtattgagctggcttttctacagtcttggaaaatattatgctggattcactaggtggtgctgaaagagtgtttctgacaagtgtcaacctccctgcttttgtcagtgtttcagtttctgtataatccaagcatctctaaccaggaattttggcctcaa

SEQ ID NO: 69481 - DNA, 1235 bp, Oryza sativa
  unsure (1)..(1235): unsure at all n locations
gaaaacaagctgtgcaataaaaaaaatcagctacttgctgctaactgcatggactgtgatgaccacacaataaaatcttaagtccaggatatatttaagcactacctcggtgagcagtttgtcgaagcgagcctcaacagccttcctgatatactcatagcatttgtccttgtagccctttccctggacctttgatttatcttgagtgcttcttggggtagatgttgctcctccacctttcntgctacagttgggcaaggatgagtcagaactatgagcagtcagtataataaataaaatggtttaataattactatttgagtggttctcacattggttgttggttgataatagatatctagagataatttgaataaaacaacagttatacaagtcatcatgacaatagtaaagcattcatgcagaccatagcagacaaccaagttagttacacccatagtcccgtacaatagcttgaatttgttgatctggtagccagtctctggtattaaagatattatatatgaaaagcatgatgtaaaaactttaatgccacctttacaggtgcgcagatgcacagatgctgatatggacaagaagtgcgttagtactcatatcttcagtacagttatatcagcatgaaagtaaagggacatgacaaattttgtatcctaggatacattatttctttgatcctctgaaacatgaaagatataatatcaatatatcatactacctagcacctactggaagtacagaaacatgtgtgaagcaaagaaaggaataagcatactttgcagttctacgctggttcgcgtattgtcgccatagcacctgcaccctcagcctcagatgcttcttatgcaactggttgatctaggatctcttgcatttcaacaaccctaacataagaatggatttaaggattatgtgcaagatatataagtgcccattacctagcaactaaataagaagaaagaatcaagccaattttctaaatctcaaatgatcagcttgtatttatgtattatttccctaataaatcaataaatagtctttcattcaacaagtgaactgaaagggaggaagccagggggaataattgctccacagaagaaattgatgggcaacaagtatcataactatgagctggtccaaacattcagctttcacaattgactgtacataatgatcaaagtagatattaaatagttcatgcataccttattgctcga

SEQ ID NO: 69482 - DNA, 863 bp, Oryza sativa
aataattcttattggtatttacagctacacttgatataatctttaattggaaggccaggagaacaatggaatttgcagttaaactgagatatgttctaaagttcacatagcagccttgtgggtagtattactgccggttacatatgcatacacctgggagaatccaacaggaattatcagggccatcaaaggctggtttggaaatggtcaaaaccacccatcactctttgtccttgcagtagttatatatttgtctcccagtttgctagctgctattctttttcttctcccatttctacggcgtatacttgaaagttcagactacaagtttgtgaggttcgtcatgtggtggtcacaggtaaatttacataattacattttagtgaattgcatgatagcttcgttttttatcaacattgcattttaaactcattaaatcatatcatttttacccatcaagaaaatttaggcataaatttgttaatctcttttgcagggaattaacttgatattctcgatttttctttgtaaactacagttaactactgaccaagataatgtggaaaatatagttgtgagctactacctgagaaggagacctgatatgacgaagcaaaatgtatttttgggtcaaaaatataagtaattaactctcgatgaaatattatttatttagtaaacttatttaacaaaataaaaacattatttatttagaaataaagaaataatactgtgtgtaaacaattataatatgaggaaacagtggttttgaaattacaaccttctaacagttctgtttttacatttaatatcatttttattttaaaaatattctattagtattcttggacgcactactattt

SEQ ID NO: 69483 - DNA, 1033 bp, Oryza sativa
aattcctgcagccctaatggaactccctttctcaaataggctttccatattggtaaaatgactctgggtcgcaaactctgtagcgtagcaaggttgtctggtaactttctgttgtattaactcaagtgatctattgtgcttgcaggtagatcattaactctgtatattatgctgcctctcataatgcagagacacctaaagcttttgcatattccccaaaaacttcagttaaatgactaatgaattgtactttactttagagtaagggcataggagactacaaatttctcgacttttcctacaagaatcttattctatgtttacacactaaaattaatcatttccatttttatcagtaacaccataacattatcatgcattagaagcgcatgaggttctctaaccgattatgcacttctacaaaaaaacaacttcaacaggcctataggttatccagcggtcagcatcagcagtgaatttagatttgcagtatataacttacaaatgacacctgttgccctgttggaacacaggttctccaaaaaaattggaatacaaaacacagcatacacacaagaggaaagtcacacctacttgatgatctgagatgctgttgttgaagctactcttgtctggtgctgcaaaaggaagaacagcaattcattatccaacaaagcgcagcgcctaaggttcaaaccatggggcagaatgtaatgtagaatagacagtgttaaaccccccaaaattgcatgacctataaacaattctgaaatagcccatgaccagccaattgaaatctctcctaccatccaccatctctgttgactaacaaacaaattttccggtgagccagtgcagatctaggaggaaggcactaggagggcaaggactcgtaccctcgggggtgtcgctatcggagaactccttgtcgagcacgcggccgaacatctcggcgatgctgccgtccccggtggcgttgcccgagccgttggtgaccagtttcccgtaaaacttctcccgcatctccttgtcg

SEQ ID NO: 69484 - DNA, 10770 bp, Oryza sativa
ttgtctgtggaggggaactttcaacaaatctctcctgatcatgtgagcgagtctctacttgtactataaatctttgtataatacagtagcatcgtgtatgtgtgatctgattttctttataatggataaatatctggcccctatatccacttgtgatctgaatactgcagtatatattggtagtaaatcttgttgtaatttatgaactgtctttttcctggacgatcgattgattccaaaatcgtgggatttgagtaccagtatctgactcaagcgatctgaatgagtggtggtttagcgttagttgggagaaaattatcaagcacggagcaacagcgacccattgaaagttgtagctcaactagtaatcctggtggcttattggaggcctaggtggttaggacttgggagatcgcactcagacgagtatactcgtggcagttctgtctgtataaatcagaatcactggtctgtatgtgacgcactgtcattttctagtagaccaatggagcagaaacaacggacattgttgctagaacaccaaactagcatactagcattcacgcgtaaatcggctgaaaggatggatttcgcaatcagacggcaataccgtagtgggtcgtgatgatgatgagatattgagatccatccaacattctccaaaccacttaatcacctaagactagagtagtagactgaagaggcttaagctcagctaatgctcgagtcgtcagaaaagaaaatcaggagtgaacagaatgaaagcttggttgataatgcaggttggcgttggtccacccactcaactagaagtgacagcttcttagggtgaaaatccaccaggcccacccaataaggccaccagcccaatattattaggaataagttcactttagatccctcaattgccgagtctaaaatttatccctaaaccgcaaaaccagacgtgcccctcaacgttaaaaaccagtgcgaatttcagactagtacctggtattggaagctgagggacgcgctatatctgtattgcggctgaggatgaatttcagacttgacgacaaaggacttaatcggttgtgctggctgcagccagcaagccattcacagctgccgctctttcgtttggattggggctgactggctgcagttgctgcagccagcacttccgattagggccaaattgagggatccaaagtgaacttatccatattattatacccagccgcgcgcagcctatactaattgggccggaacggcccatccctctggaccacagtattgggccggaaagggatcgtggtgtatgcgtggcctatgaatattgggccggaacgggatcgtggggtatgtgaggcccatgtgagttcggctcgaacgtgtttgttgggccgagagtacggcaggttggaaaaccatggcaatgcgtcgctgctgacagcggttggtgagtctacttcaggggatcagcattccggaaccttcgaaaagagcgcctcaccttgttcgccgtcatcggatggctacttcctacctaagaattgagcttggaacgcaaatgctggtgcgctgatccatttcgccaatggaagcacgaaccgacaaggcggcaatacatgatgcggatgcatgctctcaagtctgaatctgatgaaccaatcaagttttcctagccatgttaatttggagagatctacatctactccaggtgactgacagacagatagcaagcagcaatatatactccagaacggtaaaatctatgggcaaagcagtgaaatcacgtgtatatttatgaccttactgtactttacttgcaaaatgtattgtagtagtagttctttaaaaacaacatgcagcctcgggattctacaggtaaagccccacttaaatcaactagctagtcgtcttcgaatcaggtctaccctcgtccctcgtccagtggttgttctgtagaagaaaccactgctttgtttctttacggcagacgtgatctgaaactggcaagaaacagtgccaacgcccgtccaacgataacgagatacacgcaacagaagcgtataaccaacaatttctggaatcattttggaaggatacccgacacagtaatggtctaccggttttcatccaaatggcagagcagaacgaacagtcgaaacacccgacccgacagaacggcaaaaaacgggcctgaatgccagcctgaaccggcaccgcgccaccgccacgtcgtcatcgtctcgattggcagctgccctctcacttccccaccaatgctagggcctgtttgttggaacttttacctgctacagtttttctcaaaatcagaaacttcccccaaacaatctagctttgatttgtataatctagaaaataaactataacccaaaacttaaaaaacctagcttctttaattctcataagctagctaccaacaacttctcggaatgcatgccctagatctcctgcgctgccatgccgcatcagcttagctagcgccttcacgtgcgcatgtgctcgctatattatccaaatcgcaaaaccatccaaggcgcgcggcctcaccaaccaccacgcaaacccattgttaattaattagcggcacactgtcacggcgcattatttgctagctccagtgacagctcactcctcttcttgctgctgagggcttagctagccagtccacctcgtcggtgtgtgtcggtgtagtctagcagctgcggcgggaggaggagttgccggccggagatggcagcggcggcgcagcggcttgtcgccgctgtcgtcgtcttggtggcctgcctggcgttgccggcggcgcgggggctgaacatcacggcgatgctgaacgggtacccggactacaagatgttcaacaagtacctgtcggagacgaaggtgtgcgacgagatcaacgcgagggagtcgatcacgctgctcgtcctcggcgacgggccaatgtcgacgctcgtcctcgacgccgaccagtcgctggcgggcatcaagaacgcgctccgcctccacgccatcctcgactacttcgacccgaagaagatccgtggcctccccgacgccgacacgatgaccgacacgctctaccaggccggtggggacgccgccggcaagatgggcaacgtcaagatctccaccctggacaccggcaagatcgccttcgcgtccgccaacccggggggaaagtacgaggccaccatggtcaaggccatcaagcagatgccgtacaagctctccatcatggagatctcggcgcccatcgagttcgacggcctgttcgacacgccgtcggcgaccaacctgacgaggctgctggagaaggccgggtgcaagcggttcgcgtcgctcatcaccagcaccggcgtgctcaagacgttcgaggatgccatggacaaggggctcaccctgttcgcgcccaacgacgacgcgttcgacgccaagggcgcccccgacgtcaagaagatgcccagcgccgacctcgtcacgctcctcaagtaccacgcgctgccgtcgtacaaccccaagccgacgctcaagacggtgtcgcgcgccatgcgcacgctggcgtccaccgcgtcggggaagtacaacatcacggtggacacgcggggcgacgccgtgacgctcaacacgggcgtcgacaagtcccgcgtggcggccaccgtcatcgacgacacgccggtgtgcgtgctcacggtggacaacctcctcatgccggtcgagctcttcggcgacgcgccggcggcggccccgagcccggacgacgcggcgcccgccccgtcgccgtcggtcgcggacgcgtctccgccggcgccgccgccggccgacgcgccgtcgaagccggcggatcacaaggaaatgaaggcgtcgtccgccgtcgcgttgcggtcagtagtgctcggcgcattagccgcggccgtgtgttccttcgtgctgctttaagcacaagtttttttttccctttcttccatgtccagtgccggtgattgtgattgcacgagctgcattgccaattattcctctgtataatgcgagcaaactgtgtacattttgttctaattctgatatccttttctccgaatcgtctgcgccatttcggtgcggtgaatttggaagaattcatgtcgcgttgagctgtacaactgtagatcatgtgagttcttgtcctttgagcgcgtcgtcatgcaggcccaccacagcaaatgcgggtgtgttgatgtgatcttgaaaaaacagattcgggcgagagagctagtgcggctgccgctgcctccttgtgctggcattggcagctcctacggatttcgatcaattcgccgtttcaggaccaccggtgccagtaatgcccgttggccgtgggttatttgataactctatctagtctttaaatatttttagacaaaaataatagaaatttaggtcatcctattttgaacgcgattctcaaatttaatagactaaaaaattaaagtcccttaccacctaggacaaccacaatgcagaaatacaaggggtattaaggggctgtttggttgagcgccaacctttgctacagttgtgacaattaaatttagtgtttggttcatgccacaggtgagttataccacttttttttttagcaagctagcccacttgtcattgagtaatttttttaccataacttgccacaattgtggcaaataaattttagccatataatgtgccaaatattttgtggtaaactatgaaagttatgaaagtcatccaaactatggaagcctctaaagtggtccttatacattgtaggagtagttcatatatatataatgcctagccataagaataaaataacaatactttcttttctctctcacataacatacaattgagtgggaccagtaagatctatgctaatgcctcatcttatcatagcatattgtagcaactaccataattaatatcaggtcccatcttattacccaagtagacattatacattaagcatgccctaagggcatcagcatcagcaatgtttattcccaaaccaagcaataagggtgggcccgttgtcagggaaaatatctagcaatgtgtgtatgtaacagagggggggaggaataagattggtccaccttcaaccaacctatcacaaagccttgttctgacttataaaagtgaggtgggacccatcatattcccttactaccggcaataaacttgtaacctggtagtaactatttactactgtcacaatgtttattacttgataacaaacccctatttaatgcttattacctgctctagcactacattgtggatgcagttgtgagcactgtgtagttaatccacggaagagtaaattacacttctagggctcgaacttgcatggcagagaaaggagtacaataatttggaaacgctttttctgctcaacttgttcatgcgaaccaagaattcaattgaaatgcgggatgcacgggtatagccgttcagcgatattagtacagatttaactatttatctgtggagaataatacaaatttatacacatgaactccataaaagtaattaagaactaatgtcctgaaccctgatcattgctaaaggtcgtataaacaaatacggtatttacacacggaattgacatgctggcgtttcttacacactacactatccaattatacatcttatgttacaagtaagaggatatatttcactgtttgagcgaagttgtaactacaatagatacaatatgccctgtggaatatttacaacatacatacgccaaaatacttaaatcttgaagaccacaagcacaaaatgggtagagaagatcagtccttgttgcgagaggaccgctcccgctccttcttctgaccaccaagaatccgagagatttgcagtcctctactgaacgcttgattaaatagcatccgtgtctgaaactcggacacaaagggaaaccatgccaaaatagtaattggtgtaaagagaagaactcccataattatctcgtatgcccgagcaagggcacgaacagatccccatagccctgctcgccgagcaagaggcttgcaagcttgtgcaatctgaaagagattgagcaacaatgagaaatcaactaaagcataaatgaagttaatgagcagaacaagtaggagaaagacaaaccagcaatattccccatccggaaggtaagaatgccagaaagcacacaaatatatctcgtaaggtcatatgaagtattgctatcagtacaatcaagatggcgatgaacgaaacaaatatcataaacttaatcagacggaaaaatagctgaaaatccgcactaaatctccgccttccgacagatacagtctgaaaacagtataaacaatttaggtaagcaaaattatagataagatgctatggacagcaaatagtgttgttaacgtggccaccaacccgccaacagttgtatgatcctttttttttcttgagaaattaattctcaccttcataacaagcaataccaccaaaatcacgagccacgaaattaaatatacctggaaagaacaaagtagcaaaaaatgttacaaccaccccatcacttgttcaataaaaatgtagctctaacgatctttcaaaaaatgcagctttaacagaacaataaaattaacatggagggcataccaatatacttttgtcgcctgtgatatttaagtggtaaacaaggccatactggtatatgaaaaacctcagggacaaaattatctcaacaaaaagtccaattgtcccagaatatttcaaatgctctagctcgatctcccaccaggattcccaactcttgtctggtgacaccccaatgccaccacgattgctgatccacttattccaatcagaccaatcatccacaattttcgtccactcaaatcccgatggattgaacaggaagggtgcaaaaagccatgtcaacactaggaaccacatagagaatgtaacaaaaatataggcaatggttgagcggtaagattgaccaaatagttggtaaatgatgagcagaatcaacaactcaatgcctttaacaaagtgactgcgagaataaagcctgtaattctctgcaaacttagcatgaaagacaacaaagcccctaccagtagctctgtactgagcacctccatggagcaacattcgtccatagtagtgagtcttagtgccaagtgaaaacgtaaagaacacagctgccaattgcaagttcatcatgataaattcacttagtgcttgaccaaatcctttttcaaggccaatttccatcatcatgggcagggccatcagaaaacctagctgaaccagagattgtgaggcaagagcaacctgaagggggtggttatgaatgtatctcctttgtgttaaaagcccttcttcaagtccactgagagcaagataaaggcgtccatacagaaatacataaactgtgacaactgtcagctgtagaaaaagtgaaaagtattaaaaacatagttaactgtgctggcgtactcaaaacaattgcaaatacaagttattttagcttagggcattaggaattaaggcctcaatcaacaagggataataggaagatgtgagaccaatgtggctcagttgtacagtgaccaatcttcagggagtggtcgacgcaaagcagacataccagagtactgaaataaaatcccacagtagtgaagtagcatgaaagcattctgaagaaatcgaagcggtgtccaagccggtagatatcacggctaagagtctgctctccatttccattggccaccttacctcaaacttagagatctggtttaaccctacatctcttcctttaccaacttgcacatattcatgatgtgttatatttcctccacggagagttgaattatagcctgtaacataaaagacaagaggagcattaccccagttcctgaatatccagttacatctggaaagaaattaacatacagggcattcgtattgaagcaatggagatatataattactgccaaagaccatgataattgatcttagccacttcattaatcagcaaattgaaactttcaggaaacaaacctgcaaaaatatcttcgctcaagttgatactccttgatgccttactgacaccacctcttgttagatgaaaaatcctatcaaatacgtcaggatggccatagtggaatcgaaccctagaataaagaaagtaatagctttagatgcaatccaaaaagggaaattctgtacgttttattataaaattcttatgtagaactagttatcggaaagtgcactataaaatggcttgctcaatatgtttataagctagcaaatgacatggcttagttcatcacatgcaatttcagatttagagaatataatatatgatcacttagcctttttcttgtgattgatgaaaataatgtattatgtatccattcaaatgtatagtaacacacatgtgaggaggaaataatcagataggagaagatctcacttcagagggtttgcaagcagccgttgcccaatagtcacaaaactatgctcctgattggacataaaccatgcgagagaagagacactgcataattgaagagaaaggtgcatgaatgaattactaacagaacctgaaaactcaattgagcaacagaacaaagaaatagcagaatgtgaaaactagattgagcaactcttatcaacctgccagtaaaaatatgttccctaactccaagtatagatgggcgccgaactccatgttctgtaaggaactcttgaagcaaatttctcattttaagtgcttcttccatatagttatcctacaaaattaaaggtgtgcacaagtaaatatgagtttgaatggaagcataagtgctgcacctcctttggagaaaatgacagcataaagtacgattctacaaacctggttcatgtctatggtttgcaggccttcaccacgggtgaagattattgcatgattttgattttcaggctttccttctcccaacattgcaggtcctggaagttttatccggtagataaccttgaaaacaaaaaaatgcaaatgttgcagcttcacaggatcacagaaagaactttcacacttgatccacttctataaaagaagcccataacttccagcatttatcagtaaaagaagtttcaagaacagcagttgtgcaggaggttcctaaaagtgtgtacacgtccacttgaacctttaaagttaacttcttgagcatctatcagttagagagagtggaaaggaattgtggcactgctaagcaagtcccgaaggaactcaggacacacttatcactctcattgcctgggaattatgaaaccatcggtgtgattatgttttgaagttttcaataggacagcagcattcatgtggtcctgagatccatttctcatgaacatgaaggctttcgttggtgcttggctgggcaaaaggacttgcgaatttgcaatactagctggccattccaggccattactacttggtggcttggtcgttcatgagtggtgtgtgctgcgtgtgtaaatatgtttagtgtgtgtgagttggtttttgggtcagaacgtccttcttgacctttttgtactgtgttttctccttattgaaatgacatgcagctctcctgcgtggttgaataaaagaagagagagtgaaaaaatctcactgcaaaattagattgttgaggatacctcttcaaatctaaatagtgttgtttggtctatggtttgtatcacttgttttagaattaggctgggaatcctttgatccttctattaatagtgtttttgttttgtgcctaacatgatttgccaaaatttatgccccactacctaatcaggtagaagtacggttacctgataagattttttttgacaaggaattacctgatcaagattttgaactggatctgtagattcagaatccttagttagagcaacctttaccaaagttgagtaataagctggctccattttcttttcttccactctatcttcgacctgatcgatatatgctacacgaagagaagggtacctgcaagaaatttatcgctaacaattagaacttgagacagaaggaatgacctacattatccaatcatggaaaacactgtactatcatgtctacaattgtgcaaattctgcagcaaagctttggaaaaaaatccattggttgatgtgtgtgaaagagtgtgatataactgcaaaacattaaatatcatgatcaaacatgatagcatcagggagaaatgaaatataaatttaaataccaacaattaaacagtgtattggcattcttctttcatatctctctctatttcttccaatacaatccaatcatgcaatttttgtggtcaaaataatatcttctatatgcccagtagtattgtcagctatttggaaacttgcacacgaagttcatacgagttagattgtatctctagtgtacacctaatgtggctccaaaatttaaatccagaatgatatgcagcattgaatggattacttatagtattataaatattgaaatcactacagctactacaatatgatgagtacttaactaatctctacatctacagtattcaggtaaatgcaatatccttatttacgttctcatcagctgtaatatgtcttgggcattaggaagagcagcacgcttgtcatttccatattgctggcatgataccacataggtaaacttcatatcagccactgcttcacattgcgcaaacaaggaccgctgtaacttccattgttcat

SEQ ID NO: 69485 - DNA, 2191 bp, Oryza sativa
tcaatcacgcataaatttagaaactatcaagaggtacaaatttggaaacttttttttagaggaagatcattttttgatgcagactttgtaagaaactaataaaggttaatcagcaatacctgttcgagctaatgtttgccctctgtatgaagcccacagacgaagctcctcattcttgtcttcattctctttaagttcctcatcccattcaaccctttgctgaaagttcttccattcatctacatacatatgcacaacaggatatagtaaaagccagatgtaaatagaagacatagacactcatatgctacatcaggacaatggaaaatagtttcttctcgacctgggtaaattttctgtaggtagaatagggtggaaactccatcctcattttcctcctgcagctcttttatcgaaaaaagaacaggttcattgtaatacggggtcaacgcgctgcagatagaaatagacattatcagtttgacaagggtgccatgagaatactgaacatagaggcactgcaaaagtaatgtcaaaaggaactcacaaaaaataatgagcagcatacaaggacttacgaaaatgaaagcatgtttctgactttgggagcatcaggcatgtccataaacaaagaattggtgaaaaaggtaagacgccttctagcctccagatttgaggggacatccatagcagactctttcacagtgagtaacagttccagcctttttatctgcagcaagaaaaaaacattgttgacactcatttagaattaggaagtttagccaacaacagcaaatggttcagtctaagatatagtaaacctgaagcacacaggcaaacacaccttctctatccaggcatctgtgaattgtacgggaaacttgatagctccagccggttgaaataactgatattcttgatcccatgtcgttgtgccttcaggccttttgggggtattgaaaaaccaccatgacttgactccaaaatactgtcatgttgcaaacaaataaaataatgacaaactgctggaggtttgaacaggagcaatcatgtcatacaaaactcatagcagcagaatttatttcatatctcgtctacaagcctcctgcctctatattttttctttccttcacatccatgagtcttgtttttctaaacctgcacaaatattgcacatggtagtgaaatattcactatcatttcacccacgctatcaacaagcatggttggtccggaaaccttgtactaagacactaagtgatgatggttctgtgcatctccgggtgcagaagccaggccattttattccactatctaaaaatagcaaaatattccataattttattgtccattgaaaaatgctacaacagaagttgctcatataatgatattaaacagtaaatcgtcatggttcagtacttcatcctcatgatatttgcacatgtttaaaacaatagttgtacctagaaagttggtcttccattatatctcttgttacaacctccagcatatcttgaaaaatctttattacagcatccctatcattcttatcattcttctcctgatatatataataaacagacaatgagacaaactagaatctggtatacagacatatggacagactccatgaagtttgcatgtataacaagcattgcgaatatgagcttaccaatcatcatcagtaattgctaaaaaaaggtcatcagtagacagacagtcaatcatgaaaaggcaagcatgtttctttacgcgttgcattcattaagataaaatgcctagcttctcatcaatttacgtgccagaatgccaactgataatcctttgtactaaaatactttccggcaatataactatcttttagatattacaaaatatatttcgattatctaacatttgaggaaataaacagtacattttgcagtaatttgctgataaatggaaaataagctacatttctttagaaagataaataagctacatgttatgatgattggttagacaaaaaagatgttgaccttaccaaatattttaccaattcaacaaacttattgtaaagatctggcaaagcgtgcatattcaaatcagtaataactttgtcatcagcaatatacttttcaacttctgcaaatatagtatttatgaccctgaaaagcatcacaaaatgcaccatggatcgggctgcaggaat

SEQ ID NO: 69486 - DNA, 1812 bp, Oryza sativa
ataaataaacagctactcccattgttcccacaaaattgtcactgtttcaattttgaccatttatatttttaaatggttagtctatcatgatatgaggcttaatacaaatgtttacaatgcaaaacactttgataatatagaatatttttaggtacttataatttctttttgcagaaaatacaaatgatcaaagtttaaatatgaatagtgcttgggataaatatttaagaacttgagggagtattgctgttagcatgaaaatattgggaagcaaaagattttaagcgtactagtgtactacaaatagtaactggtcactgcaacatggacaagctgtcgtacaacaaaagaaaagacaaatataatctgtttgaaagatctattagagagagatatatattatgttctttattttaaaattatgtgaggggttttgttgcatatttgcctgtaccaatacgtgtatatatttgagcccagagccctttgatgaatacaagtgatcttcgcaacaagatccagacatagatatacaaaagtataaaaaggaaaattaacctctccaagtcgttggaaagcaccataaattccaccaagcagtgtcgagaagattgtataccaaatttgtgtatccatgaaatagacctggaaaggcaacaagaatgcagaaaataattgtatacttccctctacagcacaaatctagcttatcacaattatcttgccacaaacaaatggagcttcctaagctaaaacaatgcgagtgcttaaaaactttctaggaaaacaaaggagaaggtcgtaccaaaatgattggagcccaaagcgcaatcacgacaccaatgtttccgttcgctacataacaaaatttaggattgttataaactaatatacagctgaaattgtttgagtgacatagttaccttttgggaaaaactcatgccactgaaaagtgtgtataggtaacttcatgatatccttggtaggttcgacaagaggcttgatctttaagaataaatgcaagattaagttggttcatacagttacttcaacagaattgatttctaacaaggtaagctcacaataattgagaaaaaaaaaaggcattgctcaacatgaactagattcagcataatcccatgatttcaaaatgtaagtccccttaattgaaaggttcttcaatgatcagatcgtcatggttaccagttttattaggtgcatcttgtgtgcgtcaaataaatttatcataacattacactagaggtttctaaacttgtagagaaggtccaagtggtgttaaacttggaagcagaaggtcccaaaacatattgagtgctgctcaagtctgcaaacttaaaaaacgccatttatgtcataaaggattattttatctgacagaagttataaaatggaaatagaacagattattggatatgtgaaactaatgcggatcatttaaattgatgttttctatagccatattgggtattgtgactttcaaattggctgaaagagctgacacagcactagaaaatggaggtaagcagcgcacagtgcagtttcatacattgtgacactacaccaatactattttagctctcgtaatttaggtaaccaagcatgttgtacttgctctatcattgccatctgctaaccatgatgagaacatttagatattacacataaaacatatactatcaaaagcattaaggcagatataatgcaacatgctcttaacagtagctaaaacagtcgaaaaaaatcatatagcaacatcaccgagcacttatattccaaaaatatatatctata

SEQ ID NO: 69487 - DNA, 1343 bp, Oryza sativa
agtgtaaaatagaggattgctaaacacaggaaaaacataggaatgactgtttgattggtccgcatgaaaaacacaggaatttgaggagagataaagactcagggcccctttgatttggaggaaatatataggaattttagggcccctttgaatcaaaggatttatgtaggaatttcataggattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtctatctctctcatccgattcctgcgtttttcctgcgctccaatcaaacgaccattcctgtgtttttcctgtgttttgcaatcctctgttttacacttcaattcttgtgtttttcctattcctccgttttttctaccctgcgattcaaaggggcccttagaggatttcaatcctataggaaaatttcctatgaagctctttgaaataaaggattacatcctatccaatcctttgaaattcctatggaatggacaatcctatagagattttggaggaaatttagcaagagcttcgaccttttgctaactttcttttgagtctatctctctaatccaattcctgtgtttttcctatggttcaatcaaacggtcattcctatatttttcctgcattttgcaatcatctgttttacacttacattcctatcaaaatcctacgttttctcaatcctgcgattcaaaggggccctcaaaggattctttccatgaggttctacctcatgttaaatttcctccaaaacttgcatgggaaaagacaatccataggaatttcataggattctataggatcaattcctttgattcaaagggctatataggaaaaaatcctctaaaatttctatgaatgggccctgagtctttatctctctttatctctccttaaattcctgtgtttttcctatggtccaatcaaacggttattcctatgttattcctgtgttttgtaatcctttgttttacacttacattcctgtcagaatcctatgtttttcctattcctctgttttttcatccatgtgattcaaaggggccctaattctaatatgtaagtgacataaaaatattcatcctaaataaacatattcatgttcatatgcaaagtaacgtattcatctagattcctatactggaatgtatcatgttctatattagtgttttattttgggaggaaggatgtacctatatatctgcagaacgacagtgcacgtacgtgcgatgcatagacgt

SEQ ID NO: 69488 - DNA, 765 bp, Oryza sativa
ttttaacagaaaatataataaaataagatgcctttacttagaacttcctgggcaattctcatatatactgctcatgtgaacaaagtgctgataatcaacaaatatgtacatttgcccttataatattcttcatgaattttaaatagtcattgcccttttaatattctatatgaatttaaatagtcaatttttggaggtcacatccatgtttcctttactccaggactgtgccgttggactattatttgctctccttccagttctgggtggtgctagtggcatttttggaggcgtgatgtcaatggctaaactgtatggctattatcagaatagctatgttaaaataaaatctaaatttcattatcatattgatgcatgcctatgttttagtgcctgtttggttcatcagtaacctcaaatatctctaatatgcaggctgcttgtattatccgtatttataactgttgcatatatgatgacttggtcatttgttcctcgattcttgaaactgatgattcagctatcatcgcaggttagatgaattagcttgttattttttgtttctgttcctgtttttgcattcatatgtataaattcatgctcatatttcttatgtacttcaccttttatacatgttaatgcatgaatagttcgtctcagtaccatgtaagttgaaaaataacatgggtgtcccacttgcatgtgatcccaagcccctgacagtttcagtcactttggattttttttcaatcattaatctttgca

SEQ ID NO: 69489 - DNA, 1532 bp, Oryza sativa
caggataaagcaaccatgcttgaagcctacaacagatcactctaacattacaaagccacagacattcattcatttgactgacaatgatttattcgtgcattaactctttgcacatgccgtggaacattggacagacaattccatcatttctttttgcggcaatacgtctacacaagcgatgactaaagacacagtttgacaggccggggatctgttggtataccatttaagttgaaaaattgagttgtacatactgtacatgttgtcagcgtagcatattctttagactgtaaggccccaagccttggttttgtatcatccctgccaactcaacctaggagttaggtaggatttttggtgtaatgctatcagatataccgagagaaccgatatgtgctgattccccatcagaagaccatgggaaagctctatgttagtatatattgtccatttgtcctatgtatgagctgccaggtgacttgttctgttcttgtcgtatggataaacattttgtcacaacattctcttgtcctagtatgagctaccattggaaagtagcagcattttattctcccgtgaaggttattctcttctcctgcctttttgtgtggtgaacattatttttctggagaaaacagcttgttagaatcgtcttgtagcgctgggcttttttggtgtatccgcatgattgcgatgataggtccctggacaagtatttttgcagaaactttcggtgcgtctgtccagtgggtaatggttgtgctggctcgtagtcggagcagtagaaaactagaaatcctaaacaagttggtgcaattattaaaggagaagctctgaccaagctagctggagctgaagagctggagaagatctggcccgaggtgctgacatttgacgctttgtggcgaatcttgtttcagtggttgcgggacgcacatgctcacgtggtcggcctttgcaggggtagagttcaattttcactattcaaacttcatcgtagacatagaaagcttttgttccacacagtgcaaaagctggaatagctcagttggccagagcgtatggctgttaaccataaggtcggaggttcgagccctccttctagcgattttttttaatctcatcacaaaaaatgtaactcaattgttttttttactctttcaaaaaatgtaattcaaatgtatcacaaaacaaatttcaatatattttttaatgtcatcacaaaaaatgtaactcaaatgtttttttactctttcagtattttttttaatctcatctttgcaatatctttttcactctcataataaaaaaacttttttactctcattataaaaactgtaattcaaatgttttttactctttcagtaatttttttaaactcatctttgcaatatttttttctctcatcatcaaaaatgtaatttcctttaaattttttaatctcatctttgcaatatcatttttactctcatcataaaaaactttttttactctcatcataaaaactgtaattctaatgttttttactcttt

SEQ ID NO: 69490 - DNA, 12708 bp, Oryza sativa
aaaatgcaatttccaatattattatgttctttagcaaaaatgtatttgttcttttgcgagcctaagctcatcagcagaccagaataatcgtttcagttgcttgtataagagcttgccaattccacttccagtgctttcctccgaattacaagactgataaaaagttgaaaatttagtggttctcttagaacacaaaaagaaaatagcttcacaagtttagctacatggcagtacaaacaacaccgaaaccgctaggattttacacttggaacaagccacgccttgctgaacttgctcaattattatgggatctcacatgcacacagtacagttcgtccatgtgccgcaaccatggtgccttgcagctaagaacacacaattaaaaacttcttgatgagttcctgaaacagcaaagcaagaggagggacaaagtacagttaattaaaacgggagcagttgtggtgtctgcatcacatgccgcttgcacgttataaaaaattcctgagtgccaatcaggtgaagcatccgtgggattcctcaacggtaaatgtagatgcaatgggtcacattctcgtaaggataggagttatattttcaatatgctgcagtgatatgatttttttagtgttctaaatcgtaatgcaaaaaaaaactttaagttgtcaagaagaatagagataccatgcttgcaaattgagaattgcgatgttcattctgatttctgaacgaaaaatgtttggtatgaatatttgcagatgcaaaaaacaaaattcaatgaaaattttggaggcgttaccgttgatgagagggagaggttcttcttcttgacatcaactggcatcccttgcccgcagcacaatttgcggctaagcatcataagctcctccagtgtaaatgtgctcttgggaggactccacggattcttcagctgatcatcgtcattagcaacctcccagcttttctctgatggtgcccgtggaaactgaaaatctagcgctgaagtgtctccacttgagttgctgtaagcttctgtttctgaaaatgaataccatgtgccatggcgactggaaccacctgcgcattctgcagttccagatgcttccttgctgtctggaaatccaaatgcttccagatcaaaccctagagaatattcttcctcactttcagccaagaaagggtttagcgaggaaggagatacagaaaaatcagcatgatcaaacagcggatgaaaaggagatgcatcttggagaggcttcccgggcttttcttcccactggaagggcacgctgacgacaagtttcgccggagatgggcatgagatggctgatggcactggattggaaatggcccagtccttttttggcgctccaggcttcacctcccagagaaatgggactgaaatctgctgcttgacgcgctcccttggattgaattcagacagttcaagctcatccattttggatgtgtggttttactggtttcggaatggaatttgagctgttgtagatctttcaggcactgctgatataagtaggagagaacaggtggtttagatgagctgctcctgtaccacaatgctcttgttcaactgatccttcgctaccctgcaaacttgacacacaattagacagtaccaactaccaactcctctttagctcagacatgcagaaagaggtactcaattcagagtggttgatcttacatttgcattttccacagtactagaaagaaaagagggtgtagggagcacccgaaaaaaacagagataaatcctcacagggtttggtaatttgaccaaaataaccacttattcagatgcaaatctacattttacaaatgtgactggggacacaataaagaataaaaacaatgtgatcatctgttcaaaaaccagaaaacgttttttcctgttttaacatcctattctgctactgtaccgtgacgtcaggagatcatgaattagttctaacagactccaggtactgtaccacctctgccatgtttggtcgggcagatggtgtgttcgaagtgcataccagacctaatttgagcacttggactaattcagcctcaacaaatcccttcatgctccgatcaaagcagtctgacacagtcccatcctccaatatcgccctaacataatcacgcagaaccactgctgtcgccaccccagggctctccactggtttcctccctgtcacaatctcaagcaacaccacaccaaagctaaatacatcactcttatcactatatctcaagcttggagatgctaactccggggcaatgtacccaatggcagcatgcaatctactcaattcatagctacctagaataggcaaaagctttccaaatccataatcagataatttagcctcaaagtctttatctaacattatgttggaggacttgatgttgagatgcaggacttgtggtcggcagtcatggtgaaggtatgcaagtgcccgtgctgtaccgagtgcaaccttgaacctctgctcccaggagagaccaactctgctgctgcttccggaaaatgtatgaggactcccgtgaaggtggtcgtacaagctcccgttaaccatgaactctgacagaatcaattgcgttgatgatgaccagtagtaaccctgaaaagcaaccagattggggtggctaaggttaccaagctggcccatctcctgctcaaactcatcctgacttctcacccttcccagtgtttccaacttcttcacagcaatggataaaccattctcaaaggtggccttgtaaactgtaccaactgacccaccaccaacaaggcagtctttgtcaagcagtgccttagttcctgcctcccaatcttcataccttgaaggcaagctcttgctgaaaagcaccaactttccaataatggcatttgagccttgtctgccaggagatgcaagcatcggtgtgctctcggactccagcacctcatcctcctccttcccctcttgctcctctttactcctcctcatgtaagcctttatgttcatagcacaaacaatgcaaactccaataagtataagcgctgctgcgactatgacaattatgacagacacagccaattgtttcgccctccggctagccccacacagattgttcagtggaggtccacatagtaatgggttacccatgaaggcggagctaccgaaactctgtagaactggcaaggcagggatcatgcccgagagtccattgtaggacacattgaaatgggtcaggttagacaggttcccaagctctgaggggattggtccagtcagttggttctctgagaggtctagaagatcaaggtttgtgagctgtgcaagtgtcactggaatcccccctacaagatggttccgatgaagatcgagcaacttgaggtaagtcaagttgttaagcgtgtccgggatcactccttgcaattggttgccagacaaattcctgcagtagttcaaattagtctgtcagtacatgaaaccactgtaattcaaacgaattggactgggttgcgtagttaacagacactcacagctcaagcaagaactggcattggctcagggacaccgggatgtctccgatgagagcaagaccagcaagatctagtgtgacaagcatctcaattcctccgagctcggcagggattgaaccggcaatgcctgcatttcctgcgagcctgagcactgaaagcgacctcaatttcccaatgcttggtggtatgtctccagcaagagcattcgtccccaaatccagaaccctcaggctgcggcaattggccacactctccggcaccggcccagtgagccggttccctgaggcgtcgaagtaggagaacttggtgccgcacgttgcaatgttggggatttcaccatcgaaggcgttggacgagacgttgaagtaggtgatgtttaccaggccaagaaggccgaaaggtgccggtccggcgaaatggttgctcccgacgtcgagcaggtcaatgctccggcaagcgttgagctttccggcaatggcgccggagagcgagttgcttcggacggagatgtagctaatttccggcggcgcgcagagctgatccgggagctcgccggagaggcggttgtaggagaagtcaaacccggcgaggcgcgagcagttggtaatggcggtcgggactggccccgtgagggcgttgtgcgcgagggagacgtaccggaggcggaggcatgggtcgaacagcgaggcggggatctcgccggagaacgcattgtaggagaggtcgagcaggcggagccacgggaacgcgccgaggaacggcgggatctcgccggagagcgcgttgcggctgaggttgagcttgtggagcgtggggccgagcgcgctgaagctggaggggatgccgccggagaggccgttgccgaagagcgagacggactcgagcgacgccagccgcgccacgacggggtgagcttcccggcgatgcccgcgccgtggacgcgcaggcgctgcacggcgcgggacgacgggtcgcacgtcaccccggcgaagtccacgcaggggtcccctcccgccgtccacgacgcgagcgcgccgttcgggtcggtcacggcggccttgaactccagcagtatccccctctccgccgccgtcgccgcgtccaccacccccacccaatgcagcaccacacccaccaccagaacggccgccgccgccgccagcgagcgcgtctgcctcatcgcgacagctggaggagcaggcgcagtgcgagtgcgagcgcatgcattacccccgccgcggtggcgacggcaccggcgctctacttctactgctgtgactactgactactactcccctcgtactgagagagagagacaaggcgcgccgagtaaaagagtggcgagtaggtggcggtgggtggcgtgcgttaatgtgcgggtggtgctgccgcgcggccatgagccctttcttccttgacgtcggttggccagaaaccacgttcttctgggtgtttggtgcgtggcgcgcgcggcgtttaccttcaccttacccgtggaaatctaggcgagacgcgcggtcaaaccgaaacgcgaacgcgaacgcgatcgggagcagcagcgcgcgcgcgcgcgacgtggtttggtgccacactgccaatctgccggcatgttgaggtgggcaggaagtgcgcggcgcaggcgcagcgaagggtggggtacggcatgggacgcgcggttggggaggaattttttctcttcaattcgctggctgcgcagccgcagccgctgttcacgtcaaccgctcacgcatcgtgccgctgttcacgtcaaccgacggccgcggacgtggtgtcgttgcccgtttcgcgttgcgtccgtataggtcgtagtactgtggcctacagggaaaccatgggtacaccacggatgcataaatgagcttattcactgctcgtccgtcgtgccggtacggtgctactactatggtgctaccaccgtgctgcggctgtacgcacagatctacagtaatagcaaagctactagtactgctactactagtattcattcaagcgtgagtggcaaacagatcagcatattgctgcgtgggcttcttgtatcatccgccggcgcaactgcgcgagcggacgatttaactactagctagatgtgccatctgccatgccatgccattgatgggaccaacataagatgcagtaggcatggtcgcatggagaaagtttgttggggtttggagttcagcgtgcctttctgtcggcaatgattcgtcggaacgtatcatcatggaccgacgtgcttgctaattaccccgatgatgcgttccagtgccatggctttcgactctcaaagcctgaactgcaaggtctctgtcaagatttggttaccaacctccacaaaagcattgccatggatgaaaacgatgccatcaccgggtccttaattacctcaaatagtaccagatccttgaaaaattgaaatgaacagaaacggcacgatcaaacttggcggaaatgaaggaaagaaacgtgctacctcatctactctactctacatgtctgtttcagaatagaaaggtctaatctgttatagtgctttgctacgatacccaagtactccctccgcccctaagttcaaatttacactaggggtaccaagtcctaacatctaaatcgatcccggcaaccaaatcgagccatcaaattgttcatgaattcgatgggcatgaagtaatgatctagcaatgtggcatttgaggtctgaagtactccaagttgaacttaattattcttctgttacccaatgtgtacaaacatatcacgtacaagaccacaagacaaacattatagcttacactctcatcgtctacttgttagcttatcagtcataagactcacaacaataaaaagtttaatttcaaaagaagttaaaccatctttttaaggagtaaagaggggttgtggcatcttccccctctctccccagtggtgacctcagatgacaaggagaacacctcaacggtgacctcagatgacaaggagaacataagctaggccatgatagtcgaggtggtagcatcaagtgatcaaggaaatcgaggcttgttcccgccattactgcttgtttccatcctcgttgcctccgccttagtcgttggatcaagaacgagctttagcagtagcactggaaagctccagccgataggaatgagctcaacggcaatagaggtaactatagctgatgatagcaataattgggtggcacggacacaggtcaatacacatatgtagatagaggcgacaagctcccaagtggtaagctctttacctctcttatcatcagctttcctcctcaccccagcctgaaatgctggtgataaagtaacatcttaccagcagcaacgcaaacgccttttcttatatagttgctttccactctcaaaacaccatgtcctctatggactacaaaacctttcttcaagccattttatttttctccactatggtagctctggttccgacgtgggtcaatgaagcttgtgtacccttgaatgttgaccggtaagcatggcctaaggtccatgtggtttcttcacatggattgtatatgttcgtgtttacaagagaaacaagtgtagcgtttttttttcaattgcaagaaatacgcaaacgtgcgcacaccatgcacaccgcgctcacatactagtaagtgtgcccccgaacacacgcttaaggagatggagactggcaacacatccttggacccatgaaattcctgatgaaagcatgctaacatatgattaatattcgtatacaccagaattttaaccctagtgagtagtcatgcacccatgacccaactatcacacgagtgatgctttcctgtctctgtagcaaatatagcatttgacttgacaaaaactttacatgtgtcgaataagatttgcactattaaacacaagattttcaggccaagtgaataaattaccatatcataaaatcagataatcgaaaaaaaaaatctaaaatctcatgcgtcacgagcagaggggcttgttggtataaaaagtgctattgcaactgctacgcaatgtggactctggttccttctcccgcacactacgattcggtcaacttgacgcctcgtggaccctctctggtctccatctaacggccacgatggtctaatctcacccccacgcgaatctcagaacttgtatccctctctccgtcttccaccacgacccgccacgacaaacacccccttcccccccactccactccccttccctacccgcccccgtcgccgtcctccttttcccgcgaatccgcgatcttccgccgcgcgcgtcactcgtcgacccccctaagccgccgccgggcgatggcggcgctggacccaccgagcgagctgttggtgacgccgaagacggcgaggaaggacgaggccgcctcctgcaatgcggccaccccgcccaagccctcgccggtgtcccccgaggagatgcgcgcggtggcgcgcaagttcgccgagcaacccgtacagaaccccgacgacggtgtctgggctgtcctgacggccatctccaagaatgctcgcctgcgccctgaggtccccctcccttaaaccctaaccctaaacccccaatgtttccttttgtaactgctagtactaattcagcattgccatgaaaagaggttgagatattgaatcgtaaattgctgagttagctcccaaaaaagtgctgagttagctgattggagccattttgtttaattgtagggaatgaacattcttttaagcgccgatgagcactacataggccgtgccgttcaggaatccagcttcaagatttcctctttgcagatcagtgggaaacattgcaagatatatagggacactgtgttgggggagcttaaccgcaatgaacctgtacctgttttcctcaaggactcgaggtttcttgtgcttctggttatcttgtcatgtattacaataaacagcaccctttcttaaattaacttattgtagcactgcagctcaaatgggacattcatcaactggaccaggcttaagaaaatttcacctccaaccaagcttaatcacggggacattatatcatttgtctccgctcctcatgacagtaaagattctgagcttttttcactttctatgatccaactctactgttcttataaacaattatgataaattcattgccttgtaacttttttagagctttcctgcacatggcctctgctagtttacctctgtgtacttgattatatttactgtgttttccctgtttaccttgcattgtttttcttgtatataatcgatatcgaactttttttggccatttatattgcgtgtttcatctacagatacttcctttgcatttgtctaccgtgaagttaatgctgtcagtcgtgcagagaatgaagttaccatccttaaaaggaagtcaggtaagagggaacatgtgctttcctaagatttggtgattacatttttccagctacattacaagtaatgatatatgtaccacaatttgtatttgatcttaaagaggatattcattctgaaagaaagagactaaaaggtcttgggattggttcctctgatggtcctgtttcactagatgatgttcgtcggctagagaaatctaatgctgtaagttgaccccttcaagagttcaagatggtagtttttattgccatgaaagtttcttaaccttattagcaaaaatccatgcaggagctcagggaacaacttgaggaacatgttgtcacaattgagactttgagaactcaaattaaaatatctgaagcacagcatgaaaaggtatatcctacgtctgcatcttggtgttgtgtctcttctaggataatcgcccttcttgtactgcgtgacactgtgctactgcctactgccacttctaatgtttctctccactctactaaattaatgatgatattccatattctagtgtcaagaaattactggtagtgttgccaaactatctaaatatctaaatagtgttctgtacggcttataccatccctctcctagaagtgaatgtactgctgcttttccttttaaatcgccttttgttgtcaaagactacatttcttgaaaggtgccctcttgatttccctttcttatatctgagtcttctgcaaatctgatgatgtaggaattgaaggagttgaaagagattacatcgagtacttatgttgatcaagctaaatctcttcagcaaacattagagtacaagcagaaacaaatagattcacttagtacatcaaatacagagttacagaattcaataaaagatctcgatgagaggcttagcgcatataagcaatcacgtgctgaggctgatgagataattcagaggttattttttctgttcttttgattaatgctttgtggcaatactcataacttttagttttccgtatatggtgttattagcgttaggaaaaagagaaaaaagtcgcatatatttttcagtcgtgatcactaaagtcatttaaaaacactggtatatttcacccttttgtttcccaaattacaggtatatgtattgtagtatcttacagcatagttgtgttgaactgggacattttgctggtttacttgagggtcccatatcttagagggcacatggattcagcaaaccgtaaaatactccttgtttggaataaaggattttgatagattttgataaaacttctggagggatcgtactgcttcctagaaaattcccgtgaaattcatgcacagatatgcccaagtattattttatatagcactttagttgatccagggagaaaagtgagatgttcttctggatagacatttaggctttttcagcatataggaagtccaattttaacatcactctccactcattcaaacgttttcagccagaaatcaaatatatgtgagcttgaggcacagctaagtgaggagagagacttgcgaagagaggagcgtgataaggctgcagaagacttaaagtctgcactgcataaagtgaatgcagaagctcaagaagaaatcaagagacaagctgaggctcaccttagacaacaacgggaacagaaagaagttattagcaagcttcaggttttaccttttctttccaattctagggaatgatcaggaattgggaaataatgtattgcgtggacctttctcttttattttcaggaatcagaaaaggaaatccgtttgcttgtggaaacattgagatctaagctggtatgcttttttgctgttgtttatttgaacactcattccttttccattctacaattatttaccttcacattcaggaagatactcgagagaaccttgtcacatctgagaaaaaagcaagagagctggaagctcaacttcaggatgaacagcttgtatccgccaacaatcagaaggttacagtcgtaaacatgtttagagctattaagcccaagttgtttcatttgtagttcattgaatgtatgtaacatcttttcttcacttcctccccccttgcaatcgcagaaatcagataaactggaaatggatctgagaaaagtgaagaaagaacttgaacacgagaaggtagaaaaagatttcaagttcctctgatgttttcatcacataagctaatctaccctggtcttcgcatgcatagaggattgctcttgtttacttactagctgattatctgtgttcttctgttagcaggctgctcgggaagaagcatgggcaaaggtctcagctcttgagcttgaaatagctgctacaattagagatctatcaatcgagaaacagaggtatcaaggagcaagagagagaattattttacggtaagaaacattgtttgagtttcatatagaggtgaaccccaagtttgtgaaactacaaatcagcttaccttttcttttgtttcctatgttgcttactgcagggagactcagctgcgtgctttctattcaactacagaggaaatatcttctctgtttgcaaaacagcaggaacagcttaaagcaatgcagagaactctggaggatgaagagaattatgagaacagtatcatgggtgatgatctcaataaagtgccactggcaactgtaactgctgacgatgcccgcacgagagtaaactactcaaaaaatacaatggaagcttctggtgcttcaacagagaatacccaggcaagtgaacaaagttcaagtgatgattccaaggagactgaacaacaggatgattttaccagagttgaaggggcaaacactcaagaggtagagtgcaatagtccagaaatggcaacagagagattcaggtctgattctcatggtgatctggctgctacagctcctgagctagagccaacagatactgagcaagttcccgagacagaaagccaagctggtaatgttggctgtggtgatcacaattcagctcttcaaagatttagtgaaatgggaggtgataccatgcagctagatgatgaagtgcaaccacaagagaatgatgagtccatcttgatttgcaaagatagagggcaaccacaaggaaatgaggaagcctcgttaaccctcaaagatggcattggtcactattctgaagaaaaacttgaggttaactgttctgagagaaaacacgaggatacccagaccagaaccattggtacagctgatttgttggcctcagaagttgctggtagctgggcagtggaaacaggtccatctgtcaatggggagaatgagtctcctaggagcttgggggagactacagaccatgccggggagcaggatgaaaatgtcagagggagctcagcagctgatgctttagtgaactctgatggacaggctgctgggagccagagtaatattgatcatgtcatcagtaaaataaccgatcatcatcgtgttcttaatgctatgatcgaaattgttgatccagatttcagaaagcaactcccaggaagtggtgttggaaaagatgatctgatgtctgatgcggagactgaggaaggcagtgaggcgaatgatacagatagcgacagtgaggaggccatggttgaagattctgttggataggctataaggcagctacttttcctcgtaaatatcttaaccattttaccctgcactcgggtatgagcttgtaccatttttttcaatgtgcatttttttttcatttcatttcaatttctctttat

SEQ ID NO: 69491 - DNA, 17870 bp, Oryza sativa
aaaaggaggttcaccaaccaccacctactagaaaaatgcaaggggattattaacaacattaaaacaaatgagttaggaatatgcgaattgcgctcatctaaaccaatattctctttccatgaaccacccaaaatgcctctggaatcattcttttgattcattgttcttcgctgcaccgttctgttgtgactgctgcagttgatagaatggtatctgcgtagcctgctgctgctgcagttgaaacatctgattctgagcattgagttggatctgctgagctagactgctggacgagcaagaatcgccgagctcagcggtggcgagttttaggcgttggacttcggttgtcagggcctcattcagcgctgttgaacataagataatggcgaagcagtgaggaactgagcatcaaaaccagaactaacaagtgaacaattcctgaactctattcgtggcatactttcatggtgcagtgtttaacagtatattgcaataggatgaattcatcttggtaaaaatacagctactcataacattaatagatagattaacccttaaggatgaagtcatcatgtaaaaggcagtagacatcctagatcagtgtagattcttgaaacgaaagactccttgtgagagaaggaaatgtggcaatcacatggcaatatggcatccaaggagaaacatttgatacgtgaaagccctgaaaactagggtggcaatctggagaagtcaccgcagaatattgaatactccaaaacattcttctcctacacgggactgcaggctcctaacatgctagcaactaacggattcagacttcagagacgccatagggcatactatatattttatctttgattgggggaaaaggcacgcacaatagcaaatcttcgttcttggatgattgctaaggcatgtcctcctccctaccagtagtaggagtacatactaacgaccaccggcttcccgagagaaaaatatatgcataaagaaaagctaactaccaacctccaagcgcaaaaacacgagattatggcaacagttgacaagcactaggacaaacaagcatgtcaacgtcaataacttacacaagactgttcatcatagtgccgagcacatctaaagtatcttatgacgttggcgagcacaaacatgggaggagcgagtgatcgaggaggtttaggggaggcacgtaccgtcgcgcagctgcgcctgctgctccatggcatgcagcctgaacttgagctcgttgttctgcgtcgcgagccccgccgagtcgcgctgccaaaagccaaaacagtcacagacaacgtaaacaaccgtgtggatttcacgcaggaaaaaaggcgatcaggacgatgagacggcaattgcacgagaaagcgggaaggcgaagggatcagtgcgtgttacctgcatcatcgtgagctgcgcggacagattggtcgcctccgactgcaggatctgcaccttctgctccagctccgcaatgtacctcatcttcctctccttggacctcgccgccgactgcctgttcgccagcaccctgtcaccggaggaagaaagctctcagcgatcagtcgatcgatcccctcatgtcgtagcgctcaatatacattgcaatcatcgatcgttttctaatcatttgcatttgcgagacgatatggatggatgggagagtgatcgaatattatttacctcttgacgcgctttgggtcggcgagcgccatctcggccagcttctcgtcggccatgatcttcttcatctcggagggggtgaactcgccgctgccgaattccaggctgaacctgttcggccccaacgcgacaccgttccccgcagccgccgccgtccccgccgtgaagttgaacttcccgatgaggctgtccatggagaggctcctggcgtgacgggccagcggcgcggtggccggctcccccgcggcgttcctcttgacgccctccctcctctcgccgccgtcggcggaccagaggcggatcccgccgcgggtgtcgtcggcgcactcctccgactcgttctcgctgctgtcggcgccgttggtcttgatgctgctcccgcggctgtccccttcgtcgtggcggtcgtcggaggagttgagcccgtccagcccctccaggttcaggtacgcgttgaacaggtcatcggcggccgccgcgccgccggcgccggcgccgaggtggccccacccggcctccaccttgggcggcaggagctggtgctgcccggccaggtacccgaacggcacgtcgctgctggagcggcggtgcgccttgcgcggcggcagcccgccaccacccccctgcgccgactcctccatgcacacgtcgccgcccgccgccgccgccgcgcgctgggcggcgaacacctgcggcggcgtgggcggcagccccgcggccctcggcttgttggccgccgccgccggctccgccacgaacgtcgacgccaccatcggcaacgacgacgacatgacctgcacgtgctgcggctgcatcagcgcgtcgccaatgccaccgttcatgatagcgagtagtaccagcttccgccccccccgcgaccgcgagcgagcgcggtgttgtaaaatcaatcggctccgcgaacgggcggtgcactgcacacacgcgcgcgcgacgcagcagcagcggaggaatgtgggggtttgcgttgcccggactggggatcgggtcgcttttaagggtattaagtcggcgtttggtgacggtgtttgtgaggtggtggttccggtggtgcggtggggttgcctgatagccctctccccgcctcaagtctcgtctcgcgtcacatgtgtttcaccatcagtttcacatgcgctacgcaccacttttgtaccgtcttacacccaggccagcttgcacactgcgccactgccccttgctgatttactggccaggggatggcaattttggcagccaccggcaaggcggaagcgacgaaacggatgcgatgcatatggggcgcgttgcgttccgttgccacccgtcgcagcgcagcgcactttccactggccaacctcggacgtacgtacgtgcgccctgttcgatcggtgtcagctgcatgctgctgcgaatgtggggagactgcccggcacgcaatcaaggcattcattcatgtaggtttctgcctgcaagtcttggtacgagcttcctgttggcctgttggacccctgctcattcgctagtcgctacaggcctctctgagacatgcctccctcttgcatggggagatcaatggcggaccttaggagaattttagagccatggactcaactacaactagtttttgctacgaaaatatcatgcaaaccaaccagcccaaggatccgcatgccgaatcagatcctctggcataacataaccataactttgtggctgacaagtggggtcatgtggcaattgtcacatgttaatttacgtcggaggatcatattccgctgcaaagttggatatttacatgtttacatttttttctagtaaaataaatagtatgctttcatacctgctgcacctagagttaaagctttatactgtttcgaagctggcaataaaatgtattcttccagtcataaaaacatgtcgtgatgtgttacaagctgtatgatgtttagttctaaaccttttcacacatatatgttttcacatttaaacaaaatagtcaattgtttattcctggggaggatccaaggccgagtggccatccaaattcgtgtaccttgagttaagctttcataccattttctatgctagtaaaatgtattcttctagttaaaagcataccattttgttgccagcttcatgatgtctagttctaaaccttttgacacacatgctttttacattgaaagaaatagttaattgtgtattcctaggagtggatccaaggcctagtgaccctgggcgaccgtccgagctcgtgcacctagagttaaggtccatactatttctaagctggcaataaaatgtacttttccggtcacaataacatgttgttctgttgctagctgcatggtgatctagttaacctttttcacacacatatgttttcacatttaaacaaaatagttaactgtatattcccggggaggatccaaggcctggtgaccacgggtgaccgttcatatatatgcacttagagttaaacttcatactatttctaagctggaagtaaaatgtactcttcctatgacaaattaaaaacatgtcgtttctgttgttagctgcatgatgtctagttctgaacattttcacacatatatgttttctcttttaaataaaatagttaattgtatatcctgtgagatgatccaaggcctagcgactacgggaggccatccgaattcgtgcacctagcgttaagcttcatagtatttcaaagctgacagtaaaaatgtactcttccagtcacaaaaacatgtcaatctgttgccaactcgatgatgtaaaaaaaaacatgtcgttctattgccagctggatgatgtctagttctaaacctttccacacatatatttttttcatatttaaacaaaaaaaagttaattgtatgttcctgggggaggatccaaggcctgccgaccatgagtggcactgtccgaatttgtgcacctagagttaagcttcacactatttctcagctggcagtaaaatgtactcttccaagaaaaaaaacatgtcgttttgtagccagctgcataatgtctagctagtttttaacctttttcacacacatatgtttttacatttaaagaaatagttaattgtatttttttggggggcggatccaagacctggtgaccccggacgaccgcccgagctcgtgcacttcaagctagcagtaaaatgtactcttccagctaaaaaaacatgtcgttttgtgaccaactgcataatgcctagctagttttgtttccacatttaattaattaaagaaataattaattgtatatttttgggagcggatccaagacctggctagtggttaccttcgggcaaccgtccgaactcattgacaagtcacatcaatgtaatagcttccatcgctgatgttcaatggcatccatataatcctttggacatatatgtttgttcatgttctaaaagatctctagattcgccaatgtacattcacacacttaattagtcattcgtacatgcagcgtgcttaagtttctaggcgcataaggcagggtcgactagtatcccttaataaagcttatggtgatatgatggtggcattgtgtgaactgtgaaggtgtccaattatcaagtgtacatggtagccggctcgcactgtctatatcatagctcctcttcttcccttctaaaattttggaaggatgccataatatggttttgaagtttcttggccgccaagctgaagccaccaccacactgagctgtcgatccgcgtgtatttgcagtcggtggtagtaacacgcacggtgcatcctgagccagtgagccgctttagcgacacatcacgtgcatcggattatcggaagcacacggtcaaggcaagacaggtattttgttagtcgcgattaatctacaacagttagggcatccacaatgtgctacaaaagtagtccatagggaataaactattccatttagccatttagtaacactgggcaactagtccatataaagaaaatagcaaaagatatccatatgcatatacactacctatatgacataaataatattatatatctctacttctctctcttctcctaatgttacattgtatccatatacattgtgagattgctatagttaaggtttatttatatgggtcccatctatataaaccacttttaacatatacattggtaatgcccttacatcatactactactacatcacgatctggtcaagtgcagagcattgcgcagccgcagcgcaggcaggcaggcaagcgcactgccgccacatggctgcacgaacaaaaaagctagtagctccaagcctccaaaggccggtgtggaagaagggagatttcacggttggaaaagcgacgacgaccgagagaaagcggcttttttgcggaggaaaccgtgtggaccccccccgtgcgcgcgctgccgttgctgccctgccacaccgagcgatgagtatcgagcaagcgactcgcgctcgccacgacgatggggggcgtccgggcgtagctccccgtgacgccttctcccgtggaagctgtgagcctctgtgaggcgaaatgtaacactgctagtagtagtggattattctattcggattctccacgggacgcgcgggcggcggccggtggtgccgaacacatcgcccacttttgttcgatccgcaagacgacgtgcctgccgcgccgggctgtcgtgaaggcgtagcgatggtcgagcgcgacacatggaatggatcgatcggccgattcggttatatcgccatcggttttgtctccgcactgatcctgcactggatttgggcttaatttgcagagacattgacggtcgttcttaagcgaagccatggcccgaccggctagctccaaggtcaattgcaacgaacgatcgagcaacacttgtcacgagcgtaggctggctgggccggagatgacgtgctgcacccggaccacgcagcacggggatcatccgcgtacatgtacgtacggactacgtactggactagttattcatgtcaccgaccaagcgcgacgacgtacgtacacctgcagaggtttcagaggaaatacagtaatttctgaattctaaccgagaataaggaacacacttgcagtttcaggccgtgacgccccgttcgcggtggcgcggtcgacacggcgagctagccgtcctcgtgaggccggcattgacatggcatgaaccactgtaccatactctctccgtctcaaaaaaaagacaaaccctagatttccgtgtccaattttaattgtccgtcttatataattttttttataattcatatatttattattgttagatgataaaacatgattaatattttatgcgtgatttgtctttttaatttttttcataatttttttaaataagacggacggtcaaatattaggcacgaaaaatagagtttgtctttttttttggtacggagggagtatataccactacggatgtgtgtaggactgactgtacgtacgcgcgtatcaatgccttgcttgctcgtgatcgatggccattgactactgggaggcaatgcgatttactgctgccgttccagtagagggtaaaagacgtcttcaagaagaggaccacatgggatgtggcctctgaggttgattagtcgccttccattcccaacagtacgcggtgcagcaacgtaccatactccagtaatttggtcgtgctctcttgtatggctacaggctacaggctacatcatgtgcaaacgactagacgaggatgtcctgcaggcttgccaacctcatcgtaatgaagcgcgtgtcagggcgatagatgcagagtttcttgcagcacagctcaaacgagaatttttgtatgaccacttcgaaagacttaatattcagccatgtagcacaaaggctttgtttagttgctaaaataaaaatttttcatccatcacatcgaatatttagacacatacatagagtattagatgttgataaaaataaaaaccaattacacagtttacgtgtaaattgcgagacaaatcttttaagcttaattatgccatgatttgatactgtggtgctacagtaaatatttgctaatgacggattaattagacttaataaattcgtctcgcaatttcatggggagtctataatttatttgttattagtctatattgtccgaatatccgatgtgacaatcaaacctaaaaattttacctaactaaacaattcctaagatacatagcgccaacatatgttcgattgatatttttctagcactttggcagtgtctccagatttgtttgttcgagctataaaaaaaagggtgtagctatatttatggtgccatatttttcatcaaaaaataatcggcatgtatttacattgtaagttcatagtgtatttacaatgtaagtctcaaaattacatatgtaagtactaaaattacatatgtaaattcaaaaaatacatactaattatatatgtaagtggggtgtaaatgagatataactactatgtaagtggctgaaaaaaaatcgactgtagcatatggcgccatatttctaacgactccggaaaaaaaatgtaaacaagaaagaatacatgggcttcagaaatcagaaacaggtcaagcctacagtctacactagcccaataagaaaacaactgaagccctactttgggccgagggggaacttaagcccaatttaaacagccaactcagcaatttggcctctttgtcctccgtttgaactttcaagggagaacggaagctgctacccgtaacatctctctctctattttttttctttcttcagagtttctacatctcttctttattgcatttgtgtgcatgcatctcaatatcttatcctcagactgtatatgcgtttctttttcaagaaaggaacagtacaatcactgaagactagctagctatcttgaagagaagagcaggaaaagactatagcgaaaggcaagcatacgtcaatgcagaataatgcacaatgggcacaattacaggatagaagagtcagagagacgaaagctagctagctaccagaggaggctgctatggatcgatcgcaagagcacccaggatcgagtgggctgcaatggatgccgctttttaacagagccttttcaccacagccatatattgttgtgtgaatggagatcatagatatacgaaactagaaagataaaaagaatggatggtaactttgcaggaaaagattgctcgcatgagttgagaactagctcgcaaggtgtgaatcatgtagatcggccgcccggcccggcctccgtgcgcggtgtgctccccacctcctccactgcgccgaaatgatgtaatgtacgtctccgacgcggaggaggagcatcaatcggcaaccgcccgtgtgcgcgcggtgtccagctagccagctgaatttggcagtgactcagtgagatcaaaggcaccgcccggccggccacccactgcattcagtgctgcagacttgcagaggcatgcaattgcatgcagtcgcaccttgtaagttttagtaactacatatcttaccactgaactgtcactagctaattgttgctctcgatcgtctatgtgatgaatggtccacttgtctgtctgccattaggccagatcagagaggatcttgtacttatgagctttgcgagctgctgctacggtttgcgagcttttctgtgccgtatcatgtcgtttctttgctcgtcgtcatgagagacgatcgatttgatagaggtagcgcgcgatcattccgctggttattagtccacgaaatccatcgatgcctcacgcacaccgaggggctgccagtttcctgaatgattccgttccagaagcgaacaacatggtagattttttggccacacagcagggaagctatcaagttaacaatcgaagttgattcaatttacttaactactctcatgcatgcttgtccggacaatgccatgctcacgccaactagcttttgagatcacaaccatggcactccataccctggaatggaacgggaatggaggccggcgagcaatgatagcaaggaagcatcgacaagccatgcatgcagggacagcatgtacagggaagagaaaggatgaagggaagaagaaaagaaaagaaagaaacaagcttgatgctcacatcacatgtatcaaaagcggtaagagtagtgtgcaacaagtatctatccctctatctatatatctatctatcctacatcagctgcccttttctcagtagccaacgtgttgtgcagtcactttccctttaccaacctccatatatggctgcagcctctgtccacgtaggagcaattcaatagtaactcgtaacaacctacgatatcgatccttctgatgatcccttgccgttcacctctcctcgcactagctagccgatcgatctgagatatactacatcaggcatgcatataagtcggctcatgtatatacatccatgtcacaccgcttcaaaattataagcgtgccgccaaatcaatcacacttgtgccgccagtgaaagtgagagtccagaaaaaaaaaatcaagcttagctttcttagtcagtcgggtcaccggatcagtagcatttttagcacgtcatcactcttacatcaaaggtaaataggctttttcttgaagcagctagagaggatgaaagcgcgagcatatgtagctaactagctagcagtacaacacagaagagaacaatttgtatgtgtgtgtgtgtgtgttactgtcacagcagctaggctttttatgcatgcactaagggagcaaacaagcatgctatagcctttttgccgcttacgccaaggatctcacacatgtattctcgctagccaacttgccgtatctttcctcaccaaacgatccaaaaggtctccatcccgtcgcacagatagaacctgtagtacaatgcgcggcatgcctgcctgctcaattctcggcaaaaccgcaaaagggagaggtcacgccggcgccggcctcgcgcgtaacctgcagctatagcccaccccctgcgcgggcgcggttgcgtcgtgcggaaaacaagcgagatacgcgcgcacgctggtggtggtgtacgtgcgcgtcggcgttggccggcacgcgaaacgcgcggggtggtgtggatatacgagagccgccgaggcgcggacggcgcaacgcgcgtacgagcggtggtggtgcgaggcggggcctacgtacgtacgcgcgcggggtgggggccggggctacccggcgtcgggctcgcgcgcaccgatccggccgtgtacgtacgtagcgatatatatctcgagcaaatgatgccgcgacccgcgaggtgctcatgattgggcgggcggatgggcgccgcccgggctaatctttcggaccgaccgatcgaccgagcgaggagcgcacgcggtgcatgggcgacgagccgtgccgtccccatccgcactatgcatgcaccgccccacttaccaccgttccattggttattgccccgcgtggttggataccagctgcatgctgttacagtccaaacttacagtacgtccggccagtgatctgcattggtgcatgcacgcatgtaacattatatgtatgactttcgatcgagtttgaattgtatatggggaccgtctgtcttttttcccatccagaaaccaatataatgttacctgccggggcggccgtggacgccgacacactatccgagtttaaatgggactttgtaaatgttatcatatgcttaggtaactaatgatgcaaagtgaagcagaggggttaactttgatagcgacgtttagcccgttactctggggctgcaggatattttggtcagtcgccatccggttaagtaaaacgattaattaaccaaggtaagaagagttagttacagcatttcaaagatacgcatggtgccgaccaaccaatgaaagttaagtatgaaaaataactttttatgcatactccttaatatcctgcattcctgctcggtctgatatgatcttatagtaacaggctaacagcagatatgatcttgaacacagcatccatgtattgtgcccgtcacatcacagataaagtacagttctgaacaacttttgacttttctgcatcgccggctggcctgggccacaatggcgagtttctagaggcaacaatatgtgcctgccggtgtactgtactgtgaaaagaacaacctttccatgggaaaaaatctcagcgctttttagcgttctgaggaatagacgaaaggcaaacaaaacactgtattcactcgatttgtggcaagatagctaactttcattctgctttcgcaatatctgcatgcatggctgcatctacacatcaacatgctgatcatacaaatggcacattcacactgcctgcaactcgacgtctgaacacatttgtgcaagctggagtagctagcaactgctccaagcctgccacatgtaaaataacctgtcagaggttactctcatggacgtaccttcgtgcttacaagtggaaatcctcgtagcctaaaacgacgtcgagtacaaaaacgacgtgtatgtgtactttgcatctagtgtatcttgtacgtaaagcctttggatcatcgaccataccattagccaaggcagcatcagtcagctgcagctaggtacgtgtcgagttcagacgttttccatatgtctggacctctcgacgagttgcatcgtttcaggtagggtcaccattgtccatcggtgtccggccccaggcaatatgcaacttgacctccttttcttgtcctaccaacacgtctgtattttgcttgatgttgctacgtatatatgtaccctgttttatactacattactagtgctactgctatatactgctactgctaggagtacatagtttcagacacatggattcagtactgcaatgtgtgggcctaaaagtagatgaatatattgggagctagctagctagttctagatgcatcatcgggagtagcatgattagtatatacctggacgcccagttattggccacacgattgtagtttatgcttatgtacgggtgaggcgtaacagctgctaagcttatcctgttattgttaagtgcacttttggggagatgctgttacatgcttggtgggggaagaaaggacaagtcatcagccagccttaaccaagaaagaaaagaaagaaacatggcgtgccgttacagctttccgatcgattgatcagtctgttgttcctgtatgtttcgatcgcatgcagctgctgaagtgtatagtagtaatgtgcaaatatgtgtgcaatgccagatgaaaagcgcatcgctttaagaaatatgtggtgatcagctagctagcttcaatgctgctgcatacggtgtcaactgtcaagcacatgatgaattgaagaattagtacgtatattccatagctagaggccgggagatagaacattagcaaggttattaattagaagctgaccagaaaccagaacatgtcctctatctagatgatcaatttggaactctgttccacacattaaacctgccttcccttcaggtatatgctaattaagctgctaatcactcttcagcgcaggctaatggcaatgtacattcttaatataatgaactactaactagacagtaaggttaaagtgctcgtgtagaccaagaaatatcttaaatttatcaacatgtcaaccaagaacagaaacagcttgcagagacaagaaaagtgaacccgtctatacataatatcctactggcccctgttccctaatgctgcgccactctaaccctgcagcaagaacatgggtaacccagggcacacccactgaattaattagggtttaatcccagagtgatctgcagacgacgtgtcgtccggggagcaaaagtgcaggggaatgtcgtgctccagcgtggagagcagctcccatcgggattagcgccgcgtgagattgttttgaggttacatgatcattagcagctgctcgcctgctatgtcctacctgaattaattcctcccatttgacctctccatctctctctaccaaaacatttgtgatgaggaaacaaaagttcatgagaaactaatgcatgtctatagtagctagctatagatagatgaaggggccggcattattatagtcacccggccgcaagaacatgatgcaaacccaagcaatttgcagggctgctgggcccctgtgtccataatctttttccatctctcacactacctatccttattaggttttgaaagttctgtgttacgacattcatatggtccaaaaaccaaaagtgtatcattgttttgttccagtacaccagtgtctgctatatttattggaaaaaaaagagaacaaacatgtatgttatgctgtagctggactccatatatttctagctttttgttccctgatcacttgttcatcaagtactacaaacatgtatatatacttttcagggaaggcaattaattaatctaattaaagtacgttgttgcagttgaaaatggagtactaggtctaattaatactaagtatttatattatgggggaaaacagacaaactcagtgtgacgaagaagattgagtgagtttaccacttgattaatttacaattgaaaatttcaaaagatggtgcatccagaagattagaatggggactagaatggggtgtagtatgtaggttttattattgaaggaaaaaagcacaactttttcgctttctttgcttgacgaaaaagaaagatcgaatatagatacactaccttaatccaaaatttgaccaatgcttgctttgtctctgtggtcacccagttgaattagaacacatttgtaataatcatcaacaattatagcacactagctactccgtagatttccttgactttgctcatgataccgttagttagagttggattctggtgttgtaaagctctgcacagattgaaaaaagtttccctttgtatattgggaaaaattttaatttttggggggaggaattgaaaaaattttttgggttaataaaaaccaaaccacaattggggtaaaaaaaaaacaaaaatggggcccctttctttggctaattgaaaaaaacttttttttgaacataagttggacagcagctacccagcaatgagaaccggaatgatgcgaggtttcccaaatttgatccaatcttatcacgcaaggatttgttgtttccctgtggctcctaacagtggtaggtggcatcatacttaccacaacatgttttgtgtaatgcatgcctacgcccctgtgttatcgacatcataattcccactgatcatgcttctggaatataattgatttaatgctaatggctaaggctaacagacgcaattagtccctcatcagccctggtgcatattgctctctgatctgagaacacaaaattctaggtaggacatgaataataatagtcaaattaagaaaggacatgtctgtattgcatatatcgatctgcatttgataagctagctagctagagatcggtgatttttactggcttctgtgttgagtgatcaaaatcaaattaactgctactagctagccagctagtgattgctacttacatatcagatcaaaactgtacagttaacatcattttgttcaattaaacatatcgcatcaatcacaatttgaaagtagggaaacccgttcgccccagaaatctactgcaatgatagaatggactgatcatgcatgatacctggacaactgtgtacgggacctgcaacaagcagcagctcattctactgagcaatttgttcatctgtcaactggggcaacatggtcctataaacagctgaaagcacattgtggtaccattggcaagaattaacatgcacttgattgcaccagaaactaaagcatgcatttaaaagttaatcatgcctcgtttctccaaattagagaggacgagatgcataactaacttatatatgttcttctgttctagtttcttgatcagaatatatatcaaatatagctagtagcttatgtatgccatctagcactggaatggcatgccgccgaatccattgagagatctaggtttagtctctcttaaattaagtgatatatgcatgagttactagctaggtgcagatacctttgcacctgcttctacgtatgaattactctaagagccggtatatgcaaaggccctagctggatcatggctaagttctggccgctacaagattgatcaataggcacatatatcatcagctacatgcaaaggttagacatagatgctcgaatgctagagcttcttctgtactgttcagtgccgggagaggaaagggaaagaggagtagcagctagcagcaggaggaagaggacgacgtgacgtcagctggtgggcccatatgtggggcccaagggccttcattcccctcacccacgcgcgacggaaaggagagcgaccccgacccttttttatacccgccaccttctcgacccctcttttcttctccaatgcaaactccatctcctcctctccaatgctatttattcttccacacacgcaggccagcttcttgccaacagctagagaagagaacatacagacgagtttgtgcttctccttggagaagagagtttcttgaattcgatcgcctaatctgtatagatcgagataactgaagctgtcgcttgatctgaggtgagtttcagtactggttgatcgatcagttattagctatatatgttggtgtgttcatcgatctgtgatctgtgctggtttgatcatcttgatctgttctttaattttgttcaatctagctcctctctattaggcaaaaatccttagctgcttgttcttcgaaaaaaaattctagcacttctcttctcctctttgctagcttgaactgaaaatagtcgaacaagatgtagctatgaatgtggccaaatacatctcgatgcagaaacttcttcatttctgttatggaaaaagatgtggctatatatatgccctgtttatttgcaaccttttcagttttttttcttttacattcccctcttttcttcgttgatctttattgatcataatcagatgcttaaaaaaattcttcatactggtattggtatcatatgcatctgatgtgatatgatgtatattgattaaaaatcaagctgtttattgcatgctctacatacatagtagtatgtgtgtaaagttatatattttgaattacatttgctacttcaacataatatttttataataaaaatcataaaacaaacaattctctgtgtcggtagtatatgttttgtatatagagcaattttacagttctcaaggtatcaaattttacaagagaaaagtggtaccttaaggactgtaaaaaataaatgtgacacaaataaatgtgttcattcacatgtaactacaacactgtcacaccgcacagagacattgcatccttctgattgaccccctatatgatcatagtaattgatctacctcttttccttttcgagaaagcgcagtggtcatatacataacccattttttcttctttctttttgttccattttacccccaaagaaagatctgaatcatacactcaaatagaccgaaattgccttttagattggccaatgtatttttggatatggtggtatatggtgctataaaaattaaacgagcactctcaagatggtcggttcagatcactatatactactgtagctatagtatgtacttttacacactgtgaagtatatatatgttgaactaaattatatccacttatatatgtcgtcgtacaataattaatagacggcgtgacaacacttcttttacacgaaacaaccttatatgagtaagctaataagtgctatacagtccacgcatagtagttttgttgcaccaagctagatgaggtttgcatgcagaggctggaattggaaaaatggtcggaatgcaagcaaatttccaaagtctgattaatttgaagaaaaacaaatataaattaatgtagccttttgccatgtaaactataccagcactgtactagtttggtctacatggaaatcttccataacttattttgttccaatttctactaccatataaaaacacaagtgtggaatgtttttttttgaattttttttacaagtgaccattattttagttatggcg

SEQ ID NO: 69492 - DNA, 23212 bp, Oryza sativa
  unsure (1)..(23212): unsure at all n locations
cttaggataattaatcttggtaaatcatttgtctcattcttgaatcattaaacacggatacgaaggtcactgtacatatcgatctaggaccaccatcccctttctatccattctgacccaacctggtatagtatatactaccataggaggtctgtgacaatgttagcaaggtagcatgcgtgcaccatcttagttgacatccttacataataacaaccctagaggattaatactttagtgtagtgactgatccatcaataaaaaatcaacattcctttttcattgccatgaggtatatacccgacatcgggacttataggcggtctgtaattttatcctaattaaaaagggtagatctcacatgaaaggactggatttacaaattaacaattcattagcacattaatgaatggtgtatacttatatatatattataaattaattaatcatgcattatgtcctgttattcaaattcgttgcattgagcaagatctcaatttgtcatttctcttgcaagctctcgaggggacattcccttattatttgcatgtcatctaatggttataatttttttataaaaaaaataacaagatagattaatgtgatatatcactctacgacacatggaatgtcaaatttaacttctacatgtcgcaaaagaaaaattggctatgaatatatgttaactagctatagtttaattttcttttgcaacatgtagaaattggattttaacttgtatgtttgtggagtgatatatcatatattatctattttctcaaaattttcatatttatttagatgatatgcaaacaacgaggtgatgtcctctcaacagttcaaaatccactccctcacatttaggcttatcagctcattttctttggtgagacataaaacatagaaagagtatttcctagtatgagatgttgtatattatagtatgataaatctagacaaaaatttgttcattcataatactagaatgtgacacatcccatactaaattaacttaatatgtgacgaaggaagtactatataactagcaacaaccatgcatcacaatactaaaaaccaaaggggaaacacaaaatgattgtgatctacccctggaccttctgtgtccaccctacagaagagctaccatccatgcatgccctacgagctgtactgtactcctccactgcacaggacactccccgtccagtagtacgatcggcatgcactatagcgttgcaacttcgcaagcagtatctcagcaaatgtgagcgcatctactagtagctaggatcagtaggcagctcgcccacaatgcacaatgcaaggccagagctaagctagggtccctgctgtgccatggaattcctcgacaaacagacagaacggtcagaggccgtgcaagaaaaccgatagtcgtgtgcccctgctggctgctgctgtgttagctttccattctctctgtgcatgccatggctatagctttcacggagcagtgagtgatcgagtgagtgttagtggcgcttttttagcctcttcttctcctttaatttgcaggcctgatcgctgaaagggccctccgatccccggcattggctagctagcttcctctcctcacgtttttattctctccatcttttgctcccagccccacctttaatttgtcaaatttttttacatgccccacggcatgcaggcgcgtgctcatccgcccggcaaatgctagcgatgcagctttctcgttttggttgttgtgttttaagcttagccccagcatccacgcaccatgtataaatgccatatgttttataccctttttatttaggcttataagccaacttataagtcaaaaaatataagcctaaacaaacaatcagctttttcgtttggcttttttgaagccataagccactctaacactattaagccaaaatctaggttggagaagtttttttggcttatgtgagatagatgcatgactccaccattaaacttagaacattaaatccaccggcttataaatcatataagccaataagctgacttaaaagtctaagccaataagcccaagcccaaacaaagagggcattaggccccgtttgattcaaaggaaattcataggaattttagaggattttattcctataggaatttttcctacaaagacctttgaatcaaaggaatgaacactatggaatcctatgaaattcctatggaatgcctcttcccatacaagttttggaggaattttaacaagaggtagaacctcatggaagaaatccttcgagtctttatctctcctcaaattcctgtgtttttcctgtggtccaatcaaacggtcattcctatgtttttcctgtggtttgcaatcctctgttttacacttacattcctgtcagaatcatatgtttttcctattcctccgttttttcattcctttgattcaaaggggcccttagtttgcgaactagataaaaagctgctaatattaagatatattcaattctagaattaattgcagatatattgcattgcatatatacttgatgctctaagctatatacagtacgtacgtatatctaagctatgtacagtatatgtacaaaataaaggcctggcaagctctgcgtacagtgctttgcattgagccatgcatgaatccattttcatgagagctgtatgatcagaatgagtagaaaatcatgcatattgaggttcttaagtactagctatactagcgtgtatctagcgcacacatgcacttcaaaaacatatatgcagcactctctagtataaaagtcacactaattgttgctacaaattaaggcccctaattttattactctaaacaaattactgaactctgaacaaactaatcagagaaggtacaataaatctaatcagcaggctccaaaatattccaactcagattattctcacgtggaagagagataactggagagagggaacaaagcgggcgctagatgtagcgccgagcgatacacagatacgcatgcatttgtgggtcccgcaaccaccccgccgatcccgtgtatcgttttgtttctgttgtgcctcttccgatccgcccgatgcattttgctccgcttcacgccgcctccgctcacccctgtctcgccggaattttctcccgcgacgtgaaactccgccgtgaaagctccagtgcgcccaaaaagttagtaatcccagttctcagcgacaaagaaagcgagaggaggattgagaggcgcttggtgcgggcatgcaactggcacccaaagcaataagcaacttcttgatttgaattggcttggtctaattcttttcttttcttctcccactgtctgttgaatgcttgtcgtctatgtttgttctaccgattcttcgtctcatctgttgcatctagtccgttctaatctcttcctatagctccttttattttcccttttgttcttctccttttttcatgtatagattatgcagttgggcagcagtgggttgtgatatactatgtgaattatcaagtgtgttgttattcgttaatttttcaagtagagtagtagataacccatatttattacataatacaaatggccatataagccacagagttgagggcgtttctgatcatgcacatgtaaagtttattgtttgaataatgagatcatgttgatataatagccaacctattgtactagttagttttggtattggctataaaatgacatggatgttattggagctagtagctggctacactattgaccttgctcttatatagcagaccatttttctgctgctgcaacagctataattcgttgctgactatagcccacatgcctctgagatatcaccagtcgacagtatcattcgcaggcctgtagctttcctacatttgtccctgctggcctcttgcccaggctctgccgtactttgcctttttatcctagaaagtccatagtgcaaacccaacatggctggattaaattttaccaaagcactgaaacccatacacactactgtagtagtatactccttgtcagtcagtctgtagctagtcattcagtatccagaccaaaccaatgctactagcccttctgtgcagatagcttttgcatttgtgtgtcctataaaaaatcgcaagatagccagcctgcttgcaccgaatgattcgagcacttgcatgtgttctttactactagtgccactcgcgagctatatcatttgatgcatgcatgcattgggtgtggatggatatttagaagacggtgttgctgaatctgatgcacggtgcatgcaattgcagtgcaggcacaggttggtgatcatatggacgccatggaatcatgcgtccctcctgggttcaggttccaccccaccgacgaggagctcgtcggctactacctccgcaagaaggtcgcctcccagaagatcgacctcgacgtcatccgcgacatcgatctctaccgcatcgaaccctgggatctccaaggtacaactagagatcgtatgattaatttgagtttcagagatgatcattgtggcattatttatcctaattgtgttgcctggtttgttgattgatgaagaacattgtgggatcgggtacgatgagcaaagcgagtggtacttcttcagctacaaggacaggaagtacccgacggggacgaggacgaacagggcgacaatggcggggttctggaaggcgacggggagggacaaggcggtgcacgacaagagcaggctcatcggcatgaggaagacactcgtcttctataagggcagggcgcctaatggccagaagaccgactggatcatgcacgagtaccgcctcgagaccgacgagaacgcgccgccacaggtatatacatataccgatttcactagctaattggtttcttaattttctctgcatgctagctagctctacataaactagcaaactggttccatgcttgataggctaagttcctaattttaaaaagttgtatatatccggttggatgtataggctgggtttatcaaaaaaaaaagaaaatattttttaaggttgttagtgaccacattgcatacttatatatctgagaaaatatatctgaattatatacttatatatgtgtgttgcaacttgcaactgaagataaaatgcagtataccagcttaggccttattagaggttaaggtctaatggtgcccagagatttctaaagtagcacgcacagagatctgccgccgatatacatgcgtgcaagcatgtctaattcatgtaccactagtaatggaccatatagataggaatatatcagtagcactaagcagcaccacaactctttttgttcttgaaagataagtcttgcattggcctccctttttgtgagccttccaaagtcttctattctctcccaaataaaggtagcctgcatccagtgttgatgccatcctgaccttaccactaacaccaaaaccttttttccctagacaattgcatgcgcatgcatggcctagttagggtttcccctggtgtgaacgtcctaacatgcgccatatattgtttacaagctgtatgcaacttgtgctagtactcatcaaaaccattgcatgctgcttggcaaacatgtcaccacaaaactaaaaaagttatcagctcgtattgttccactatcacacagtgggaagctagctaactttacgaatgattggcaaatactttggtgtcaatgtcaaccttgcaaaatgcagctcacatcccccccgttcgtttcctcttaaaacaatggattaaattttgaatttttgtgctacgcttttcaaactgctaaacggtgtgtttcttgtgaaaactttctatatgaaagttgttctaaaatatcggattaatctatttttcaagtttataataattaaaacttaattaattatacgttattaccacaacgttttacatgaaatatttaatcttaatcttcgggagactcaaacaccacctaagtatctaactttatttgcatgtgtgtactacaggaagaaggatgggtggtgtgccgagcattcaagaagaggacggcgtatccggcgaggagcatggtggagacgtgggactactccttgcacgagcgcaacatcatgagcgccgcggcggcggcggcgttcgccgatccgagcgcggcgtacgcgcagatgaggcggcagcacaggagcgggcggttcaagcaggaggcggagctggacggcgccgccacagccctcctccactactccagccacctcgccgagctgccgcagctcgagagcccctccgcggctgcggcgccgctccagcccaacccgagccagctggccaccgccggcgaggacgacgactgcaagggcgataatggcggtaggagggccaagaaagcccgcgccgccggcgacaaggtggcgacgaccacggactggagagcgctcgacaagttcgtcgcgtcgcagcttagccccggggagtgtggcagcatggaggcaacggcggaagccgcggcggcggcagtcgccggtgtgagctcgccgctggaccacggcgatgacgacatggcagcattgctgtttctcaacagcgacgagagagacgaggtcgacaggtggacggggttgctcggctccggcgccggcgcgagcggcgtcgacggcgacctcggaatctgtgtgtttgacaaatgagggacaaagcattcacagcacgatgtgttcatcacatcaaccggatgggatatatggttatagctgaaatttttataaattgttctctttttttttcttctgcttctttttatgttcccaaatgtgattgtaacctttaatcgatctgtcccctgtgcagagtcataagatgcatggcattgcaatgtgctttttttttcccagttgatgtgatcctacattggcactttgtaaatgtctttgactcccagctgggtggcatatatagtacactgtactctctacagtaattaatgacataatatttgaagtcagcataacttgctagaaacgactaaagcaagaggtgcgcgtgcagaacaaaatgctactctgactcagcacactagctagtaactcgttgaacttgtacaaatattatcaagaaaaaactctaggaaatttagattgtgatcactagtcaagagggctgtgcgattgatcaggctatatacataatcatagattccaaaacaaagttgtattatatatatagattcttatagcactgctggagaaaggggcatcactcccggttggtaaccctctaaagtcctggttttgcaactggaccacgaattcaagactaaagatgttaaaataaccaagagtaaagattgatctttattcccggttaccaactggaacaaaagagggtagcgccaggctctctaatccctattctcctctttttttttttctttttcattgttctttgcatattgattttacaccaaaatcacatagatcaacatcacaaaatcgaacattgacatcacaaattcacacatacatcacaaatccaccacaaatccagacatacatcacaaatccaccacaaatccacacatacatcataaatccacgtatcaattcgatatacaaatttactaacacaatacactacaatttactaaaatatttttatatatatttttttaaaaaagacgagtgatcaaagttttgaagataaatagtcctattgacagttactaaaaggggaggtgaatggagtacgtgttatggctttatgcaaatttggcgtgtttgatagaagagaatatttgtgactacctgagaatacagatgtgatttgcatagaatagtgacaggctctaggtagtagatctgaagcaaaatattcgctaaatcaatatactcctatgttgttattagtgcggtctcactcaatcaccacaaatccctagaccttaattcagtcttgttcccagttgttgccaaacgacgaagccgtaagtagggatgccagtagttagtcccgttacccgtataaaaacccgtttactagttcatttcttacacgatagtataaaatttagaagaaaaaataaactagaagagagatatataagcgggcttaaaaaaaacccgcttgcatccctaccgtaagattattatatacgacaacagatgatcttccaaataggaggcctattctctcgtgataggtagaagggatcaacaactaattaattataccgtagtgcgtgcttactacccattaatcaattattataccgggataatgaactcagtctaaaatctctgttcatgttggtctaatatatattatcactaactagtctgatcaaaataatgcagaaattcctattctaaaaaaaaactgcagaaatcaaggattcaagggtgtacctgctgaattgctccggttgatcggatcagcttctgaaaatccacccacggatcgtaactcgccgctcgccacacgcccaaaccagtacaactagggcggcggtgcgcgccaacgccaatcgatcggccggtggtggcggtgacgcccggtgccggcgccggccctcatggaaacgagaggattggtgcgaccgccggagtgcgctccgatggccgattggccgcggcggcggcggcggcaccgcgagtcggcgagacgacgcctgatcaggccgccgcttctcttccccaatccctctacctcccggtcttgtactgtacatcatttaggcccagcaaagcccacgtagtccgttttttatgtgggcctcatcagtccttcctcgcaactaaggcccatttagcgaaacccaggctcgttggcccagttctcccctccgtcttcagttttctccaccatgagaggactgctacagagttgtggagtggatctccgcctccggtgagctccagctccgatggcacgcggaggcggctacgggtgggcgctcgcggcgggcctcaacgccgcgctcgccgccatctccgccaagttcttcgcgcctccggtactctactagctctctctctacctccctccgatctgaacattctgttttctgttcataccttgcttggaaggctgccgctgtaaccttaataggccgcttcagcctttgttcgggtttaatttgttcatgctggttcgattaaatgattttaccaagttcatgggcatgaaacagtcacttacttggatccgaagttgcggattcatcagataattcgaggttagatgtgtgatcccttcagctaatgacttagtgctagaagtataactgggataatgtggaaattgctgatcaaaagttaactatcatgtgtggttcaattagtttaggatcagattgtgaaaatacctcaaatcaaatgataccggtttaacctgtactccggattagttcctcctaccagtgtacttgtagtctagtgctgcctgctattttgttacttgagacttgactttattattgccttctacagcttctgaaatacagcatggtgatacttttcaatgtgacaatgtggggctgctatgtgaacagcctcaaagcactgtcatccctccaagcaaccgtcaccaattttgctgccaacttcatttcatcaggtcttgcagggtactttctgttcgaggagccactgccttctaaggtaatatgagaattctcccttctgtgtagtgcgtgcacatcaagctagttattcatgcagatcaaatagctaaaaattttcaaatttatttgtgttagcttatgtcctctgttagattgggctttttcttccctttcaaacatgggaagagtatcctaggttgatctgtcacattgcttcttagtagtatgagtaggtttatttattataaataggattaaatctagttattaagctaggccactttatctggattcatattactcgcttgaaaagtcacatagcatacaaagattatcttataatttactgttgtatgaaaaaattcttgagagatgcatgcagttggttgataggaaagaaaacacactggatctttaggttgttatgctaaaatagatgccgtttttcagatagagaaatagatggtcttgtgctttatatcatgagcaatgacttgcccccttgtataccagttaaatacaagccaaaccctgtcataaatacaacaataataacatatcacttgcctactatatctgtacagctgaatttatgtacagtctgtaaaatataataataataaaaaaagacatttggagggagagatgtccctccaaacagtttcaagaagaaatgtgagcgtgttggggattgaacacgggacctcagggttgaaaccacacaccctttgccactgcattatcaggtgtatctcagactgtagaatactgatacatcactttccccacttttgagtttacatgtatacaaaattgtaactgaactgcactcagcttttgaatttgatgtatgttcatacagtggtttgtaggtgctagtcttatcattgttggtgtttttatcctaagcaaatcaagcatcgagaagaaactgaactctgactagagtaagttttaaggccaaaattttattagctacgacacacattgtcagtttgtacttctataagcttgtggtatgtttgaccataacttgactcttttgtaaaaacttgtgtcaattatgttttgcaactttagttcatatttttgtaattagtaaataacttgagctcatctattgagacatcaatacaagattgttttaaaagtgaatgcatgatctaagaattgctttttatattgactttaagatgacaacaatcaggaagtggaagcgccatatctgaaaggagtatctcttttctcattagcagtatagtcacagcagaaattcttccctctaatattttcataatttcattgcccgagctctgactttgattttttttacggcaagaggagattttcagctgttcctgaagcactgtagatcatgatcctctgaaatgcagtgtgagtgaaaaaagataaggttctttccactgttcatgaagcacagcagataatgttcctctgaaatgacaatcctatgtcggatgctccatcaacattagcttcccatctgctgacccctccaagggacagcataatttgcttttgatacccgcggtatagtttcatcagtgtttaactgtcccttcgtttctaagagaaccttcttagtacgccagtctggactgttaactgatactactaccttgtttggtgatactgatacctgaacggctgaacctgtgttatcacttgtcaggaccttacagtttgctctgtcctgctagcgagcaacgcaatcagtaattcagtatatcgaaggagatcgtgcgtggtcgtgctatcagccgatcaagtgatgaaaacttgaatctatagggattgaattgtcatcctcatcagtaaaaaatatttgcattccaaacatgtctgaggcttttcttgaaataaaaaaaagaatcattgcagttgcctgttgcagcatccggaaagaaagaaagaaagaggagcacatgcacatgccatgcgtcccatttgagcatcttttattggggtagggtgggttcctcctgaatggatgcaatctgcatggcaagtaaaccatttctgttgactagtacaaactcctgctgaaaaatattcttcagacaaacggagtaggaccatccgagacgatcgatcgatgaatcgatggactttatgggtgtagtacgctgggcagagacaagagtttggctatcttgattctgaggatgagtcgaccaagggaccctttgcagggtcaggtttgttttttgtcccactctctggaagactggagtagtacactacttgaagcatcccatagctgggggatagtgacaattacagagtcgttctacattgtgtattcgcttatctaatttgctgatcctgaagaaacgggcagtctatcctagatggaaatggaagaacaacgatctgaaatgggaatagtaaacccgaaattatggaaattaggagtaacacaggattgattggaaacgtttcattcagaaatttttatacgttccaaacgagacactgcgtgttgcttcgactacacgttgtgcgtccggcacgatacgacaaactttccagctgaagctggatgtatgcgagcagtgcaacggccggccgggaaacgaacacctcttgaatccctctcacagaagcgaacaagccagcttcgtggccagtaagtaccaagccacagctcaccgcggaatcgaccggggtgagctgagctggatgcagattgcgcccggagtaaccgagctggggacggggttaaagtgaggacatgattagtctgttgaaaaaaaactttaggaataccaaattttggtttattgatacatggtaaaaaaaaagtgtaccagagatcttatttgctctgaattttggaaatctcaagagtaaatactcagaatctactaaactcctatttggtaaggttcatatatgtttagaagatagtatatttgatttattacgcaaccgaaatatggtatattgtttttcctaacgagaaaccaatgaagcccttgattttcggggtagaaaatgttgaaattcttactacaagatgtctgatttattaccttacaaaatgcgacagcagtaaattttggtgatctttaatttttttttgtggcaagaaacccatcaaagcccctttgatcctggcgtggaaagcgataagcggtggtgtcgcgtcgcgtctgcagtagaaatggaagcctgggggctgtggctgtggcgtgggccaaagcagcagccatcaccagataaccccgcccgcatgcccccgcctcaggcccccctccccaacgtagtatattcacctcgccgcacggcagcggcagcagcagcgtgccacgagacgaccaccagctagctcgcaatggcgcagcacgagaggaagccagtcggcgaggcggtggacgtggaggcgggaggaggaggaggacggcagcgagctgcggcggcggcgggggagagaatgaggttgacgtggtcgtgcctcgccgtggcgccgggcgtggcggcgacgggggtggcgggcgcggccgtgctggtgtggtgggcggtggcgttccacccggcgcatgagcagctgtggatggtgcccgtctgcctcgtcctcctcggcccccgctcgtcgcctggctcttcctcttcgcctccggtgcgtgccgccgcctcggcggcctccgcgccgtccaggatctggtcccgccgcccttcgctgccgagagatgactgggttgtcttcgatctgtcgtccgtccgtcgagtgtacattttcttagtcttattattcttcttcggtgttctttcttatcgtcgtttttcctaagatgatcggaatgtgatcagaatgggatccaaattctaaagaaaagttcttgctagtacaaacctgcagatttcagatgcttcgattgatcttgcagataagtttggcacttaattatattctagtcgatcaagtacgtgggaagaaattctcgttgtcaaggttttttattcagcgagttaacattgacagctccggatcgaattttgagagagagctatgcagctcagcccgacagcgatttgtcatagtcacacaaaaatgatggctcctttactactatcgccgcatagtccacacataggcacgagaaaagaaagtgttgttttctttcctacgcggtcactgccacagcttggaaacacagagtgaccgcagcgactagtacttggcagttggagcacgaaggcctgaatctgatggtggtgccaactcggccaaagtcccaattattcctcacaagtcgcgacttggcaatcgacgtcgccttcaataatgcaaggctgactggcaatgagactgggcatgtagcacgcgcgtcgctcatgtgtgtgtatcacgctaacatttgtctcggggctctggcagattatgggtggagatttggacggaagctagctagtaatatatatgttggtctgttccagttacgttgcaaactgcgataatggcgaacggatcgatgggcacaaagccacatatgcatggggcatggacttaactagatagtgcggtttggtggcgtctacacgttttagaattcgcatctcattctcggtgaataaaaacctagtcaaaagttgaggctctcccatctgcaagactgcaaccgaacagacgctgaagaatctatcttaggatcgagctcgtcgtgttcactgttcaggcggccgaagctttgcgcctggttgatggggacgggagtatctatagtggaccagtacttcactgtactattactactactactactactgctccagtacaaatactgatgatgtgtgttcgcatcacattattctggctaagctttcttcctcctctttcttgggacgaggacagcggcggcagcgtacgcagcgggccagattctacacgaattctgcacgctagttgcatgcaaaagccgccttgcgagttgcgagttccgacgtacggttacctctgggcaccaaacgggaaaccggccaagccgttgctgtgtttcgagttccgacgacgacgccgctgcggcagcggtgcactcacactcacgatagctgtggcaattcagctcgattatatcacgggcgggggcatggcgtgtcctgggacggtgccattcggtggagcgtcaactcggaaagcggccgtccggtgacacggccgacctggcctggcctctcccttcggcttcacttccctagcttgagacttcccaaagagcacccacaatagtaaagtaacgtgctatctataaaatatatacatatcagtaatagactagattaatagtaaaccactttaattgtatgtctatatgggtatctatagctctctaatccattgtctcgtttttctctatagactatctccagattagtagatatctttgctctctctctccatttaatctctttcaagtaggaaaatatgctgacatgtatcttttatagaaaatctatagataattattgcgggtgcccttattgtaccacatgttgatggagacattcggggtagttgaccacgtcggggcgatgaatcatgcgcgcatgtatcgtatggtctggagacgacgatccttttcttctcatgggctgggcttctttcactcgtcgacagagagcatcatgggccagcccaccgttgtttttgtaaggcgagagcgagagagagagagagagagagagagagagagagagagtccggtttcagggcctgtttgtcaactgggcctgaaagaattgggccaggtttctcgccagattatgggctcccaaacagagggttttgggtttatgacatttcttctgctgctaacctgccacgttgggagctgaatatctacgaactacgtcaaaatgtataaaatcgcggttttaatttttcttttcagaaatctcttagcatagccttcttaaaatagaaaactaagcattttctatctagcacgattctactttcttctaactcgcggttaggagtgtttctgcgacaaccatcaagtataactcgacaaaaatcaccggccatggagctcatcgaagtacgtatcctcctggaatcgaaatcccacaagctgacaacgcaaacaaagtcgcacgtggaactctcactccagaacaacagtgctgtccccgtcacaataatctcgccgtctacttccaaagtcacgaaagctgctgcagtatcaaccactaacacaagagttgcaatcacaattctctccaaatgtaatgtgacggttacgatttcaaatcagcaatcacacacaggtcgatcggtcacgccccctgtcgtggtaatgccttgatggcggcgaggaaaaagatttgagagaatgtggtgtgcagtgcaggcagcgacgacgaacgggacatggcacgaggcgctagtggtggtgtggtgcccccgcgtgacgccgcaggataaggctctcggccccatcgcggcatcaatcatgcattcacgctgctactggcctactgctattgctattgctattgctagccgcttgctgattcgtggcgcaccgcttccgaccgcgaccacatcaggcaaggttaattgcgtgcatgattgctggaaaaacaacacagcaaacggcatacagtagcaagatcacacacgttcgtttttgtcgtcgtcgcggtcgcggtgaattgttcagaggagagccagagtttgttcaggggaggacgtgtggagcacggatggatcagcgcgtcgttttcaacggaggaatgattgagagtacggcaccgtacgggtgctccttcgaggaaggtgcaaagcacgcatgttcagggttactactagctcgttgcctgtcgctgtggccacggtggtggacgacggcgagattttccctactccagcgtaaagaaaaccgaaaggagcgatctccaagtggcaacacgtaaaatctcgccccacatttggatttatccatccgaggaggagccacggttaaatgccgcgttcgcgcgtgctcgttacgtacgcgtgttgctttcgagtttgattaatcgttttttttgccggggtggtggtgggattgggatagagttcgggccactgcctgtgaaaactgtgaatcgcgtcgcgttgcacacggccaaaacgatagcgcgcgcacgcacgcacgcatccgtgccgcacgccgcgcgccgcctacgtctcgtcccacgcggttcccgaccggaccccacaccacacctgccaccaacgcatctccgccttatttgaggcgcgcgcacggggcgcccaagccatccagcctgcgtgcgacctaccaacgcgcgcactcctcgatcccatcatcggaaggcggcgaggcgcgcggtggaggattgatctgcgggagggattgatggcggaggcggaggcggaggcggcgggggcgggggcgggggcggggccggcgaggaggacgacgagggtggggcgctacgagctcggcaagacgatcggggaggggagcttcgccaaggtcaaggtcgcccgcgacacgcgcaccggcgacaccctcgccatcaaggtgctcgaccgcaaccatgtgcttcgccacaagatggtcgagcaggtccgccgccttaatcatcctcaaaattgaatatttatctctttttttagacatcaggtaataacaagttggatcttttctcggaggggatcgaattaagaatcctaaattattctagatagatgctagattattataaaagatggattttcatggggattaataaacattaaacgagaatatgcgcttactacgtctctaccattgtcaagattctgtctgtttggattgtttgtgattgaagaaaggtcatgtgtccgcctgtccagcgggctaaatctgctctgatctaaaggaaattagatggaattgtatcaagtttgaatcggaaatgtaacaacagattatcaagctgggccatgtaactataacaatatctccgatgcggtgatgccaaccctgtcttaatcaaatgctttctgcctagcaaaaagctgtgctagctttggtgttcgtaggagtggcaagagttgttctagattcatttttttttctcggggagttataaattcagtctgactggggggaaactcgggtattgtacattccgtgctagatcactcattggttgatgcattgtttggtggaaaaactagtattttttttggttaaatatgtgattttccatatgatgtgttggcacaattaaatgtccctgctcgagctgttctgttttccagcttgagctttcgattgtgaatgataacctcatattccacttctatcagatcaaacgggagatttccacaatgaagctaataaaacatccaaatgtggtccagttgcatgaggtactttgctatctttgcaggaacaatagcgtcattaccactcatacccttctttttttttttatctcatctcattcaatgagaattttacattcaatgtgtgtttgacaggtcatggctagcaaatcaaagatatacatggttcttgaatatgttgatggaggcgagctttttgataagattgtaaggcccatgaactttctgtgccagatatcacgattcttatttttgtttatgtacaaattgcttttacatgctgtaagagtagcttgttgaaccggcacatttgactgttttgatactgactgactaatccgcagttcttggaccatacaagttgacccatttatcatcatgttattatcaactaggtcaattctgggagactaggagaagatgaagcaagaagatacttccatcaacttataaatgcagtagattattgccacagcagaggagtgtaccatagagatctgaaggtttgttgaattatcctgcttacctcctttctgggtaatctccactgggatggatgtattctcattcatattttttatgtgccatttgcagccagagaatctgcttcttgattcacatggagctcttaaagtttcagattttggccttagtgcgtttgctccacaaacaaaagtatgatatctagctagtacccagaagtatgtttttgtagttgttaaaaaattaaccagtttctttatcctaatgtgatgtgtttgggttttctagcatttttctggtttaattgacttgttccttaacttgcactattacctcaaatgaacttcggacgcataattatttgttttggtgacaagaaagttgaaagaagtaactttggtaaactattttgattgttttatttaggaggatggacttctgcatactgcttgcggaacaccaaattatgttgcacctgaggtgattcatgttgcctttgattaaactcgtgtattttctccaaaaagatgtaagaatcatatattcatactgttccctcaggtgcttgctgataaaggttatgatggtatggctgctgatgtatggtcctgcggcataatcttatttgtcctcatggctggatatttacctttcgatgaccccaacctaatgaccctttacaaactggtaagtatgtgtaacatgcacgcattctaatgtttcttgtgaatttcattggtaaacttgatagacttttgatgttctcttcacagatctgcaaggcaaaagtttcttgtccacattggttttcttcaggtgcgaagaagttcattaagcgcatacttgatcctaatccctgcacagtaagtgacaattaaggacatatatcttcagctaaccagtttgaccagctgactgctgctagtccaatgagtttcattgtatatcctctttgaagccttttatgatggcaatttgagagaagtcagaaaacaatgagctatattctttgcagagaataacaattgcacaaattttggaagatgattggttcaaaaaggattacaaaccaccactttttgagcaaggtgaagatgtgagccttgatgatgttgatgctgcattcgattgttcagaggtaatgctagctgaacatttatctgtaacctgcatcctttcccaaaaatacgatttgtaacctgagttaaaaccacttctttgtttgttacgtttgtttgtttaacctttcaggagaatctcgtggcagagaagagagaaaagcctgaatccatgaatgcatttgctctaatttcaaggtcacagggattcaaccttggaaatttatttgagaaggaaatgatggtaggttttgatagagtccaatattataattccatgttgagaatatgttatgtgctagatagattggagtgcttctttctggaagcttgtatcggttaatataattttgctaatgttttcctcttttctttatgtgctaagtccgacagaacaattatgttttgatcaatttatcatcctattagttgtactccttagtcgtttactaaatagtctgagtctacctaatatatatagggaatggtgaagcgggaaacttccttcacatctcaatgtacaccacaggagatcatgtctaaaatagaggaagcttgtggacctcttggtttcaatgtgcggaaacaaaattataaggtttgtagcattttagacggctatgtattgactagtttgctttatgtgggtttctgttagtttccttgagaatttgcatcagtatgttcgccattcagaagtaacttggatttgttcttttttgttgggctccagatgaagttaaaaggtgataagactggaagaaaaggctatttatctgtagcaacggaggtattggaaattaaattgacatgtatcctgttaagtctgtgcaatgcttcagtaaattttgctttaataaaagaacttattcacatgctatctcacaggttttcgaggttgctccatcactccacatggttgagcttcgtaaaactggaggggacacgctggagtttcacaatgtatgttatcaaactttgtatattctatcatttcatagtgggtcattgaaaaaaaaaatcatttcatagtacccagcatctagttgtttcttgatgatttcagaacgattaacgtcatttctatcaaattgcatgcagttctacaacaatttctcgtcagagttaaaagacatagtgtggaaatctgaatctgacgcaaaagcagcaaagaagaggtgatctttagtattccaactatccaatgctcctggatgtagttccccctttgtagcgtttgcaccatttctccaggtgataccaaaggatatcgtcctcctggtcttgtgcacattgatgaattttctgtggggtcacatcttgttgtgccaatccttgcaaaagggagcgcttttttttttctttttacccttagcgcaactgtagacatgctcacatgcatgtataaggccctcccggagatgcaccttgtatttgcagttgggatgtcaaataggtgtcctacatgctttggtgaccagtagggttgtgtgccttttcttttagtgctgaaaagtatataataagatcaaaatgtgaaattgggaggctatgtaacactaagctgtgctctgttcttgagaaacctagcagcagaatggcagtgtaactttgttagttctttcttttgtgaaactgtaatggcttcacacctgagctatgggtgtatgtattcaatcatgatgcaatctgattggccggataaaagaaagaatagtaatcacctttgcatgctatttattatgaaccatcacatcctcttgggccggatcggtaccaatgcgattctagtcgggtttggtctcaccagcccatgagttaatacggcccggatggaggagagagtttgatttgatctgctcgcggctctccctgccacgccgccggtcgccggagctccgtcagccgtccaccggcgttgctgcacggaagctacaggcgatcgccctggagttagctgcactacctgtgtttccttgttctccaactcattagcagatgggaactgaagcatcaaaatttaatttctatttgcaatcttttcagttcatttgtttaatacagtagttcatcgtgtgataagttgtcttttatcagctgctaattgtatttcagttgtattacgaggctgatccatttgatacggcttttgcttgagtgcgatgatagcaaccgcaaagctcaaatacaggcgccgatggttacaagatttaaaccagaaaacagtggctgcttttgtttgctgttgcgatcattcatccgacttcttttttccttttgcagggagtacaaaaatgcagagtcatatgacatagactcgtgctggagaaaacaaagatgggtgtgtttagttcacgcctagttcacgccgaaattagaagtttggttgaaattgagacgatgtgacggaaaagttagaagtttatgtgtgtaggaaaatttcgatgtaatggaaaagttggaagtttgaaaaaatattttggaactaaacacggcgataaatttacttatctgtcaatgtctgctcctatacggacgatggtttctaggatatcatgaggtaactgtccatgtagttttgtccaagaaaattctgtcgccgagtggagcgatttcattttcaccctctgcgacaacgaaagaggcgggtcaggtgaggctggatgataaaaaccgcagcaggcagccaggtaaattttcaatggcattatttctgattttcttccatcgccatcttcaccgaccacagcacacacgtagcttcatttccgtattttctgctctaatatatttgcgagttgatgatcggaagctgaacatgacctcacaaaatcactatttttaatcatcacatgatcacatctgcatcaatctataattaacaacaattgtttcgtgatatatctggagtacgaaggctctgtttcatcgaaaacgaaaaagatgcgtcgcctttggctgaacggttgagctcctttctctagtccttcagcgttggaagaggtagctgccaatgctgtcgtcaggggtgacgagaaagtcaggatcatccgactcacccaaaccgcaaaaattgacaagcgattcactccccgtttgtttgattattataggatgcaaaatggatctgcaaatgcaaatgggaattgggacatcacaaccacagctgctgccaatattcttctgctagttttttcgtcatgttggaaatgaaaatctacccaccttttgaagccccggtgattctgccgtctttctttgcctcctcagtcctcagtgctagtataatctatggtcatggtgtgcggtatttttaatgagaaaatgcatacgcagatcaaacttttggttgagacttaaaccttttcctaactatggattgttgtgatcctaaaaccagtgcgcaataaagaactcgccgactaatcttcagtttatttatagttgaaaaagtttgtggagatacatacactagaaaattgaaaggacactaaaattttcaggcttacgagtggctgtttcttcctaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69493 - DNA, 9005 bp, Oryza sativa
  unsure (1)..(9005): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctccatgcttagcctatgcggtgaataaaacatttcgtaacaatctgtggagtcaatctggtcatagttttttttatgattgatttcatgggtgttttgcccctatgttagcacttattctcttatgtgcataagttgctttgtgcattgcaaattggctgttcattttaagtaatttgtcgatgaataatgtaatgcatcctccaaggtgtcgctcctaactgtgttgacatacaggcttcctgatccagctgcaagaaaatttctctgtttcgaggattcaataggcttgcagacggagcaccagaagccagattctactagcactggtgcaaaacagaacagctcaagtgatgataactcaagctcaacagatggcccacccgtcctaactattttggctggtatcattgtgttccttctagtcttgtgggttatcggatcgctcttcacctggattgctggtttggtctttggcgctgcaaaatcttagaagttcaaattttaggataattctgcacctttttagttgtacatacttcggtccaattgtatgccaatcttggataaattgcacttgatggtttcattcttaagtgttgaacaactgcttcatggtgttgtaccattgtttccagctgtgccttgggtattgccttttcatatgtcatttcgaggtggaaacagtggtttggttctgttcttttgtatgaatccctgagagtggaatttatagtaaaaaatttaacatacgggtctcctgaaaatgcaggcttgtgtgtttcattcatcagtctctgataaacattcgcattccccctaacagtgtacacgcacctaatcgaactgaaactccatacaagttgccttttgagcttgttgtatcagtgcattgtgatcttataatgctttgctatggacagtacaatcataccgttctctgactgctgaataggagtatatgccatgccatgatgtcttggcattcagttcagtctgctcccctcccaggcatcagtgcgactgtgaacgtgtgatgagtggtgactgttgaggttgaggccccccctgtatcatcatgcctgtcatgctatgacctcatatgaaggtgaactcaactcctgcaacgcaatcccggtgtagtaccaaactgcttttcgttaatgctcatatcagtacagcattactacgccattgctacggtcatcatcaatcaccatggatctgaatcctaacggcctgaaatcctgaatccacatcattctatagtccctgtcagatttcctgcccgttcttgctcacgggagaaaataaatccccccccccccccccccaccaccacagcaccactactacgaccgacacgagccacagagtcagaaaggcgtctccctcccgggaccagcctgcgccgcaccagatcagcgaccgaccgcgccagcgtcgcgcgcgcgcgcggcacgtgagatcctcacccgcgctccccaacggctatattccccatcaacctcctcttcttcttcgcctcgtctcgtcttccccttaaatcccgcgcttaaatccccctcgcctcccccatctcccgctcctcccattcaccaacggattcactgtgtcaaacctccgatctctgcaatggcagcaacggcgcagggcggcggcggggcggtgtccgtgcagcacgtggcgagggcgtcgtcggacgagctcctgcgcaagttcgccgacccggacgcgcacgccaagcagatcacgccgccgcggcgcagcctcgcgctgcggcggaagcggtcgtccaggagggtggcgtcggggctctccgcgagggatttggagtcgggggcggagctcgcggcgcccaagcggaggcggagcatcggcgggtccaccgagtggaaggccgggctgctgctgccgacgaccaccacggcctccgcccgcaagggatccgccgcgagccactcccaccggggcggggccgcgcgcctcgatgacgccgccgggatcggcctcctcctcgccgcgttggagcgggtaagctaagctctcaactctccaatgcctcgtttccaactctccaatgctgaattggtttcactctgcgcgatgctcagacatggaggaagacggtggcgggggcgtcgaagatgttcgtggagaggcaccgcaccaaccacgtgctgctcatcagcgacatggtctgagctctgaactctaaactgaagcctctgccatgacaggtggccgagctgtgactgattcttctctcgtcatcgagctctcctgctcgggttggttaattggtttccttcgaattgaattcgtttatgactgatcgattctacagtttagctagaataaaatggcagaaaagaacaacacaaaattgaactagctgtgtagttcaggtagagtaggttctttgactcctgcctctgtgtttgcttttattcactcgttgtttctttatactcggttgaatcatcgtctcggcgaccacgttgtaaattcaagtttgcaatatcaataccagtgctgttcttctcagagaaaattcagatattgtgttattgtgtgtttaggcaattaggcctttggttttttagtggattataggcctccatattgactgggctaaagacctgaatactgatgggccttgtgggtggctttcgctacacacaatctgaattcctgaatgaggtagaagaacttaaaaattccaagatccaaactttccacagatgcagttcaatggtttatactccacttggctttagattatgcaccatataaaggtttctttactagtatcagtccatgtctacccagaagcctaccttgttttctctagtagctccacatacgctttcaccacctgattaaacattactacctccgaattaaaggtacatcagatatgatcaaatgatcaatcattgatcctttcttttcttatcttctccttttcatttctgatatctcctctgcactcagcaaacccccttcgctaagaaaacaaagctgaagacgatttagtctcaagtccaccttttctaagtctctgaatatggtgtgggggtctctctttgcactgaacctgatttctcaattcttagttagcacttgggcaggctcagtcaggtgacccgttccttggcaagatcgtgacacatctgattgaagaatctgaatcgcctaaagaaaaagtaacgctatagtactgatagcatcatcatcactgaattaattactggtagcatcaccatgtctgtcctcattctaccagtctacgatacgaacaacgaacaactattaaaccacttgtcaagttggaaacttggaatgaagtgtactgctctgaaaattacaattggctcactctgctgattccaccgaggcgtgaaggttaatccagacacaaagcaggaagcagccatttcgtcaggtttgagtgtttgaccaatagaaggcagatacttgtgccgcctcatggacgtccgggacacgggacaccgaattacttgggtctctgatgctgtgatgcagcacactcgccggctgttcgtagtaggatcagacaggtgactgaagaagatgagctgcttttttcgtagctttcaagccgagctaatctgttcccccatcctgccaccggaaatggcagcagattggtggggaggccctttccgtagtagagggtccgacgcgcatcgcagccgtcgcctcctcctcctccatcctcatctcttatcttttagcaaaggaagacgccactttggaaggaaaagaaggaaaagctgcaccggtggagtcaaccagaactatctatccgtggtgcttttctcctttgtgaagggtgaatttgttcgtgtgctactgtgtctgggttaagattttattctaatgtgatcctgtagagtattttcaagataagaggacattttggaacttgcataatcatgaatcaataaatggctcgaattgtcagtaagaaaagagaattaattttcaaaatggtagaactagattgacgaaattttctacaagtaactcgttaaccgggctagtgtaaacaagtttaggtgcatgtgttgcattgctggtagtaaaggtattaacatgtttcagtgtatgacacttcatttttgtaagtggtggtgattgtgaatatagggtagatgttgtcagggaaacagaagatcatctcaaccatattcaaatgctttttagcttttggtcaatcagccattccactacccttcgcatatgatggttagtttgtagccatgtgtatagtactgaaaaaaaagtcacattcagcatctgattttgtaggacaaaatggtaggccatacataccgaacccccgcagcacagtgaccaggatgtctctcttgaccaaaatttctttggcatttttctatagaaaatgataaagagcgagtacatatgcgataaacaaagtgcacggccttgtagaacaacgaacctgagctgttcattcgtgcagactactttccccccttttttaccttctgaactgatatttacagatgctgtaaattatggtatctgttctgaacttttgatagcagcatgttagtactaacttcgtattaccgtaaaaaaaaggatagtagggtttttttttaagtatgtgagcgatgcggctctgaattctgaaacgctctcggctaaagaggaacagatcccattccacaacggaagatggggagcaggaatggactcgagatgcgctgctgaaacatacagcatatttattctatatttgtctgcacaaggatggaatacggaggaacaagatgcacattcttcggccggctgaagtgacctgactgcgaacctaccggtggttgatctcagaagaaatgtcagcgtgagattatagccaaaattctttgaagcatcacaagacaggaagatcttggggtccattacatctttgcgataaggtttgcccaaaaaatagaggaggggtttgcctcttaacatcagatccatgatctgaagagagaccattccaagaaacgttcagtagctgggcctgatcatctatgtctggtgagacactgatgcagcagggcaagaaaaaaatcctggtgcgatttctgcagagcgggtcgccgtctggcaattatatcggcacctttctcggcagctcgttcgccaacgacacttgcgcgtaatgaagtgtgcagagacttcgtttcgtcatttgctccccctcggacggttggacaccaagcattcgccatttcactttcggttggtgtcgtcttcaccgatcgatcgattatttctctgtctctctctcgagaagacacggtaggctgcacacggcacctaacacaggcaatcgatcgccctagctttgctatcctatactgcaagaactaggacgacacttgcaaagttgcttcttcctctttgtttttttttctctctcaaagttgcaaacggaagaagaaaatgagaagactggtgcaggacaccgtaccgtaactgcaggctgatccgtataaatatagttacatgcacactccagccgtttcaaaataaataaggcccctttgattcaaaggaaaatcatagaaattttagaggattttatttctatagaaattttttctacaaagccttttgaatcaaaggaatgaatcctatggaatcctatgaaattcctatgtaatgcctctttccatacaagttttggagaaattttaggccccctttgattcaaaggaaattcataggaattttagaggatttcattcctatagtaatttttcctacaaagccctttgaatcaaaggaatgagccctatgaaatcctattgagggcccctttgaatcaaaggaattatataggaatttcataggattcaaatcctataggaaatttccctattttgccctttaattcaaaggattgaagctttccaaatcctatgaaattcctacggaatggcacattgcatgtggattttggaggaaatttagcaagagctccaacctcttggaaaatttcctttaagtctatctctctcatccgattcctgcgttttttctgcgctccaatcaaacgaccattcctgtgtttttcctgtgttttgcaatcctctgttttacacttcaattcctgtcagaatcctgtgtttttcctattcctccgttttttcatccatgtgattcaaaggggccctaattctaatatgtaagtgacataaaaatattcatcctaaataaacatattcatgttcatatgcaaagtaacgtattcatctagattcctatactggaatgtatcatgttctatattagtgttttattttgggaggaaggatgtacctatatatctgcagaacgacagtgcacgtacgtgcgatgcatagacgtacctcagtaggagtacgtactaggagtagattggaaaagaagcgaagcaagacgtggcttgcttggagatgacgcggatctctccgccttttgatgagcgcgcctccgccgccgcaaccgccggactcgcgcacggccgcacccactagtccacgccttcttccacttccgtcttcccagtggcacgtccccgtaataatccccagtttccggcccaactacgtcaaaaacagtttccagcttctcctcttccactgtctctccttcccaaatcctcctccctccctccttcccactcaaaaaaaaaaaaaaaaacccgcatcctctcctcctctccaactccaatccccaccacctcgcgtcacgccgatcacctcctcctccccttccggtggatccccgcggcggtttcgacaagtcccgcgtcgccgtccggtgtggagcgccgtcgcggccggtggcctgtaaggtgcggtgttgttgctggtgagaggttactgggttttgccgcgagcgaggtgcgtagccgctcgcctgcgtttcgcgcgctgggtcttatcactttggaggcttctagaaggttctagccttctccgagttatcgcgccgattgctcgcccattgtccttttgggcgaggaactaatgaaatcctccttttgatcaccttcttacagaaggtttctggagttttctggaaactgcgctgtgatgcccccgcgactgcgagaaagtgtctccaagtttgtgacacaggcgtgattctgcttgtaggctggggttttgcattttggagccgcggtggtctcggcggaaggtaatcgtctccacctctgcttccacctcgttgttctagaaggttctagtagcatagcacttcatgttttgacttgtgtggggacgaacgctgtttaaaagtatcttactgtctcttgtgcggttaggttcctaagctctgcatgttcgtattctgaactttctgaaattttggaaattccaggcatgggctaggcccccagcacggtttccaggtgattgattggtggatagaattgttgcctgagagcagcaaggtagtgctaacatctctgccttctagaagctcctaccactttctagattcgtctcgatactcaacttaccttcagttcgtgtgcgcaggtttgggcgtggtgactggaagcaatcacgatgacgtcattgtcacgaactctatcccggggagggccaatgcagccaccggggcagcggcgcatcctcagaacgcagacagcggtaaacctgggcgagcaaatctttgacagtgaggtggtgccatcatcgcttgttgagatcgcgcccatcctccgtgttgccaatgaggtcgaggcgtccaatccccgggttgcatacctctgtaagctaccccaacctgctcctcccagtgatttcgctgttgtgagattgcacatgaatcaacacctccagctatcttctgcatttccactatacaaagaccatattttggcatactgctaactggactgtcacaatgtcacctagtgtgaaagcttgctaatgttttgttttaaaaatttgaatgcacaaacgaacatctctcttgcctaattgcgccttggtgatggaaatgctttatgctatcattatcttagacttctttcttggataagaattttggggggacccctatctcgacacttccacaatacgtacaaagaagttagctacagaaaaacactggcgtcttggtgatccacttacaaacattgttcactcattgcttattaccataaaaaaagaatactaatcttattctgcttcacaatgtgtttgatcacattaatttgtatgtctgtaataatggataggtcgattctatgcatttgaaaaggctcacaggttagatccaacttcaagtggccggggtgtccggcaattcaagacggctcttttgcaacggcttgaaagggtatgcatttcaagtacttctagctctagtcagttgtttgcatccatttttgttttatcctacaactgtcctgtgatggcgccattgactgcttgcctctgcttatatcctttcctctacctttttcctttacacatagccccttagccagtgctatgtttcaacatttttatgcatgctaataattgcaacatttacatgatcgtgtaaatgaatctttcattgtgctcattaagagttatatcttatatcatcataggaggttagtcttagcttctaaaaaaatatgtagttaattttgtccagaaaatgttgaaagattttaggtgaccacccaatgcctcgtatgaattaaaaacccaaccatgtcacagggatatatatctcaaattctcaatagc

SEQ ID NO: 69494 - DNA, 2496 bp, Oryza sativa
accttaatcatcattcatgttcatatggatattacttatctaccaagtagtagtatttaccaatcagatcatctgttttactatctttagatcttggaagccgctgataaagttaaagagaagacaaagatatatctccctttcaatatactccctcttgatccagacagtggcaatcaagcagtcatgaaatttcctgaggtttcttttatattacgattctattgagttgacttaatgctatcaaagtgaaggactttctgatactttctcactttcaagatccaagctgccgctgttgctcttcgcaatactagaggtcttccatggcccaaaacttatgaacacaaggttaacgaagacctcttggactggctacaatctatgtttggttttcaggaaaggcaatccacactttgtttgaatatttttcgttgcttatttgttcttcataactatgattctgactcttaacctacccattatctggggttttgatgtctcatcgacttcttgacatacagacagacaatgtttccaatcagcgtgagcatctgattttacttcttgctaacgtacacatacgacgaaatccaaagactgatccacaatcaaaggttctgttcttccctgaaaatattcaaaccctgagcctgaacagattaaaaatcttactttctttccttcatatgtttacataaacattttttatcccttttgatattcccttttattttctctgaagcctgagttatcagcaattttcgttgcagttggatgataacgcgctgaatgaagtgatgaaaaagttgtttaagaactacaaaaagtggtgcaaataccttgatcgcaagagtagcctttggtgactacctcagaatctcttcattgttatcttactgttcttttgtacttggttctttcttcttattgcttttgaaaaatatctgtttggactttggagttagtgctttgtgtttcattaccttacctctgcttgatggactgaatgttcataagaagcaaccaaaataatgtagaaagcccacacaaatctctgtgctctgcagttgcaaaaggtaaaacaatttgaaagatattaaaggtgaaggtggaaatttgtaaatataatttaaaaggggtagtgcaatcagtactccataacatccgacaccggttatatatgtaattcctggtctgtgagcctattagttcaaagcatatgttgtcaccctaccaattgaaggcaatatctctcatcttctcctttccttcgcgtcccttgctggtgtcgtaagtctgcacccatgtttacattaaacacacagagtaaggtgagccttagatggaataaacagaagaatttatggccatgataccatagtatttatacaatcagcatggtttgaactttgtagggttgtagttctcataatttgtaacctataaacagacccagaagggtggtagtgggcaaacttttagatggaaagaagcaggcacctaatgcattagtgttaaaaaaaagaagacaaggattgctatatgttgccgaaggccttccattgtggttcaaggttttagaatgaccttgagtatggctggtttggcatcctctcctagttttagggtaccaggagttttaactattataacatgtgttgagggacatatctagtgcaaactaaaactccaaaagcaataggtgtatggaaatctaagggctctcattaaattgaacggtccattgttgcaatctgcctctatcaactggaaaagttactcatagtgagccaagtcatatctatgtcaaatcaaagcaatcaagttttttaacatcaacttccctcgtgtttcaaaatatgtatgtgcaataattataaaaggtgataaatcatctttgaaaagtttcacgcaaaatggaccaaattcccaagttagggaataagtactgttttttcctcatcaaaaaggagaaaaaaaagctgatgccttacattttctgaacacttacagtctctgagcttccattatctttcttaatgacaggttgccaacaattcagcaggaggtgcaacaacgtaaactgctttatatgggtctgtaccttcttatctggggtgaagctgcaaatttgcgatttatgccggaatgcatttgctacatataccatcatgtatggtgtgaataaaaatctttctgcatcttaaattctccttttacttaaatttatatctctaattctttattttagttgccggattcactttatgaatatatttctcttcagtaggccattgattggatcatgtaggataacgactttatttatagcttttgatgatgcatttgctcgttctcttcatctgccttaaggactgccatggagtactgccctgcaacaaccatatatttcatgatgaataaaacaaacaatgaattattttctgtgaatggatgcgcggagtatgccatgaactgatttggttatgtgca

SEQ ID NO: 69495 - DNA, 1711 bp, Oryza sativa
  unsure (1)..(1711): unsure at all n locations
ataacactaacaataatttaagcaatacattatgctgtaaaatttattatacatggggttattagattaatagtcatcaggtattaatgtgtgatttatgtttcaattgtaaaatgttttccgggtaaactctagtaaaaaagatgttgaccatcttcttattgcctaccctgtttcacattttattgataccattgatcatatgaacatctagaaagaatgtggaagtggctacatgttgatgtacggtaacaattatgaacactgcagttacacaaaccctgtatcataagataactcaattatgatgtttatcttctatatgattcactcctttcaactcagctgttgtgacatctcattttgctaaaatcgaattaaaaatttatgttgtttcagtctaagagatcacacaactcataatttacagttactctctccgcccacaaatataaacatttctaggttgtctagcagaggttaaagttgaggagaaaagactttggtgcccctcactaaatgagggatggatgggaatggaagggtcgttaggggtaatatgggaataattttgaacgagaggcgattgatgggacaagtagtactctagacatccttatatttgtggacaaatttcaacgtnntgnaatgctatattgnntgaatagaggaagtatttttctgtaattgttgtttcatgaatgatcaatcttcacaaggtgttaaggacagtagctaaaattgctaattgtatgcctgagcaacatcagtttaagtaaattcctttatgtaaatgaggatgcaatcattcatattgagcaaaatttatactaatctacagttcaactctacgacctgttctatcaagatactatagttgatcctatggagagtctaattttgcaaccatatcaaccaatattcgtggagttcatttattgtgttagtataagtttttttttccttcgaagaatgttttagctcagaatttttcttctactgtgcccacaacaatgtttgtgttggactttgatagcttattgaggtgctgacaactctagcacttacaactctatagatggcatttgaaatgtatggtatgctagttggaaatgtgagtgccttgacgggtgaatatgtgaagccagcctatgggggtgagaaagaagcctttctgaagaaagttgttactccaatttacctcaccattgcaaaggtatatcttgttctcagctatcattccattattcaatatatgttttacactactttgctaaaattagtattttgctatcattcctcaggaagctgaaaggagcaaaagagaaaaaggaaatcattctgagtggagaaactacgatgatctaaatgaatatttctggtattagtttatcttacacctttgtacccctgttgcctatattttacattctttaaattgcaggtctgctgagtgctttcggttaggttggcctatgcgtgcggatgctgatttcttttgtcaacatttaaattcacctgatcaaagaaatgaagtgagcccactttagttattacttcagtatcatgtcttcttttttcgggtgtttgaaacaatagtagtgtaattgcctttttgcagaccacaagaactgaaaagcagaaaggaaaggtcaactttgttgagctacgctccttttggcacatattcaggagtttcgatagaatgtgg

SEQ ID NO: 69496 - DNA, 1575 bp, Oryza sativa
gagagaagactaggccggaagttcaatttcctgtgagtacacatgctctatattttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatctatatacatatgcattaatttgcataacatatatatgtgtataaatacatatatattatgcatgtatatacatataatataatataatatatatatatatatacatatatatatatatgtatgcatatatatgtattgaaacatatatatgcatggtttatatatatatatatatatataaactatatatatatataaaccatgcagcaacagggccatgcaaaaaaaaaaatggtcagctcgatctttactcccggatatttcacccgggactaaagatagcgatctttagtcccggattggtactcccggtttggaaaccgggactaaaggggggttacgaaccgggactacaaagggtttctccaccagtggggattcctccatgcttgcaattcaactaatttaagcattgtgttggagaaagcccaacaaatcaatgccacaggtcttggtgttaaggatgaggggtatgcatgttaaaatggttgggagctatgatcatcacaaggtatgaagtggtaatttgactcccctccttgcccaatgacgaggacaggatttgaacccaggtcagtgttaaggatttgcatatacttaccattgcacaacagttagttttttttttctcttactcttgcctaatactccctccgtattttaatgtatgacgccgttgacttttcgactaacgtttgaccattcgtattattcaaaattttcgtataaatatgaaaacatttatatcatggttaaataacatttgatgatgaatctagtcacaataaaataaatgacaattgcataaatttttttaataagatgaatggtcaaatgttggataaaaagtcaacagcgtcatacattaaaatatggaggtagtatcattttaatttcttctgccatagggtcgcgaagacccttgatgcttggatgttgggcgccaatgctaaggcctatggcaatgagg

SEQ ID NO: 69497 - DNA, 799 bp, Oryza sativa
ctgttgggcgtttacgacttcaccgccggcctgcctccgtcgccgcgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctgttatgccgccgctgttgggcgtctacgacttcaccgccggcctgcctccgtcgccgccgagtggtgcctccgcctacacggctggcctgttatgccgccgctgttgggcgtctacgacttcaccgccggcctgcctccgtcgccgccgagtggtgcctccgcctacacggctggcctgttatgccgccgctgttgggcgtctacgacttcaccgccggcccgcctccgtcgccgccgagtggtgcctccgcctacacggctggcctgttatgccgccgctgttgggcgtctacgacttcaccgccggcccgcctccgtcgccgccgagtggtccctccgcctacacggctggcctattatgccgccgctgttgggcgtctacgacttcaccgccggcccgcctccgtcgccgccgagtggtacctccgcctacacggctggcctattatgccgccgctgttgggcgtctacgacttcaccgccggcgtgcctccgtcgccgccgagtggaactccgcctacacggctggccattatgccgccgc

SEQ ID NO: 69498 - DNA, 13846 bp, Oryza sativa
cgacgcggcaagggcctcatcgaggcccgactgcgagaggacggccacggcgcctgatgtctgctaggctttcctcgccagcagcacgatgctgtcctgggcgaggtcgacgcggtcgttggagagcaaggtcgtgagggctaacacggcgcccgcggcgatggccgtgctctggttggccgcgctctggagcagcccgtacaggatgaccatggcgttcttctggctgtgggtgtgcgccgtcccagatgagctggaccagcgtcttgatcgcctccaggatgcgtccgagttattcgatgagaggtagaagaggatggccaccgcgttgtgctgctccttggccttggcaccgacgctgatcacgtcgatgacgaggccgacttctccgacctccacgatggtcatttggttcccattttttttaaaatagtaattaataacccaaaaattaaatgatagtaaatcaaaggtttaatttactcttataaaaataaggacgctatgtacaacagtgtccatggacgttgttcccgagaacgtcaacagtgtacgtccagatcaggacgctgtttgtaatggcgtccatcccattggagccgaaccagcctacggtagggaagcctccactcgcgtcgcgtctcgctgattcttgtcgggtcgtcgtcctcaacgctgctcgccaaggaaggcctccgctgcgtctcgctcggttagcataagcgccctaagccgtcaggttaatacttcatatccgatcctgccgtccgatatgattcgacctatgcatcctaattttttagcgcacttcttcaaattaaatggccagctcgatcctgcaaatggcttctcttttttttccctaacgaatcgcagatggctactcttggttcgatactaataagaaatacaaatttgtacgtacatgtgtgcctgcaacgagctgcttcgtttatttatccagaatgtcctattgattgctccgtaaaagctagaagacctggttaataatgtactcaatgttagagcaaacagatcaaggatgcaagtaacgctaatgcatgctgcagtgctgcacataacggagaattgggaacccaaaagttgaaaacagcgtccccttccggacgttctcaagaacagcgtccacgtctggacgctctggtagatagcgtcgttcttacttttataaatccagccagcgatttactaattatttaatttataggatattaggccccctttgattcaaaggaaattcataggaattttagaggatttcattcctatagaaatttttcctacaaagccctttgaatcaaaggaatgaatcctatggaatcctatgaaattcctatggaatgcctcttcccatacaagttttgaaggaattttaacaagaggtagaacctcatggaagaaattctttgattctttatctctcctcaaattcctgtgttttttctatggtccaatcaaacggtcattcctatgtttttcatgtgttttgcaatcctctgttttacacttacatttctgtcagaatcctatgtttttcctattcctctgttttttttaattactatacataaaaaaaatcagtatttggttcattccctcactttgccataccatgctttagctagtcatgtcactgtttcttatgtgtgtgtttgtttcgttgccacaattgtatcctgcaatactttcttagccttaggtccaacatgtcatacttccagttttagagctaactatgccacacctatggccaactattttctacccacacacttttgcttcatgccacaatatgcctaactatgccacaatactcccagttgtggcatcattaggcatcatccaaacatcccctcatccttccaaattactagggtcgttcactgcacttgacttgttctaataccttggaatgccatacagtagatacctttagttttggacttggaggcattgtgaacacaggagtagctcttcctctttcaagcagtagttggtactactacacaagtcgcacagggcactggtggagaaaccatctttcgtcggtcggccgatttccacagtagtcccggatgcaataaaaaccggggctaaagatgttctttagtcccggttcaaaagggcaacgggcatatttgatctttagtcccggtttgtgttaccaaccgggactaaagatgatctttagtcccggttcgaatgctgtcagggtctgtcaggccctcccggtatctttagtcccggttgataacaccaaccgggactaaagatggtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgtacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtcgaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttgttcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccgtggggaaacaaattgcccgagacaacgtacgaggttaagaagatagtctgcccgttaggactggaagttcataagattcacgcatgtccgaacgattgtatcctatatcgcggtgaggagtatgaagacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaggatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggaggaaacagaaagtacgtatcttaagcactgtaggaaggttgtatacatgggtcatcgtcgattctttgcagcaaaccacccggtacggaagaaaggcaagcacttcgaacataaggccgaccaccgtacgaagcctaaacatcgcagcgggaaaacagtgtttgctatggttaaagatcttaaagtagtgtttggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagagtcatgactgtcacgtgttgatgacacaactgctaccagttgtaataaggggtatccttccagacaatgtccgggcaacaataacaaagcaatgtgcattcatgaacgcaatttcgcataaggtcatcgatccggatagattagatgcccttcagaatgaagtggtgcaatgtctcgtcagttttgagttgatatttccaccttcatttttcaatataatgacgcatctgctttgtcaccttgtgaaagagatccgtattctcggtcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaattatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttatctgcgaggggaccgtctgggtcgatcgcgactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgcccctagagggggctccctgcccgccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatacatatatgttatcccctattactagtcggataaccatgccgtgtggatacggggtacccataatctccacagtagcccctgaaaccttcacagtcgaaaatataatcttctctcgaactagattactccaaagccgagtgcttcaatcatcttcgccatggtctcccgagtacttttaccaaatctgaagactgtggagggctgaaaaataaagtcaggtatatcgaatagatgcacctaataggtgtagcccccgactatgtggttaattgaaccaaccaaacatatagtcaaggaataaataatctaaccaaccgagtggttttgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaagaagcttgtatgttgtgaataaagaaatttccaaagtattgggcatacgccatgcgcacactgctttaacagacgtgctttagtccctaaaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcagtgatattatatccaatcaattgcttaaaaacccaaacagcaccttgatttatataaaaaaagtcagcgggacagctatataaagctttactgtttgacaccttttaagatgcattataccaactcctaaaaagttaagtaactgtggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaatagatcttccaggtattatagaccaaatgtagctcatatgaatagcttctgatctgaatgattatcccttctgggatactccaaaatagatgtaacaattgaatcccgactggcgcaagtattcagttgataacccttacggggaataataaatagtccagtctttgagcatagaaaatagacccatgatcacgaattcatattgcatatatccagagcaagtccaaattgaaggtatgatacttgtgtttgagctaataagcccctgagcatatagcttgtccttctgtcgtagtcacaattgtccattgatggtagctgacgcatttggcatagagacaagacgaccaacatagagataatattgcccaccagaggtggcaaaaatattggtggtagtggagatagtgataccaatcaaaagtaatgaagtcgcatagtcatagaggcgaagaaaccagtcggcagcaaacaagttagccaacagtaaagatgaaggcgtccagcaacagcgacagaattgtgtagccatggtggtgaaataatcagtcggtgatagacgagccagcagtcggtgacgatgataacaagccgacaatgaagacgtagacgcacaccaacagcaatggcgaaatccactaatcatgaagatgaagaaaatagtcggcgacgacaaacgcaactgacatgatgaagatgacgatgtcggcgatccagtcaatagcagtgtcgcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtggcaataatccatcaaattaatgttataactgttgtagatgcttcacttggaggagagttgatgttgttgcccaactcgtctaaaccgaaatatttgaagttgttgaagtagaatgtctgctccgaatcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactatagcttcttgtcgtcgaatagttattgcttgattgaagatatgtgttgaagatgtccaagtagaaatccgaagataataaagatgaagtcgctccaccatgatgacaaagttatgttgccgtgatgaagtgaaccggtagtgaagacgcgcagttgtgaagataaaagcaccagttggcggcggcataaccagtcggcgacggaagacgatgatgtccatcagtagtggtagaatcatgcagccatggaagtgcagaaaccagtcggcagccatggcaaacgtaggcagcttgtgttgaagatactgatgcctattagtagtgacagcgatgtaaccagccgtgaagaagatagcatgagttggcgctataacaggccagccgtgcaggcggtgacaccagtcagcggcggatgcggcggccggtcggtgaagacgtagacgcccaacaacggcagcataataggccagccgtgcaggcggaaacaccagtcggcggcggacgaggcggccggtcggtgaagacgtagacgcccaacaacggcagcataataggctagccgtgcaggcggaaacaccagtcggcggcggacgaggcggccggtcggtgaagacatagacgcccaacaacggcggcataaaggccagccgtgcaggcggaaacaccagtcggcggcggacgaggcggccggtcggtgaagacgtagacgcccaacaacggcagcaaaataggccagccgtgcaggcggaaacaccagtcggcggcggacgaggcggccggtcggtgaagacgtagacgcccaacaacggcggcataaaggccagccgtgcaggcggaaacaccagtcggcggcggacgaggcggccggtcggtgaagacatagacgcccaacaacggcggcataaaggccagccgtgcaggcggaaacaccagtcggcggcggacgaggcggccggtcggtgaagacgtagacgcccaacaacggcagcaaaataagtcagccgtgcaggcggaagcaccagtcggcggcggacgaggcggccggtcggtgaagacgtagacgcccaacaacggcggcataataggccagccgtgcaggcggaaacaccagtcggcgacggtcgaagcgagccggtggtaatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactccttacgtttaaacactctgcccgactaatcatagccaccaagcactgggagtcggcctaagcacttcccaaacatgcatatgagtgacatgagttcgtcattaatggaacaaagtttcacggatcagagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccgttagcaaaccaaacggaaagcataggaagatagaactccgtaactcgataggtacttttgtactcagattatgtcacaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaacaccagtcggcaccagtggaaccaagctagtggtgtaggtgatgaagcccattaacagcggcggagtccgccaaccgtataggcaaaaacaccagtcagtggcggcagaggccagccggtcggcaaagacgtggacacccatgaacggtggtgtgaccaaccaaccgtataggcgaggacaccactcggcggcgacggaggcaggccggcggtgaagtcgtagacgcccaacagcggcggcataataggccagccgtgtaggcggaggcaccactcggcggcgacggaggcaggccggcggtgaagtagtagacgcccaacagcggcggcataataggccagccgtgtaggcggaggcaccactcggcggcgacggaggcacgccggcggtgaagtcgtagacgcccaacagcggcggcataataggccagccgtgtaggcggaggtaccactcggcggcgacggaggcaggccggcggtgaagtcgtagacgcccaacagcggcggcataataggccagccgtgtaggcggagttaccactcggcggcgacggaggcgggccggcggtgaagtcgtagacgcccaacagcggcggcataataggccagccgtgtaggcggagggaccactcggcggcgacggaggcgggccggcggtgaagtcgtagacgcccaacagcggcggcataacaggccagccgtgtaggcggaggcaccactcggcggcgacggaggcaggccggcggtgaagtcgtagacgcccaacagcggcggcataacaggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataattagtgatcaaataataattagtgatctgtgaattaattctaatttatataagaaaatttagaacgataaacctggtttgtgatccaattttgattcaaggcctgtcaatggatgaaccgtagcatgcagccgtgtagacatgtaatcgtcggtagcacatgcatggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccgacggtgatcttcgcatgatttcggcggcggctgcttgctgattgcttcaaatcatgccctggtgacgaaaccgacggaccaacagacatggcagcattgtagcgacggatttgatctcactgacagaggtaaaattgacgataacaagctggttgtagatcgattcgatcggtgattaatctcctggttgattgaccagatccagatagaatttttggcgacgaagaccctgcccttttgttgagaagatcacggccaaagatgccggcacaaagttccatcgcacttctcgacggaaaactcgacgcaacccctacctggcgcgccaactgtcgaaacatgatttcggcaataataaaagggggtagcgcacgagacctaaaagtggatggatgcggagacaaaggatttagataggttcaggccctctcaatgagaggtaataccctactcctgtttggggatttgaatccgccgagtgtgtattgatctgacgatcaggttgtctcatgcccctagagggggctccctgcccgccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatacatatatgttatcccctattactagtcggataaccatgccgtgtggatacggggtacccataatctccacagcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgatcttaacaaggttggatactcggacgaaccttttgtccttgccaatgatgtaaagcaagtctttttcgtgaaggacatgtctagcaaaggaaagaagggcagagggcctgatgagcctaagcgtcaagtggttctctcaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcatgcatatgctaattataattgactagaggatttttaaaagttttaaatcacgcaagtggcattttatatgttaattagagttttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggt

SEQ ID NO: 69499 - DNA, 15998 bp, Oryza sativa
aacgaacgtgaacgagcgaacgaacgtgaacgagtgaacgaacgaggatgaacgttaacgtgaaatgcaaaatatatatatatatatatatatatatatatatatatatatatatatacatatatattacttggcatttatcctaatacatctgtttgtatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatgtaagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatattagattactttatttgtaattagacttagtatataattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatataattattgactacggaagtggtgcgacaagtagcaattgactattgtagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaaggttgtgtatggttctaatgtacgacatttacagttagcatacatgacttagattgttaaaacataaatgtctcgtgacttagcagatgtttcttgtatgaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaatcctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtcttcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactccacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatgtatgttgattactaataaataatctctcacaacatgaaggtggtgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcacaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcaccgactcctcctcaggatcctgcaccgtctcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagccgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagataatcggagcgaggatcagggacacggacttcttgcaaggagatgacattctctggatcaatttcacacatatctacgaactataccagctggacgccgtcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcacaatgctcgaccaatatccacaagaaacagaggacaatctcgtccatctcctgaaggcccagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcaattggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatatatgtatgcatatatatgtattgaaacatatatatgcatggtttatatatatatatatatatatatttatatatatatatatatatatatatatatatatatatatatatatatatatatatatatatataaaccatgcagcaacagggccatgaaaaaaaaaaaaaggtcagctcgatctttagtcccggttatttcacccgggactaaagatagcgatctttagtcccggattggtactcccggtttggaaaccgggactaaatgggggttacgaaccgggactacaaagggtttctccaccagtgaagtctataagtggcatgaatatggtccgtcatctttggtccatttccttgatcagcaagctgcgcagtgtgatctgggttggcatgattttgcctgtttccatggatcccaagatcggcagtctttggacatttgggaggccatccttgggtgactattgaacgaatatatcagatccatggagctacaccattcccggtgcctcctagttctacgcaagttgttcaaacatggacatacagggcagggcctacaaaactaaaatgcatgatatttataggttaagagaagctgtgctccatctcacactgacaagcacttgtgttgagcctccaaattttcggccatttgtctatctcaagataattttctataattctggtgcagtgcactatttatcatttatcggtgccgtgcacttggatcgacaaaggacacgatataaatgataggtgatgtaattaagtagggtagcatgacaaaattatatacagcggcggagccacctccaaggcaggtctgctggccacccaaactccgctgctaccgtctccactacaacacccgacagcgcctatgaaaattagttggtcactaaaaaacgctattagtgaacctaactcaatggtgtcactggctccgccattgattatataggatctccgtgatctggtttgcctaaaaccggcacctatgaggcgttttccatgtaaatgagccttttgacgggataaaaattaagaactagcacctataactactcattggtgtcggtttaaaaaaaccggcaacaataattctaccaagtcataggtgccggttcatctaataaatttacacctatatatgtcatatatgtgtcggttcttgaagaaaggatcacctatggacttacatgtattttctatctatctttttcatatgaagacagatgaagatagactttatacaaatttttaaatcttgacgagatctaccactttgtagttgactactctttcattcgaggtgttttccatctcctaaaatgtgttgtaatttcttagatctatttagataaacgaaattttaaaaattataaatgtctgggatggcgacaaaatatactccctccggctccataattcttgacgttttgacaatgccgaggtactgttactttcctattttgtaatctgaacactgacctctatattcctttacactcacatccttttctattcatgtatttttccaagaatgctcacgatcgagcatccaacgcaacgctcccatcgaacacctccacaagaatcccagccatttatccaagatgtgatccgacggttgagttgcgggaaacacttggatgcgagtgtcccatatcctgacctcgatggctccacgcaggcaacaacaaccctctcctcgatgccagagtcactgcttctgcagccgccgccgccaaaagatcctccctcctccccactggctcccttctccctcctccacaatcatcttcatcccctctaatagactttaagggagctgcatggtggggagatccaacttgtcatcaaggtggcactgacgtgtcagcgtgctggtggcgagcaggggaaggcgaggaagtagaagaacaagagggttgatgtttggaggcttcgccgtggaagaggaggtggaggaggcatgtttatgaggaaatggcatttggtggatccagttgctggagtgaaggaagaagtatattcagccaatggagtaggggaagaagatgattgtaggttttgttgcaattatattgtttatttctgttgcatcttgttctgtttgtgtgtttcattcttttcttataatgttgcacatgatgtgcagtgtatttttttcttgatgctacacacaatagaacctgatgttgtcatcaatgatgttaaaggctgaaacatttttttgttgagctatgatacatatgaaacactttttgttgaaatattttttagtaagtcatgaaacatttaaaatatttttctatacggtgaaacactgtctgaacttttgattaggatcagacatctgatccctagtatttttcctatctgcatttttccatcctataatccgaacgattaatttttttttttggaaaattttttgctacaggacatcgtaacttcgcggtttagctttaggacaccgtacgaagtaacttttaggggaagacactctcaaaacttggatattttcttgtggacgccgcacctattaaaataataatttccgggtgaggaggagagagaaatcacgtgaaatatcaaaaatgtccttgggcccacgtgtcaacactcctatctctcttctctctccctctggcaccggcaatagggaacggcagcagcggcatcactccaaatctaaccggtgcaactccagcggcgtcaccctggacccagatgatggttgctgcccttgccctcatggcgagctccctaacgcgtgccgccgtccatcagctcagccacgaccatctccgcgccgccgcgacccttgctgcagtcggccgcctcgggacctcgtcgccgcacagctccaagctgcctttcaatagtccctatgtcctcccctctcctttaattgagccgtcatcgaccatagccatgtcatcgtcgccgtcccgaacccactgctgccaccggctatggtgctcgccgcctctagccaccctcggccacgccattgcctctagaaggtgagggagggccaactctagctgtccgggccttcggccgagccacccccttctctgcccttcaccggtgagctcgtgccaagccgtcgcgcacgctcaccgtctcatagagatgcggcgctggaaggaggggatagagggaagagagatagaagagctgacatgtgggccaagggcagttttgacatttcatgcaatttctctctcttcctcatctggacattattattttaatgatgcggtattcaccagcaaatatctaatttttgatagtgttttcccccaaaagtctattcgcgtagtgtcctaaactaaaactccgcgtcctaaaactaaaaccacaaagtcacgttgttagcaaaatttgcctctttttttttccacaaaatttgccgcaaactaaaactaggatgtatttggatggagggcttggataggatatggccacccaaattttggaggtgtttggatggtgggcaacactgggatatggccaccacctaaggaatatttcctctagatgctggctccgtgcatccggccgattcggccggacggggtggcccaggaccgcgtgaatcgtgcacccctcacctcctccccatccttttctccttttttttatgagagatttgataatttatcacttatttaagtgggttttgattatttgacatcctagtccactttcatatacttagatagtcctacatgtcatcctcacaagtactccctccgtattttaatgtatgacgccgttgattttttgacaaacatttgacctttcgtcttatttaaaaaatttatgtaattataatttattttattatgacttgatttatcatcaaatattctttaagcatgatgtaagtatttttatatttgcataaaaattttgaataagacggatggttaaacgttggtcaaaaagtcaacggtgttatacgttaaaatatgataacatggagagagtatcaattaaagcatttgggcaacggaaaaaaaggtgtcaaattatcaaaattttccttttttctcctctcttctcaccggttcaccagtgccaaaccctacctctcctccctcctctgtttcggcggcgcatcaggcggcgtggagggcggactggtaggcggtgccgggccgggggtggttcggcggagcgggtggcggcgccggggccgggcggcaggtgtcggcggcgcaggcggtgggtgtcggcggcgcgggcgctgtctcctggcggcgcgggcggcgactccaggcgaccccttcctcgtacccccgatctcggaaaagaggattataaggtaaaagcacacacaaatctaacaccactacagcgataaaccccccaaaccccaccaccacgccgccgccgccgccgccggagaagatgatggtgccgctggatccgtcatccaagcccacctcccagcgccgcatcgcggagggggacaccgtcgtggtgtacgagcgccacgacgccatgcgcgccgtcgccgtgcgcccgggggccgtgctccagaaccgattcggcgtcttccgccacgacgactggatcggccgccccttcggctgcaaggtccacagcgccgcctccgccggcggcggaggggctcgcgggggcaaggggaagggcggcgggttcgtccacctccttgcgcccacccctgagctgtggacgctcgtgctcagccaccggacgcagatcctctacctcgccgacatcagcctcgtcgtctcctacctcgagctcgtccccgggtgcctcgtactcgagtccggcaccgggagcggctccctcaccacctcgctcgcccgcgccgtcgccccgcacggccgcgtctgcaccttcgatttccacgaccaaagggccgcctccgcaaggtactaatttttttctcttatggactgtaatatttgtttttctgatggaagaatcgatcacctgataaaaatatttaggccgaattttggggagaaaaataaacagctgtgtctaatttatatatattatcttagcattctgcatacatttttttttcttatggactaatatttttcttatggaagaatcgatcacttatagaatatttaggccgaattttggggagaaaaataaacagatgtgactaatttatagatattatcttagcattctgcatacattttttttcttatggactaatatttttcttatggaagaatcgatcacttgatagaatatttaggccgaattttggggagaaaaataaaccactgtgactaatgtatagatacttatcttagcattctgcatagagaaggtagattggtgataattcacaagcaatattatcctttggtggtttccctgcctgatatgattgtcacaaatcagaatcacctgtgcacttttgcacacacattagcttggagttgtccaagctttttgatgtgagatcgttttctgttgtggtggtaatgcacgataaagtgatttgtgtggcaccacctagctggttgtatggagctattttgcagtaatgcacaataaaagtattttgtgtgatatgctgttatagaaaatgactttacagataggatagggccatagggatgatttctcaacttatgtctttgcagcacctgtaagatactaggatgatatgatcgacagggttcacccccttttcaactccacttgaagcataacactaatgtgaaatgcagattacactacagagaaaagtttacttggactaaaaattgttattgtcactcaacatggcacagcagatagagaacttatataacatgaaagagaagattttcagaaccgtgaatccatgattgtccaatacttctccatagacatatcattttgatggatattttcctttttgcaattgcgatttggtttccatttgtaaatagggaagattttgagaggaatgacctgaccagcataatcacagtcgcagttcgggacatacaaggacaagggttccctgaggaacacactggtgctgccgatgctgtgttcttggacttaccccagccttggcttgcaataccttctgcggggactatgctaaagcaagatggagttttatgctccttctcaccctgcattgagcaagtgcagcgggcttgcgaagctatgagatcatgtttcacaggttcaatgcatgctcagaatttttttctgtcagaaattgagggcgtattataactgtttttcatgattcatgggagcaaatgaccccattatactcatagattgattgtggtaccaatttgcacatctgggattgaaagtttgattattttgccttgtgttgctttggagtaattttgggagagaactttacatatttatttcgagttgtagcaaacttgtttagtttgtagtttgtaccttgatagctgtttggatgacagaccttaagttagctgcttcgacaaacagtatttaaagtttcttgtttgagtatgaaagttgtaaagattttgctacagcttacaatttgatgttttgtgggatccatttaacttaggagtcattttcatcaccattcaattttattagtgggtagtcttattcagacttataatttgatgatgcgactctagttctatcatattggagttacagaatggtgacatttagaccctgaaaaattatatcccattttgaatataaattatctacagttgactttactaaacactaaactatttctgaatacataaccatagatttgaaaatattgaccaataggtaatacaagtaaacattatcctgagttaacccacaaaagtgggggctgaacaaaagttctattttaacatttccgtgttataatgcagatattagaacctttgaaattcttcttcgcacctatgaagtacgagaaggtggtttgaagggtgccacaaccaatgaagagtctaatgcagtgcctcttgctcagaaaaaaagaaaacttcttgctgctgcagaaactttagatgttaagcagaattctagtgttatggttaggccttgtagcactgctagaggacacactggctacctgacatttgcgaggcttcgtgtgcatggaaactaaactgatcctccatacaggtgagtaggtatacaagagtagggatcaaaattatgtcctgtttaagacctataaattgatacaaactgccaatttatttctacctagccacacttttattactcttttagcgtagtgcttttgtgttgagttgtaactgtttgctcttgctctgtaacttgatagggaaacttgtggactcacaccttcataatagaaggaaattgagtgtgcaaccccatgttcaggtattctctcaagattgatttggagatgatcattctttttctgaaatactgttatggccatttgctgccattgctgatagtcaaccagggtcacctgtactgaactgcatttacctgtacgtcgagctgtgggccttgcatttgttgtaatggtgtagaagtatttcccagagttcctttttaggagtacttgaggaagtattgggaggagtacttgaggaggtattgggaggtataagatgccatacttcctgaaggacagtaaaaacgctcttgtttaacctggccaagtgggctgggcatgtttggatttcacgtttccatgcgttgccagaaaaggaattcaaatatctatcttttttaataaatgtgttttcacaggttgccgaaaaaaggtgtggtatgtttctgtttgattgattagcaccgcctaacctctttttcctaaaccatgtaatacagttaatttaagtcctattggatgaaacaaataaaccagagcggtgaatgtacgaatatacttagacaaagtcaaataagagacatgttgccattgcataagtttaggtgatatcgccatccaagtgattgagtagttgatatagatcacacctaaaattctaaaatagactagttatgccattagcctccatgcacaagccataaataacttgactagatggccagctaattgattagtaaactatttatataggactgttgttttaaaaaaaatacagattttgttgtagtacatggcgactttttgtttacttcctgaacatcttaaaagtgaatatttggaggaacacactcttaaaaaaacatgattattcgctactttccagtcgcataaacctagacgttaattatgatgttttagactaggttgaagttaaacttttataattttgattataaatgacttcaaaaatacttagtttaaaggcactagaacaacaaatatagttgtatatatatcatagaaaaacatagtcaaagatatatttccgagactgttattgtgcaacacgtcaaggataccatggacattaaaatatatatttatgattaaataggagagtgtattcttcctacatcaaaattcgcacaaaaagagaactctaagttgcagtgtttccctatcaagtatcaatcgcgagctgcataacttatatagtgataaggagaaaccgatggggatttaaaggcttgatgcgatgacgctcttgcaggagaaaccgatggctctcccgcgtgtctcgcgtgacgctataaacaaaccgaatatacaatgcgagcaacgcagctataaaagttggcgaacgacatgtagcatgcattccaagcagagccagaacagtgcgtgacaccgtaatgccgccggagaagcaggacgcaacgatggcgaggcgacagcgccacgccgtgatgatcccgtacccggcgcagggccacatcacgccgatgatgaagctggccaagctgctccacgcgcgtggcttccacgtcaccttcgtcaacaccgagttcaaccaccgccgcatgctcgcctcccggggcgccgccgcgctcgacggcggcgtgccggggttccgcttcgccgccatccccgacggcctcccgccgtccgacgccgacgccacccaggacatccccgcgctctgccgctccaccatgaccacctgcctcccccacgtcgtcgccctcctcgccgagctcaatgacccgacctccggtgtgccgccggtcacgtgcgtcgtggcggacgccatcatgtcgttcgcgtacgacgcggcgaggcggatcggcgtgccgtgcaccgcgctgtgcacgccgagcgcctgcggcttcgtggggtacagccactaccggcagctcgtggagcgcggcctcgtgccgctcaaggacgcggcgcagctcgccgacgggtacctcgacacggtggtggacggcgcgcgcggcatgtgcgacggcgtccagctgcgcgacttccccagcttcatccgcaccacggaccgcggcgacatcatgctcaacttcatcatgcgcgaggccgagcggctcaccctccccgacgccgtcatcctcaacaccttcgacgacctcgagcggccggcgctggacgccatgcgcgccatcctcccaccggtctacaccgtcgggccgctccacctccacgttcgccacgtcgtccccaagggcagcccgctggacacagccatcggctcgaacctctggaaggagcagggcggcctcctcgagtggctcgacggccggccgccgcgctccgtcgtgtacgtcaactacggcagcatcgccgtgatgacgaacgagcagctcctggagttcgcctggggcctcgcccacagcggctacccattcctctggaacgtgcgccccgacctcgtcaagggcgacgccgccgtgctgccgccggagttcctcgccgccgtggagggccgcggcatgctgacgacatggtgcccgcaggagcaggtgatcgagcaccccgcggtgggtgtgttcctgacgcactccgggtggaactcgacgctggagagcctcgccgcgggcgtgccgatgctgagctggccgttcttcgcggagcagcagacgaactgccggtacaagcgcacggagtggggcgtcgggatggagatcggcggcgaggtggagcggagcgacgtggccgccacgatacgggaggccatggagggggagaaagggcgggagatgcggcgtcgcgcggcggagtggaaggagatggccacgagggtgacgctgcccggtggaaccgcggatatcaacttgacaaggcttatcgacgaggtgctgctcagtggtgggaagaagcgtcaagctttggacgcccgtgactgaatctaaaagtttacgataatattgtgttggcatgtttatattgaaaaggttttcttaaaaattaatttgaatcgtatataatcttacaaaatagcagcagtccagacatccaatggtccacagtgaggaagcactagaagtgcgtggttatgtagctccattcactaggtttaaaatcgtattgtcgacaattcgacctattcatttatatttgttatttaatgaggtttatgggatttatctggatctatctttgtaagtgtgtaaagggacacacttacggccagcaagtatcactactagagaaactatctttcgtgggttgcctaaatacctcaatagccccgattcatcaaaaaaaaccgggactagaaatcatttttagtctcggtttaaaactaaatgatctttagtcccggttcattcattgtca

SEQ ID NO: 69500 - DNA, 2350 bp, Oryza sativa
cctacataagaaggtgtggtgaggtcctaattcagggaaaatacatgattatagtttgctgatcaattatgaatggatgcatggagccaaatctcacatggataagataagatgttaggtctaatgagaattggaggcaccttgcaaccaactgtcacattgaagatcagagtgatatcacagtgctgttgggcgagcagaggaacaaacttgcgtgcttgttccttgagattctttccctacacgactctctatgcgagatgttatttccacgcacatttctgaacaagctgcgcctatcttcttcacagcttctcacttctggatatcagctaccaatactgtccccctcctgttccacgtacatttggtttttcgcattagcttccagtttgttttaggcagaagattgaaacgcttgacctcgttaatcaatttgcaaatggaggaatcttgtgagaatttcatgggaattgaactaattcctatatgaactagctgcaaattttctgtgagccaaagagccttaaacaaagggcaagtgggtgtttgtatccaaatttattaatggcgtatagatttcagaaatttggtgtagtcaatcgatagatcaccaaatttgtatttgtatccaaattcattaatggttacacatgatataaggcaaaatttggttataccacaggtgaagaggccggttctggaaaataacactaaaggttctgtccacaggtgtccatcttctatgctaacagagttagctgagaaaaagaaaagaaaaaaaaccttcaggctacacctgctgctaccgttgacagagttctatataacgcggaatgcagaaaaaaggccttctgggtacttcggaatcggagaaatttttggagaattcaatccgaaatagtttaaaatgtaaacaaattttgaccaaatttgagttaattttagttaattcacagaaaatttaaaaaatctattgtggggattgaaattttaaaccgaaatatgaaaccttgcgattgacaacgataactatgacctcgagtcaacccgccgtttgaccgccacacatcttctgtgctagccagtagccactagctgccatcccttctacctccggatcagtcgaccccatcactgccgtgcccatgatattcgctcaaacagagccaattaatcaactgaactttgaagctgaaaattcagaattgtttgggagcacaaagggacataacaaacttatgagcaggcagaatgtgctcaatgggtgaaactcgacgttggagatcctctatgccggcttgcctgtgctcagctggccggtcctcttttgccaagctactaactacaagtaaaagtgcatgaaattggggtttcatatcctatactataatgactctaccattaatataagcactgacgtgtgggataataaaaaggtgaaaaccatataccagtgactataatggtgaggatcctcacccagagtgggttattgggatggagattggcagtgaggtttagcggtaggggcagcagatgcggtacaagcagcagaatggaaggagatgcatgtgcgggctatatatgcgacatgtgggtcccatagtgccacttgacctgacattcgtttttcgataatgtttatggatttaccattgatctatatatttaagatataaaggggcgcacttactagtgtggctgccatgtgagttcgtggtagtatgcgtacacgtcttttgtgtaatggaaaaagaaaatatggatcgcttgatgtggttgttggagtcatatatgactcaagccttcaaccagacatgttcagctataaataggatgcatcacttcgacacttactgtcgtatattgaggatcaatagtgtagaaaccaagcttagacaccatcaaaactctgagaaatgaaaaggaaatgtcatggtctgcataggagggtgaggttctactttaaaagaaaataaggcagtagtttgcccatcaattatatataaatgtatatactcggaaccatatctcaaacagatcacttaaaagactccaggccttgactgataagaattggaggcaccaggaactaaagttcagttcattgtgacattgggtgtcagaccacacaggtgttgggcaagcgaaggcataaaacaagagagtataagaacacaagttgggaatatatagtataaagcacaagttccagcactccgaattctcgaaccagtgtgttcagaaaagtgcataccaatgaccacaagggggtaggatgtagatcccattctaacgacatatcccatgaattgcatatactcccctacatgatgaagcattgaag

SEQ ID NO: 69501 - DNA, 10140 bp, Oryza sativa
ggtatgttcagactatttatacatagatgtggaaataagtgatggacatcgagttatgcagtgtagatgatttttttagtgtattaataatatataatttattttagtggtactaattcagtttcatttattaaaaaggcacatagctttaagacaataacaacaggggagtttatatatgaccacgacaaaatgatttttatttaaataagagagactacgatacattcccgtgtgaatgcgcgggctacattccttgttattatataaatttttaaataagatgagtacttatatggatcggatgtccaaaattcaatgccatactggagtagatcttgcgcccatgcatgaggacgatcccatcgatcgtatcacatcacatgataatgcactggaatcctattccatcactctaatgatcataattaatgcgctcttgatcaaaggcgaacagtaccgtggcaacgtcccctctttaagctgaactcattgctctgtacaattggccttcgaaattgcaaagtttaaaaaactgagcaatttcggacattggagtatcagaccactactcagtgaaatgcaggctgcggtacaaggagatttccaggagtatccgggatattatcataaacaaatatgttgctaaatactccctccgtactcgtaaaagaagtcgtttaggacagcgacacggtctccaaaacataactttgacttcttatttctataaaaatatttattgaaaagtgatatatgtatacttttatgaaagtatttttcaagaaaaatccattcatataacttttacattttaaacttaacaatttgagagttattcatgatttatatttccaaggtttgacttaaacattgtcctaaacgacttcctttacgagtacgcggggagtatttctataaacttagctaaagttaaaaggaggttgactaaggcagcgttcgagagggcgagagagtgagtttgtttgttttgttttccacgcgcacgtttcccaaactactaaacggtatattttttgcaaaaaatttctataggaaagttgctttaaaaaatcatattaatccatttttgaaatttaaaatagttaatacttaattaatcatgagttaatagctcacctcgtttgcgtatcttcccaatctcctcaatccccttctcctcaaacacaccctaagaaaataatcaaaattaacatcatttaatatgaaacgacgagggagtatataatataataataaattcgcgacgagggagtatataatataataataaattcgaaatgctaaatgtcattgtacaaaaatttaggggcaatattttacagattttagactgttggattggcgccaagattcgtgcccgcgctttttctcccccaaccccgacgagctctcactcttctccggtgccggcgatgcccccaactccgacaggggacatatatatggattaggatttggggttggattgttagagtaggagtggggatgtggcgggggaagaaggtagttccccaaggtttagagggatgggcgtgggcagcggtgggcggtaaggcaccaatggtggcactagagccatagggatggcaggaggcggtgggccaacgttagcggccgggcaaataacgagactggttagaaggcaacagccgatgatgccgtatctggcgaccgggagccaccagagacggggaagacggcgaaacaagggactcggcgacgttgccttgggaaagagagaggaggagggggagaaggccgaccaaggtgggagagggggctcatcggtgctgttgaccccttctgaccagctggagaggtagcggaggagcaggagacagagccgaaggttttgcgtgagcgcacgaaagcggcggcgatgggcgggattgaggaagacaaagagaaaaaaagatttgggtatatatgtttgcatgaatctcaaagcgatccaatggtatatatttgcaagatttaagagggtctcagtcaaaatccataatgactgtcctatgataaatttcggaagttattctcataaagctattttggtcatttaaacaaaattgtaaagtattaatgaaggctaatcggacggtgatggtaaattatagaagttaaacaaagccaattgcatatcgtagaacgtgataaagtcagtgatggatcatagatatatgataaactcaatagcatataatgtattctcacatctccagctttgtctccacatgataccatacgcatggcacacttgatacaatgagacgcccctactattcgggacaaaagtcacaaaactcgatgctctctccagtctcacctggtcccacgcgaaaaaccatgtggccacccatgtccatacataaaacaactccgccatgcgccccacgcgtgcatctcctgctataaaaacgaacatctccacagtacacgagtgctcattgccttccaagcacagcagctcatcactgagctgaccagagagagccggagatgggatcgacggcgacggcgaggcggcagcaccacgccgtgatggtgccgtacccggcgcagggccacgtcacgccgatgctgaagctggccaagctgctccacgcgcgcggcttccacgtcaccttcgtcaacaccgagttcaaccaccgccgcctcctcgccacccgtggcgccgccgcgctcgacggcgtcgtccccgggttccgcttcgccgccatccccgacggcctcccgccctccgaccccgacgccacccaggacatccccgcgctctgctactccaccatgaccacctgcctcccccacctcgacgcgctcctcgccacgatcaacgccgacgccgccgcggcgccgccggtgacgtgcgtcgtctgcgacggcgtcatgtcgttcgcgtacgacgcggcgaggcggatcggcgtgccgtgcgccgcgctgtggacggccagcgcgtgcgggctcatggggtaccgccactaccggcatctcgtggagcggggcctcgtgccgctcagggacgcggcgcagctcaccgacgggtacctcgacacggtggtcgacggcgcgcgcggcatgtgcgacggcgtccggctccgcgacctcccgagcttcatccgcaccacggaccgcggggacaccatgctcaacttcctcatgcgcgagtgcgagcgcctctccctccccgacgccatcatcgtcaacaccttcgacgacctcgagcgccaggcgctcgacgaaatgcccagggtcctcccgccgcccgtctacgccgtcggcccgctcctcctccaggtccgccgcgccgtccccgcgggctcccagctcgacgtcgccgtcggcgccaacctctggaaggagcagggcggccttctcgagtggctcgacggccggccgccgcgctccgtcgtgtacgtcaactacggcagcatcgccgtgatgacgaacgagcagctcctcgagttcgcctggggcctcgctcacagcggctacccgttcctctggaacgtgcgccccgacctcgtcaagggcgacgccgccatgctgccgccggagttcctcgccgccgtggagggccgcgggctgctgacgacgtggtgcccgcaggagcaggtgatcgaacaccctgcggtgggcgtgttcctgacgcactccgggtggaactcgacgctggagagcctcgccgcgggcgtgccgatgctgagctggccgttcttcgcggagcagcagacgaactgccggtacaagcggacggagtggggcgtcgggatggagatcggcggcgaggcgcggcgaggggaggtggcggcgctgatacgggaggccatggagggggagaagggggcggagatgcgacggcgcgcggcggggtggaaggaggcggcggcgagggcggcgcggccgggtgggcccgcggagtgtgggctggatcggctcatccacgaggtgctcctcgctggtgggaacaagggtggtcaaaggctaagctagctagccgtttgacgcacgtgactgtgggaattaataatgtgtggacatgtgtatttgaattccatgtgaaattcgaaatgattcgtcaaacaatttaatttatgtagaaattcctacgaaattgccttgttccaaaacatcgtgagctaggagctcgagaaatggatcttttttttttacaaacatagacgattaaaacacacgtacacttactccgacgaacgcatgtacgcacgctctactctaatagttagcacatttgaaagattttaacgatatatatttagattcacgaattccctataaacacatcggtatcaacgggcatgtcactttctactaaaggaataattagatgcatggttggaaatttcggactagacccctctgatacgatattatttcagccgaaaatttttattttttttaaatttttcgtgaattttggtaatatttgttcgaattcaactaaattttgttcaaaaatgtcggaaatttcggtgaggtccaatcaaattagctaaaccgaagtttaaccctgattagatgtaaatacgagcacacttaatataaaacacatgttactttcagtgacgaattcccactacaggatgatacacatttagaggcgagctaatcagcctcaaaatcccaaaaaatccgcctcagaatatgtattgaggccaacattcactgcctcggatactcctgcctcaaaatagtatattgagccaggcataagagttggcctctaaaaggtgtatttgaggctaaccatgtatgcctcagaatttgattgaggcataccgcatgcctcaatgctagggtacgctaccgaggctattactgctgcctcaaaacaaattgaggcaactgtaacctgcctcaatgtaggatgcatcaaattaattatatttcctagattattattgtgggaaatacacattttcatcatcatgaaaacatgaaaacttgacaattgaaacaataagaaattaaatagtatccaaatcacttcattcatatattagcagtacatccaatcatacatgtccaataaataatacatagcatctcatccgtcacttagactataacaacattctggtggtcttaatataggcattaaagtgaactaatatgtctgaactccaattcatatgtggcatttacaagtgttgagacaatcaactactcaaaagtgtagatatataattactgctcatgtttgagctatctcttctaagaagttctcgccaattttctatagttgaacatgatcgacaatcatcaccgtttgagagaaactcgagcacctggagtgtaaatatgtaaaattcagttaacacaaacaaacaatgtcactatctttatttaaataaagaacataaaatatgatcatgagcatggaaattgagtttactaccaaagaaaaattgacaaaacaatccaaagtatagcaggaactaattatacagagaaggaaatgctagagacctatgattaaacattttgaacagaagtacatttctatgtaaaatagactgcacctattgaggttttaaagtatatggcaatccaaattacaatagcatttctatcttttgcatacttatattttgctcaatgaaatttccagaataaaaatgatgtaaatactctatatatacccaacataaatggcacatatacctgtttttgtcacttccccattgcactgaggtgacacttcttcaacatttcaaattgatatttaccatgttagacttgctatgtaaactaagcaataaaacaaagaagccaagaaaggaacatactagttgggatggccatgcaatgcaatgaccaatagcgtctctaatatagttcaaatttctatgcggccggaacaattcagcatctccacatataagactgtctatcactactttgtagcactcccttcccagcattgttcctccgaccatttctaaggggtcttgactttgaatagtagctcttgcaacacggttatatggacgaacaattctcttaagaaagacatcccttccaacctatttcaaaatgtagccacatcagattttattacagagtagaaagtagaatagttgctactgttttgtagtaataaaaaagaactaaccacattttcacaagctaatgctgcccttttgaccttagcatgtttagttgttcccacattggccccttcaattttagtaggcttgttgttattgtacctggctatatgcttctgtaccccctgttacacaatagaagatgttactgttgtcaacctattagcatgcattaagcaacagaaatgcatggtggtaatatagtgcgttccaaataaataccatatatccatatacaaacttcagcagcattttgagtgatcacagttggaactttagagcgtttacttgtggcatgattgcttgttgtttctccacaacgttttttttgtcattcttggttgcttggtacaattgtgattgtccacatctttttctaccccctgttgtacattacatgtagcatcaacccttctcaatgaatcctacaagacttaagatatgttacagtttgacttgaaaaatgaagtaaaatcgatgttattcagctcaccttcgtaacatgcatattttgattaacttgcgattctctggcaactcctggttgcacctatattcaacaaaaaataaataagtctatactaattccaaataatactagtgcattgacttgaaaaatatgaagcaaagtcatcgttattcactcaccatcccatcatgtctgttatgattaagctgagattcttcaacaattcttggttgtacctgtattttaaaaaataattcttaatgccgcaaacaatactggtgcattgacttgagcaagataaagtaaagtcgaagttattgttagtgcatcgtactaagcacaactactatctgttcgagaagagcttgagcaggggacaaacaaagaagaataaagcaaccaactagctaggagaagaataaagcaacaagcaagctagatggctacctgcatttcattcaccaaaaatcatattttaaactaacatgcaccagcttctagactattctagaccatgttctaactttaggactattctagaagtacttcagacgaaggaaatgaattagtttccattagctcaccttcctagcatgtttgttcagactaagctgcaattctctagcaattcttggttgtatctgtattcaacaaaggaaaaaaaaaccattagatgaaactagactagcacattgagttgaaaaatatggagaaaagtaaatgtcattgaagttaccttcatagcaggcctcttctgatttagttgcaatgcttcaacaattcttggttgtatctaaaatcaaggaaaaaagatagaagtttatagttcctgaataataataccagtacaattgaggttatgcaaaatgaactatgatcttttatattgtttgaggcagatgagcatgagtgctcctcaattggcttgttcaaggaatgcctttgttcaggagaagtatgcttcatagctttaaattctgccattttctctgcaagtcgtctctccattcgttcttccattctttcttccagctgttgcatcccttcttttaaagcacatactttttgttccgctctatgtcttgcttctctctccaactataagcttgttctttctgttgatttagttcctggcaaaccaagacttaatataaaacacatgttactttcagtgacgaattcgatcctcgattcgttattatgccatttagttttatgacgtttggtaggaggattgtgttgcttagtgacaaaaatgagatgttcgtcattgagaccaaagacaaattgacatgaactaatccaatgatatatcatgacaaatgtttttctataagagaccaaccgggacaaatatttttttataagagaccaaccggcaaatgtcttaagttcatgattgaaagcaccatggcctgaatttgtaagctgtcaaaaattacttaatgtttttagaatttataataatgtgcaaaaatgaattaagtttaatgaagtaaacaggagaataaaaaattattaataaatcacggtgcgagttatttttcctaaattatccataaactaaaatactatatgaaattttagtggaattttcaaagctatattataattttagtaatacatgaattatttatgtaatttttggtgttcctacccttcgccctctctagtaggtttggtacttcctccgtttcacaatgtaaatcattgtagcattttccacattcatattgatgttaatgaatctagacatatatatctatctagattcattaacatcaatatgaatgtgagaaatactagaatgacttatattgtgaaacggagggagtaggtttttagtgttactacacatctagattgcagtgtagaccaacctgcatagtccaaacatcaaaattgagcacagttgaaattcagcgtcactaaaccaattttgccacagaacaagatactacatacagtaccacatggtgacaagaattgaacacaattccttcagcttagtcaagacgtccataagaggattgtgcataggtgagttctaggcaaaaggaactgaatctgagatatatacaggaatctatatgcagggcacatatttcataacttggattagtcggtcacaccatccagaacggctcttgcggttttaggcaaaatggaactgaaatatgaacaggcagaatagctccaagatggcatctatatagacagacactgcacagatttcgccatccagaactcagctctttcttggtccgtaaaatactgattacgaccatgttaagtagaggatcatcttcattaatttgatggacacctccagatgaacaaagaaaagatatatactgattcagagcgatgcaaccttgtaggctgttcctgtaatagaagaaaaaagtgttcagcgccatttagcgtgctaggtttaatgtctcttgtttacatgaatatgtgtaggtaagctatgaacatgtggaatcatatcataactgtctatgcgctgaaaatcgaataacttacatcgggtggaacgagtccacgatttataggcttgtgtgttgcaatttgcaactgaaggactgaggcttttctgcaaagaggttatgtgctgtggctgacgggagctgccctgtgtacaccgtgctaactttttcgggctcaaggtggcaattttcctagccgcttacgcgcacgagaagtgagccggtggtttcggtggaaatgcatccgatttcatttagcacggtattgtatttctcttggatgacgaaagaatggctgcttgcagctttgtgaacatcctggaatggctgtccaagacttccttcatcacttcggtcttctagcctggttgaatgagcagcgactcaaaattgaagaaactttttttttgcagtaggatttgacagaattgatgaacaaaaaaaggagcatcagcaacaaaagagtgtaatgggggaaggatccgaaacaaagcaacgatagtttgattaattgattgatatatatttgtggagatgtcaaaacaacaaggcagcaatacaaataagtcaactttagggttttagtatagtccctgaaaaccagaaaattgcaaatcaataatcaatttttggctgtctgaagaggctggtagtcataagatctgattttgaaggtcaggttaattttcagacttctgtgagaacgactatgaaagttcagaattggaaattcgacttcttcctgaccagaactgcatccaagcataggacatacggaaggtgcaaagtagatattttacatacatgtcgggggatgcatcggggttgtagtcttgctcctacaggatagcagctgaattataaaggagcaagtgaacacaaataattgcacaccacatgcccccatggacatacctcagcaatgaactcccatttttcatccttaagagattgccgtacaacatcaccatgatcatacacaatctgggtttcaaacaaaagaaagagaatatctaaatatgaagtcaag

SEQ ID NO: 69502 - DNA, 6749 bp, Oryza sativa
ggatgcgatgtttaacataaatttaatatatttgtaagcctcaagccccctaccccgttggatcctcatgcaaagaagaaaaagaagaaaaagatgccctccaccatttctggatttgcttcacatgatatttttttatacgtcgtactaatttatactattcttaaaaataatgtttaaattataccaatatattataaattaaacgacaacttaattacaaaaagtattatcaaacatacatactgtatctctgtgcctctgcaatctcgcaaagacgtggtatggaactagaaggaaactgcaacaacgcatggtttgaaatggttcttcacctttggcctttttcttaaaccagccagctcgccagttatttccaagcctgtggacagttcgtcgccaacgaccaacttgcagaaaatactcgagtaacaattaaacaattagaatgtttcaaagaggctagattactcccgatgcctcctaattctatgcaagttgtccagaaaagatgtacattaaaacctacaagttgcatgatattttccaggtcgagaattagctagtttgtgcgtagcgacatgcacttgatcattcgaattgctggtcttttgtgtatatatgtatgtgtctctctgtgtgtgagagagactgagcatctatatatctaccaattagcaaacatatttttcacattttgggagggagaaagtcgaaagcaacgaacagatagccaaactcaccatgcagcaagcagcaatgcctgattttttttatcaaggttattttttgttagaaatgccatatatgactttgctggtcgtatatacagaaataattcattgcatgccgttcagatagcctagcagttttgctgtagaccaaaagatggaataagctgtataaaaccacttttgtacttagtacgtatatcaagcaaggtgagcaaaataatgaattgaaagacatcttgtacgggtaaaaatcaggagagaactcactaactagggcaagttgtcaatagattcaagagtctctataacactgggtgatcttgttcgattgagcactcttaacagcaaagttgggtaactatccctctcggttaaggctgcgagacctctttatttcttgattgcctgcagcctgcgtgctgtctggatgtggtacgtagagccactatttggcgtagacggtcataatcatgtatgtactcatgtacatatcatgaaacaaatgtgtaggacaattcctgatgccgcctaatcatattagagtaatgtaactttaactttttaatttagggctgggattaatatcgcaagaacattatattctatctccataggttttagtagtacgagtttctctagaccttttttttgttttttttttgtttttgtcaatgaaagtgttccctgaattttggtgcaggtgttcatcggctccatatatataaaatgtttgctggctaaggaagatagaagtttcattaagtctatttatgtattgcagcaccaggtagatggagaaagtttaaataaggtagtatttccagataggtccgtatcataaaataagttgtgtgagaggaccataaaaagaccattttcatgactagaactatggtctacaaatgatagctagccttattaattatgtcttggcatttgtcccatgtgtagtctcgaatagcaagaactaaaccaaccagaggagtgaatggttgaagtacccaaaaactaaaacttttaccggaattaaaaattacccttaaatctgatgtagatagctctgatcggagttgacccgctggtctgatcgacacactttgatttttacaccatgtagtgtgatgagcgttcccaagagcatctgtgactggccattcttgacgttttctgtgatgatcagcgctcctagaaaatcaaagtggctatccatacgatgtttccttagaaaatgaatcttgttgcagaggcttaaaaagttcataaaaaactacatccatggacaagatgagatagctagctgtcacggttttaagtgtgtaggatatatgttacttcctccatgtttgaaatttacaacatgatacattttgcatttcaccggtgattcgtgtccaaataaataggacaatgcattatgatttagttcgtaagactctaagtatctaaccaacaatgtttgtaaaatttctgtataatgtttacaacaatagcaagatgcataaaatcaccgaggggcacctatgtgtcacctttgtccatggcagtgttttctagatccatatgttatgctcggccatttttccagtttatagagtatgattttagtcatccagagaattatgccagaattccatattacttccaatcctatactagctagttatgtccaaacaaataaagatggatacatcagaggatgccagtgtattggtttattagaaaattatagaggaatgtgtacattgcaaaaggccctccaacttgttaagaagctagccatttgtttatattcactctttgtatatttatatatatactgcatggtatttattctccaatatattatagagaagatctttatatgaactacgaaggctgcagcttcccgtaaattttaaaaaaaagtttcataaagatggatatacaaagaaggtgcatgtgtattgcatgacatgagcatttcattgcaagaacagagtatttcagagtacacaattcattcttgagatagaccagccatattaatcgtcttttctactttcagtattcacatcttaatctttttttgtttctcattttgtatattgaagttgaatataatttttggtgcagtggtgtctggtacatgttactatactctagattgtcaagttgtttagaattttgtcacaaccatttagattaaatttaagagtcaggattagaacactctcacaaagaacccatgaaaaggctatcgctgtctgacattgcttcgtgttataatccagccctatgttttgagtttgcagcaaaatataatttgcattctactggatatttatcaactcaatgccactagtaggtgcccttagttagagcatagcacatgtacattgtaaaaggcccttgaacttttgaagtgtttctttacactgcttgctgtttatataacagtacaacatagaaaattattcatatgccctggaaaggttgccacctgcctcaaattaatgacacattcaataaagctgtacacaaaaaaattacaggacacatttcgcaagaaaagagtggttaaaaggtgtggtttcgtagaaaccacgccttttaaccaatgatatctggaataacaaatgaactgcttaacctttcttggaaagcagaatttcatcaattgaatctaaatatcgagacattatgtgcagcataaaatttaataaatgtgtattactcgaagtgtattatcgtcaatccaaaaggaactcactctcctttcctaaacttatgatctttgtcatgccagttttcttatactgtgtcccctcattacccctttgtctctcccttgctgctaaaaataatgaagtcttgaagatatatgaattttggggaaataatggctgttgagatcaaattagctttggtagtaactatgatctctttctgtaaacaacaaggtaggtgctaagtcatcaggactaaaaatgttcagccaatgatcaatccaggggcattgctatcgctcctctattattacctgcagagactaacacggccaaacctgacacatttctctgtattgttgtcccttctttgcagttagactgcgaggtggctgcgtatcttgatagcctgatgtgagcctgctgcctggatgtaatacgtagagccactgtttggcaatgggtcaatttcttatatatatatgttgctacatccaaccttcctcaatggaggctcatcaggacagtagcaatgcgtcctagtaaattgctatgccatagctgccatgtaggcttgggaactctaaaagacactatacccacagtgcaagtgtggcaagtgtggtttaaaaaatttataacgggacctacagataatataaaaaatctcacccctcccacacccccccacccccacctaatcctctcacgtccccatgtccagggcggccatggcggcgtgctccggccagcgcggcggagctcggtggcaccggcggacgggtggagggacccatgcggcgatgagcaacagatccggcagcatccagcggtgcggccgaagacgccggcggcgccaagcggcgtggtggaagacggctgcgtcaacgacaccgtcgtcgacggtggaggcacagcaccgaagctgcgcggccgcggaccctgccaacgccattggcgcgcgaggtggggggcgagcttctggagctccgcccagaagacggcggcagcaccgagcggcggatctcgggaggcttcccgagccccacgcagcgacggcgagctccacctagaagatggcggcggcgccgagcggcggatctcgggtggcttccccgagcccaaggcagcgacggtgagatccccgagcgcctctactccggcgagcatccgacgagcaccacgcagcggcggcccctactttggtgagccccacgccccgagtgcccctactccagcgtgccttttttttttactccagcgtgcctcctttcttttgctttctcgtttctcgtggaggtgcccctttttttggacaaaagttgttgaggttcgtgtggccaaacttgatcacgcgaagctgggttgggaacggtccccactcccctctctactccacgcaagcgatttgcctacgtggctctacattgtcacacgccacgtctttgcattgtaaatggccttagcttgacccttgctgaggaaggatgatgagagaaacgtgtaggacattatttcctgatgcctcctaatcattattaaattatgttctaatctaaactttctcagagctgagattgatatgtcaagcagattctacgacaaaggatttcagtaggtactggtctctaaacttttgttgtctttttgtcagcaaggtgttggctgaattttggtgcaggcatgcatatgtatatatacagtctctctatgcatatatagggaacaacggatgttaatttaatgctatgacagtgtttagttccctttaaacttccaaaaatttcatcacatcaaatatttgaatatatatatagagcgtaatgtggatgaaaaaaaaaaaccaactgcatagtttacatgtaaattacgagacgaatcttttgagcctaattacgtcatgatttgataatgtggtgctacattaaacatttgctaatgatagattaattaggcttaatagattcatctcacagtttacgggtggaatctataatttgttttattattagtctatatttaatacttcaaatatgtatccgtatacgtcaaacaaattttgccaaagaacaaaacacggcctatctatattttgcagcatgaggtatatggggaaattttaaacaaggtagaatttcagacaactccgcatcctaagatgagttgtgtgagagaataatagaaatgccattttcataactacaactatagtgtacactgtacatatagtagacaaattaatttgggacaatttcgttgttgccccctactttgatgatgtctaatattgattttcgttcttacccctacttttttttaaatgaatcaaccgttttcctctgttctgttaattcttgctaatggtgttaaatgcggggtgtaaaaagataagtatacccttcaatactttcccgtacttttgacataatcagatctattgatgccatagcaataatttagtttgtcaaaattttgtaaaagttagctaaaatttgggttaaatttgaaagtggtgtacaaaagtaccggaaaatatctaagggtatacttgtccttttcacctcacatttaacaccgttagcaagaattaatgaaataggggcaaatggcttattcgtttaaaaaaaatagctatttggtcgtgcgttgcacgactttagaagcctttataaaaagcccaaaatatatacacactataagtatgataattactgtgtctactttaaatttgaacttttttgtaaaatcataggatcgacatgataaaaaaatagttaaatctagatgaacatatattttgaacgaaaagttcagacgttatattcaagatcaggcctctttgttttggttcctcaacaatgctcattctaaaattaaaatataatttcacaatgacttaaacatatatctatactggaaacagacatataaagcaaggccttgcgaattatcaaaaataattcatgcaagataaaatcttggaaaaattcatgaaagtactaatcaatataatcaaatcactgtaatttttacctaattttatatgtacatttgttacatcaaataaatcggtcaaagtagtcaaacagtggattagttataaaccttaatcagctaaaacctaccatcaccaaaatgtgcattacactgaatacaagtgtataatggaactaatttattcgaataccaggttaattataatgaataaatataatttttgtagaatttatttcctcagtttaaaccaactaaaaattcatctgcctccatccaccctattttagcatgcccacaaattaaactacagatt

SEQ ID NO: 69503 - DNA, 2019 bp, Oryza sativa
cctcgcctcattcatcacctcggcatcctcttcaaaatgccccaataagcgccaaggttggtagagcaagctaggagatcaattccattttccccaactctagccgccgagcaccaccgagatcaattccattttccccaactctagccgccgagcaccaccgccaaatcctccttctccggtgagtcaccatttgattccgtgcaggtgtcatccctagaacctcagtagcttcacgtgcccatccttttcatagttgggaagccggatgaagccattatcatcgtctggcctattcggctgccgccgggccattacacacattgtcaccaccatcagagccccgccagacctcgtgcacctaaaccgagccctagcaccacatgcaccgtgaccccgatcatggggaggaggcagcgatggtgatggggaagtggtttcgcggcggcgatggaagcgagaaggtcggcaggcggcgctggatgcgttctggtttctgggatgtggtggatgtatttttttctcttttttttattcacgtgctcactgattcttgtactccctccgtatcacaattagaagatgttttgcgtggccgtcgtactttcacgtttagatgatgttcctagccacacgtacaaaagccgacgaaattgcccctgcctcctcgatctcaaccccacgccggcgctgtattaacttcgcactcttcggttccaccacgcgcttttccctcgctcatccttcttattcaccacaaacgccaccgcccagaaacaccgctgccccagaaacaccgtcgcagaggaggagctcgcgccggactccatggacgcgccagagtcggagctcgtgccagactccttcacgctggagttgcaggagctcgcgccggactccatggacgcgccggagtcggagctcgtgctggactccttcacgccagatttgcaggagctcgcgccagattccgtggaagcgccggagtcagagctcgtgccggactcctttgcaccggagttgcaggagctcgcaccggaatcggagagtagccttggcttcatctagcaaagatggttcgcaagggagagaagttggcagccgatcttctctttctaatgtttctttttgcatgtgtggaatcttaaaattgttgcttcctttcaccttcatagcttccatcaaaacactttgtagtgttacaaacattcggtttgctttgtgtgccgaatactccatgaatgcctacaaaataagtgtgcaagaaatgagtcaatgagcaaatttgttgttgaagaatcaatgtaacatgtgtgaacaatttgatcaaattacctcttccactgttggaactagagcttctattgtttttgcattcttattgtattgaattgcttgaatagctcgaaaaaaatccaagtcaagaatgttgaaatccggagaatttggtgtttggcaaattaggcgaatatcaaatccttcttgcttagcatgctcacagaaatccgaatcatccaagtttagatgggaaggtgcattatcctgttgaatgaagattggtttgcccacatcttcttttggccatttggctcgaatagcgggcaagactttgttgatcatgaaatctctaatcacttctcttgtgatcgaagttatgggcttcaaaaccaagtctccacggacacggccggttctcacattgcctctcatagccggttgataagtaacaagtggaaaacaactaatcctaccatcaaaaatgcaattcccatccctaaaccttggccgagcacaaacacacaagaacatgagcctagggatgtaattcttgttcttacaagtccgatggggatcatcttgttcaggtagcaaataatatttttcagatttttgagagaggtagaaccatttttcatcaatgagcacaaagtcaaaaaaatccttaaaccttggaccaccatgcaaatccctcttaatcatgtcaacacacccttcaacctagacttatattagcttcag

SEQ ID NO: 69504 - DNA, 943 bp, Oryza sativa
ggtttttaatataagcacacatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtaccggaatcacgccatgaagggagactacggggaaagggaactctcggaaggaaagcaattatgacggtagacaacaatttattccgtaaagcccatttcactgttctgcaacactcttcattggtagctccttacatcgaggagcacttggctctagttcgcgccaggaacatcggtaagtccgatgtatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaa

SEQ ID NO: 69505 - DNA, 705 bp, Oryza sativa
gtcctcgccgccgcctccgcctctccgctgccgccgcatctctggggtgagagccgccgccgccagatctccctttatctctcgatctctccgatctcagctcgatctctctccgtctctctccgtcgccgccgccgccacgccacgccgccgccgccacggccccgcaacgccacgccgccgccgccgccgtcgccacgccaccgtcgccacgccgtcaccacgccgccgccgtcgccacgccgtcgccacgccgccgccgtcgccacgccgccgccgtcgccacggcgccaaccgccgccccgatgccgccacggccccgcaacgccacgccgccgccgccgccgtcgccacgccaccgtcgccacgccgtcaccacgccgccgccgtcgccacgccgccgtcgccacgccgtcgccacgccgccgccgtcgccacggcggcaaccgccgccccgatgccgccacaccgccattaacgaacgagaacgagaacgatcgaacgaacgagaagcgagaacgaacacgtcaacgtacgttgccgtgagaacgtgaacgagaacgagaacgatcgaacgaacgagagcgagaacgaacacgtcaatgtatgttgccgcgagaacgtgaacgagaacgagaacgatcgaacgaacgagagcgataacgagaacgatcgaacgaagacaagtgagaacgagggaacgaa

SEQ ID NO: 69506 - DNA, 1278 bp, Oryza sativa
cactccggggaagacgaagcagcagtggatgtcgaaagaaaatgagaaaaacagagggccttgatgaaaaaaaacaagtgtggccagtgtcacacacggtgcgcgtgagaaaaggcatggtgcgggccagctcagctgtgcacgtggcatgccacatcggcgcgaccgcggtcaaacggcattttggaccggcgatggtacatttagcaagtttagtggcctaattacacgatttgcaagttaatggacctggatgacatccacccgcaagtttaagggccgctactgtattttactcttagagaaactatctaggagtgacaaaagcatcagcttccgaatttaattctgccctttaatgttagatgttttttttaactaagcttctgtctattatatcaattccctatgtacatggattgacaacagcgacatggtatggttgattttttacagtgagacttactccggtccatcaaaaagtaccggtttagaaccctttgtagtcccggttttccaaccgggactacgaatccgggactaaagatcgctatctttagtcccggttcaaataaccaggactaaagatcaatctttagtcccggttgtaaaagggagaatcttaccaaccggaactaaagaggggaagcgacagttcctcgagatcttttttttattttattgttgatttgctaatggctagtgttaatccctgtattttctcccgaatcaaatgggatgcacatccccaaatcaacatcccaaatattaagttacttatacacacagatcaaatacatcacaaatcctacacacagatcaaatacatcacaaatcctaaaaaactacacacaaataaaatacatcacagattatacaaattatacatcatatctcagatccatgcgatgcaatgaatcacaaaatctaaaaaattatacatccagtgaaacacaaattacaaaaaaaaaaagaaaagcaaacgagccggcgcccggccgccgccggccgcatgctcgccgccaccgcccgccgcccgcctgcccgcgtgcgcccgccgccacgcacgcggccgcgccgccaccacccgccgcccgcctgcccgccgccgccggcctcatgcccgccgcctcctccccccgcgaggccgtgccaccgccgctcgctgccggccggctgatggaagacggagtagaggggaggaggaagggccggctgatgggagggaggagaggggaggaggagaagatgaaggggaggaggggaggaagagagggg

SEQ ID NO: 69507 - DNA, 930 bp, Oryza sativa
ctgctcctgagttgcagtgcatggtggattgtgctatcgcctggtgattaatttgacgttcacgtccttctctctccttggttctctctccttcatattagaatataatgatataaaatgttttagaggaatgagcctattgtaactgccctaaggactgcactcgtttctggctatccattttgatgatgaacgttcagatttgtttctacagtaataacatggacagaaaagctgaccaacggccagtctgtgttgtttgctccaaaaccacaaggtactatacgtactgtggcaatacattatgatttactcggtaacaactaagtatctaatcacaatgtgcgtgtaaaatttctcagtactgtttccaatcatagcttgcataggctgtgcgtcttggtgacaaatatgtgcaaccgttgtaaatagcagtgttaatttctagatcactaacattgtttggccattttataagtttcattggtttagctgcatttctagtgccccaaatagaccacagaacagcaataaaattcttcatatcattaattcctatggttacacgaaacccctcgcgagtgaggaggaatactccacccatattgaaagtactatcaactacattccaaacaataaagcaaatgggcatttgggaaacaaggattgatgtacaagaagatgaatacgtattgcatgacacgaatattttctagcaagtatagggcatttgtagcagagccttgagatgtttgacaacattcaatctgcctatatttcgtctttcgtaaagttggatatgcccgtactgcttgactcgtttgattgaaagaacagagtattgcttgctgctcctctggatccgccagtgtcgagagagagagagagaggaggaggaaattaaagccccgaccctagtcatctactcgg

SEQ ID NO: 69508 - DNA, 752 bp, Oryza sativa
tatgcatgtttgggaaggcttaggccgactcccagtgcttggtggctatgattagtcgggcagagtgtttaaacgtaaggagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacattaccaccggctcgcttcgaccgtcgccgactggtgtttccgcctacacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggcttgccttcgccgccgccgactggtgtttccgcctgtacggctggcctttatgccgccattgttgggcgtttacgtcttcaccgaccggcttgccttcgccgccgccgactggtgtttccgcctgcacggctggcctattatgccgccgttgttgggcgtctacgtcttcaccgaccggccgcctcgtccgccgccgactggtgcttccgcctgcacggctgacttattttgctgccggtgatgggcgtctacgtcttcaccgaccggccgc

SEQ ID NO: 69509 - DNA, 718 bp, Oryza sativa
ctacgtcttcaccgaccggccgcctcgtccgccgccgactggtgtgtccgcctgcacggctggcctattatgccgtcgttgttgggcgtctacatcttcaccgaccggccgcctcgtcggccgccgactggtgtctccgcctgcacggctggcctattatgccaccattgttgggcgtctacgtcttcaccgaccggccgcctcgtcagccgccgactggtgtttccgcctgcacggctggcctattatgtcaccgttgttgggcgtctacgtcttcaccgaccggccgcctcgtcagccgccgactggtgtttccgcctgcacggctggcctattatgccaccgttgttgggcgtctacgtcttcaccgaccggccgcctcgtccgccgccgactggtgtttccgcctgcacggctggcctattatgccgccgttgttgggcgtctacgtcttcaccgaccggcctgcctccgtcgccgccgactggtgtcctcgcctaaacggttggttggtcacaccaccgttcatgggcatccacgtcttcaccgaccggccacctcgtccgccgccgactggtgtttccgcctgcacggctggcctattgagccgtcgttgttgggcgtctacgactccaccaccggcctgcctccgccgccgccgactggtgtcctcgcctaaaacgtgggtggtcacaccaccgtcatgggcaccacgtct

SEQ ID NO: 69510 - DNA, 7811 bp, Oryza sativa
  unsure (1)..(7811): unsure at all n locations
ctcatgcattaactgatgaatcgtggattaacgccatgcatgaagaacttgaaaattttgagagaaacaaagtttggactttagttgaaccaccttctggacataatattattggaaccaagtgggttttcaaaaataaacaaaatgaggatggtttgattgtgacaaataaagctagacttggttctcaaggttttacccaagtggagggtttggattttggtgaaacttttgctcctgttgctagaattgaggcaattagacttttgttagcttttgctatttcaaaaggttttaaattgtatcaaatggatgtgaaaagtgcttttctaaatggttttatataggaggaagtttatgtcaaacaaccaccaggttttgaaaatcctgattttcccaaccatgtttttaaattgtctaaagctttgtatggcttgaaacaagcaactagagcatggtatgataggcttaagaattttttgcttgcgaaatgttttacaattggaaaggttgacaaaacacttttagttcttaagcatggtgataatcaactgttcgttcagatttatgtggatgatatcatctttggttgttcaacttacgctttggttgtggagtttgctgagactatgcgcagggagtttaagataagcatgatgagtgagttatcatactttttgggattgcaaattaagcaaacacctcaaggtacatttgtgcatcaaacgaagtacaatgttaacatcaattggttctacagctgtgttggatcctgatgaagatggtgaagctgtaactaacaacatgattgaatctttatcgtatctgattgcttctaggccagacatacagtttgctgtgtgtttgtgtgcacgctttcaagcttctcctcatgcttcacatcgtcaagcggttaagcgaataatgaagtatttgaatcatacacttaagtttggaatttagtattctacttcatcttctatatgcttgagtggatattccgatgctgattttactagttgtagaattgataggaaaagtactagtggatcggaacatgtcattttcttggtactgtaggatcgtaaagggcctttacaaccccaaaagctagccattgagatgaagggctcccccacttatatcttaggtcatttgcccttccacattcaatatgggactattcaacaatttcgcccttcacacattggtgccccttagcccttcaccaccccttcactgtatacaggccccacagggccacggtccatcagatatacaggccccgcaggcacccacagtccatcgggccttcacacactgtgtccatcgggccagagatgttaaactagccaggctctgataccaattataggatcgtaaagggcctttcccaccccaaaagctaaccattaaggtgaggggctcccccacttatatcttaggtccttttcccttctacaactaatgtggactattcaacaaaactcgtgtaaaccacaaccaagatcttaactacttaaaaaattaataactttccatttgtcacttaatttttcgtccatatacatgctaatttttcatccatatactcaattttttttgtccttcgtgcttgtgtgtccgccttgctcacgatccccttcatcccctacgcaaccttcgtccgtctctctgtgagaaacggatcgaatagaatacaagtatggacacatgaacaaatcaacccaacttccccatccaaaacccaatcatatgaacaaatcggatcaaaaacatcttgaaaaaatcaagaagaaaataaagagaaatcgagtcggagaagagataaaatcaagtgcacactgatcctaaataaggggaaatcacactatcgtctgggttggaggctaactgggagtggcctcgctcgatccgcgtcaccagcacccaatccgggattgatccgtgtcacccctgtccgatccgatcctctccaatgtccacagtttcgcctgttcttcagaactccaaccaaaaccaacgagctccaagccaccagatccggccacaagatatcgaggtcagctaaatctggaaggtatgaaaattaaggaggcgggagagaggagagctcgaggaaattactgaatccgaaagctaaaggcattgccgccgcaataatcttcctcctcttctcctgatcattaccggcgtcttcttcctcacaggctgtaccaccgcctccctgcacaagctccaagaatcccatgcaccttcggcattttctcctccctccagctgccatatcggctggccacgagtccaaagtcaccaggcaatgatgagcagatggatacattaggggcggcgggctgagcggaatatcggcggcgatgagggtgaggaaagaccgaaagaggacgagggagaaagaaccgctcacgtggataaattattgggggtgcgattatgtttcttttttcattttttctattttctaaccactcacgcggatcacgatcggatgggggcagcgagctgaggggaatgagagcagcgaggaaacaacacttatttttttcttttctctaactgcttacacagataattatgacatataacaatttcattcggttgatatctgtgtagaacattagcttgattcatcgatttgtacttttcaaaaatatctttttttttcatgattgcatgtataagagtacatctaactgattgattcaaatgttgatataatattttatatggtattgtagagataacctcacctaactaaataaagaggagagatcatacacaaatccgcaaaaccaaccaaacaaaatatcttctgaaccgtctctcttatggaagcaaccaaacaaaatattacattagccaaacaaaataaattcaagcaacaaaacagaggaggaatgtttatcctcttagccatgtcaaactcaggctgtatgagggagataagctagactaaggagatgcgagcaacctaacacatggggaggatagggtagctttgttgatgcatgcctatggttcttcatttaaggatgttctggccgagtattgttacacgaacttatatcctaccctactttaaacatatggattttttcaatcgtcacgctttattttgttcatcgcctacatgaaccccgctgaatcgcccgattgagtcaatcatttcattttttttccatacgtgtttaaattcatgcattgtgtgatataaaatgaaaaattaaaaaaaataaaaaaaggtaaagggagatgagttttgtatttgcctttagaaaaattaaaaaaaataaaaaaaggtaaagggagatgagttttgtatttgcctttagtatattcttgtgcatggtagcaatacttgttagataatatggaactagactttgtatgcattttttactttatatgaacttttgatattgtttttgatagtgtaacgtttcatatagatagagtagaaaattacaagtctatattcctggagggctatagcccaaagggaaataaaaacaaccatgccacacatctacaaccaaatcctgcatgcttcgtatattctcgaaaatactttatgcttgagcaatattattaagaatggagaagttgtaccgatcaaattatcaccaattatatagaacatccatttggaatggcctgctgactgagtcagtgtggagattatgggtaccccatacccacacggcatggttatccgactagttataggggataacttatatctatgtaatatgtaacagatcatgacttgggtgttacgtttccttgtatattacggaacggcgtaaagtcctgatttgggaaaccgataccgtattggttaaggtttctatcttgtaatcctgctccccatcctatataaggtgggcaggaggccctctagggggcagatatgagacaacctgatcatcagatcaatacacacccggcggattcaaatccccaaacaggagtagggtattacctctcattgagagggcctgaacctgtctaaatcctttgtctccacatccatccacttttaggtctcgtgcgctaccccttttattattgccgaaatcatgtttcgacagttggcgcgccaggtaggggttgcgtcgagttttccgtcgagaagtgcgatggaactctgtgccggcatcatcggtgctactcttgtctttggccgtgatcctctcaacaaaagggcagggtcttcgtcgccaaaaattctatctggatctggtttatcgttctaaattttcttatataaattagaattaattcacagatcactaattattatttgatctattattttatacatgtaccgccggccgccttcgtcgctgccgattggtttcatcgcctccacagttggtgtgcgccgctgccgttgcnnnnnnnnnnnnnnnnnnnnnnnccggcctgcctccgtcgccgccgactggtgtcctcgcctatacggtcggttggtcacaccaccgttgatgggcatcgtcatctacaccgccggcctgcctccgtcgccgccgactggtgtcatcgcctatacggttggtcggtcacaccaccgttcatgggcgtccatgtcttcaccgaccggctggccttcgccgccgccgactggtgcctccgcctacacggctggcctattatgccgccgctgttgggcgtccacgacttcaccgccggcctgcctccgtcgccgccgactggtgtcttcgtctatatggttggttggtcacaccaccgttgttgggcgtctacgtcttcaccaccggcatgcctccgttgccgccgagtggtgcctccgcctacacggctggcctattatgccgccgctgttgggcgtccacgacttcaccgccggcctgcctccgtcgccgccgactggtgtcctcgcctatacggtcggttggtcacaccaccgttgatgggcatcgtcatctacaccgccggcctgcctccgtcgccgccgactggtgtcatcgcctatacggttggtcggtcacaccaccgttcatgggcgtccacgtcttcaccgaccggctggccttcgtcgactggtgttttcgcctgcacggctggcctattatgccgccgttgttggatgtctacatcttcaccgttggatcaccttcgttgccgtcgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctagagatgttatatcatatttttcataatatttatcttgattgcttgcgacataatctgagtacaaaagtacctatcgagttatggagttctatcttcctatgctttccgtttggtttgccaatggatagttgcctttaggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggagaaatcaaaattaacaagagaagacatacgtatttataaactgcttgattttttctcgagtattatatttatatcagatactactcatcctatatgtttgttctgcaggatccagatccagatatgcataaaagggattcatggctttaagcatatctcttatgctccaggaatggatcagtcagaacatcaccaccggctcgcctcgaccgccgccgactggcgtttccgcctgcacggctggcctattatgccgccgttgttgggcgtctacgtcttcaccgaccggcttgccttcgccgccgccgactggtgtgtccgcctgcacggctggcctattatgccgccgttgttgggcgtctacgtcttcaccgaccggcttgccttcgccgccgccgactggtgtgtccgcctgcacggctggcctattatgccgccgttgttgggcgtctacgtcttcaccgaccggcctgccttcgccgctgccgactggtgtttccgcctgcacggctggcctttatgctgccgttgttgggcgtctacgtcttcaccgaccggccgcctcgtcagccgccgactggtgtttccgcctgcacggctggcctattatgccaccgttgttgggcgtctacgtcttcaccgaccggccgcctcgtccgccgccgattggtgtcttcgcctatacggttggttggtcacaccaccgttgttgggcgtctacgtcttcaccgaccggcctgccttcgtcgccgccgactggtgtctccgcctgcacggctggcctttatgctgccgttgttgggcgtctacgtcttcaccgaccggccgcctcgtcggccgccgactggtgtttccgcctgcacggctggcctattatgccaccgttgttgggcgtctacgtcttcaccgaccggccgcctcgtccgccgccgactggtgtttccgcctgcacggctggcctattatgccgccgttgttgggcgtctacgtcttcaccgaccggccgcctcgtccgccgccgactggtgtttccgcctgcacggctggcctattatgccaccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactagtttcttcacttccatggctgcatgattctgccagtgttgattggcctattatgccgctgttgttgggcatctacatcttcatcgccggtcgtctcgtctgctgctgactagtgcccttacctctacgtctggtttatacagctaccactactgatggacatcatcgtctttcgtcgccgactggttatgctgtcgccgactagtgcttttattttcacaactgcgcgtcttcgctaccagcttgcttctattgccgccgactcgtgttcacttcatcacggcgatgcaactttgtcatcatggtggagcgacttcatctttattatcttcgtcactggcaaactctattgctgctacttcgcaagttttgcttcttcaccaaccatgacgtctttgtgaacctcgacatctcggcatgcgatgccgtgttattttactacaacaagtggctctccaatattcaggatttctacttggacatcttcaacacatatcttcaatcaagcaatgactattcgatgacaagaagctacagttctcgactctatgtttagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcagagc

SEQ ID NO: 69511 - DNA, 945 bp, Oryza sativa
tattatgccgccgttgttgggcgtctacgtcttcaccgaccggcctgccttcgccgctgccgactggtgtttccgcctgcacggctggcctttatgctgccgttgttgggcgtctacgtcttcaccgaccggccgcctcgtcggccgccgactggtgtttccgcctgcacggctggcctattatgccaccgttgttgggcgtctacgtcttcaccgaccggccgcctcgtccgccgccgattggtgtcttcgcctatacggttggttggtcacaccaccgttgttgggcgtctacgtcttcaccgaccggcctgcctccgtcgccgccgactggtgtcctcgcctatacggtcggttggtcacaccaccgttgatgggcatcgtcatctacaccgccggcctgcctccgtcgccgccgactggtgtcatcgcctatacggttggtcggtcacaccaccgttcatgggcgtccacgtcttcaccgaccggctggccttcgtcgactggtgttttcgcctgcacggctggcctattatgccgccgttgttggatgtctacatcttcaccgttggatcaccttcgttgccgtcgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctagagatgttatatcatatttttcataatatttatcttgattgcttgcgacatatctgagtacaaaagtacctatcgagttatggagt

SEQ ID NO: 69512 - DNA, 991 bp, Oryza sativa
gcacagctggcctattacgccaccgttgttgggcgtctagtcttcaccgacaggccgcctggtccgccgccgattggtgtcttcgcctatacggttggttggtcacaccaccgttgttgggcgtactacgtcttcaccgaccggcttgccttcgtcgccgccgactggtgtctccgcctgcacggctggcctttatgctgccgttgttgggcgtctacgtcttcaccgaccggccgcctcgtcggccgccgactggtgtttccgcctgcacggctggcctattatgccaccgttgttgggcgtctacgtcttcaccgaccggccgcctcgtccgccgccgactggtgtttccgcctgcacggctggcctattatgccgccgttgttgggcgtctacgtcttcaccgaccggcttgccttcgccgccgctgactggtgtttccggctgcacggctggcctttatgccgccgttgttgggcgtctacgtcttcaccgaccggcctgccttcgccgctgccgactggtgttttccgcctgcacggctggcctttatgctgccgttgttgggcgtctacgtcttcaccgaccggccgcctcgtcggccgccgactggtgtttccgcctgcacggctggcctattatgccaccgttgttgggcgtctacgtcttcaccgaccggccgcctcgtccgccgccgattggtgtcttcgcctatacggttggttggtcacaccaccgttgttgggcgtctacgtcttcaccgatcggcttgccttcgtcgccgccgactggtgtctccgcctgcacggctggcctattatgccaccgttgttgggcgtctacgtcttcaccgaccggccgcctcgtccgccgccgactggtgtttccgcctgcacggctggcctttatgctgccgttgttgggcgtctacgtcttcaccgaccggccgcctcgtcggccgccgactggtgtttccgtctgcacggctggc

SEQ ID NO: 69513 - DNA, 1689 bp, Oryza sativa
gctcaggggcttactagctcaaatacaagtattatatcttcaatttggacttgctccggatacatgcaacatgaattcatgatcatgggtctattttatatgctcaaggactggactatttattattccccgtaagggttatcaactgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattgaatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatatgttaaaacagtgtgcgcatggcgtatgcccaatactttggaaatttctttattcacaacacacaagcttttttatagctgttttgctatgtgaattttcaataatgtagccaactttaggttacgctcatcatattttacaaagcagtcggtatatcactcggatcatgttatttggaggattcacaccgcatatgctatatattgatatcaagtcacttggttgattacgattatcaaaatcactcggttggttggattatttattccttgactatatgcttggtttgttcaattaaccacattgtcgggggctacacctattaggtgcatctagtcggtgcacctgactatatttttcagccctccacagtcttcagatttggtaaaagtactcgggagaccatggcgaagatgattggagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttgggaaaccgataccgtattggttaaggtttctatcttgtaatcctgctccccatcctatataaggtgggcaggaggccctctagggggcagatatgagacaacctgatcatcagatcaatacacacccggcggattcaaatccccaaacaggagtagggtattacctctcattgagagggcctgaacctgtctaaatcctttgtctccacatccatccacttttaggtctcgtgcgcaaaccgggggatccact

SEQ ID NO: 69514 - DNA, 2508 bp, Oryza sativa
attttcctaggagatagagaagggtaaaattatcttcagttctaggtacgtaggtaccacatcggtaccatatctcagtacattatttacgtgttcttttttaagatttacattttcttcttaagaacgtattcgctttgtaagcctccatgacgtgatttacatgctttgtagaattcattcactaacaacaaattatatgttttaggaattaaataactaattctataataccatacacctagatttcaatattgacccgaactcaaccatcttccaaatttacctcacgtttggctgatgtgcttcgccttgccattgtcgagttgatctcatctcctattcaattctcaaccataccaacacttctcccatttttttccctggtgaaccaatgcaaacactagaacaagaacgaagtgatgtgtaaagaagattcaacctgattttttgtcatgtgtagatctaatcgatgcctaaatcaatgcctccgaatatttacattttaagtattcgattcaacgtaatgccaatatttcactagttaattactctactgccattggttacaataatttttcttacatacctttctcctctcttgatcaatggtccacattaccccacctctcgataactctaaatagctcgtaaacactgtaaaacctctcatatcttacgtacaaaatgatccgtaactgtttgatgatcagcaatggcacacaaagatacacgaggcaagaataaagaaggaatataatcaaagaggtaaattttgatacccaggctcctaacattttcgctaaatggtgcattcttatttacaaattttcagcgctgtcacacagtcacacactaacacgcaggaccttgcagtagactgcagtctgccagctaagacgacgttggtcaaacatccaagacaaatcagtcttctacatggtacatggatagcaaggccagcaaaagaacaaaacacaaatcgtaaggtaaaaacatggtggaattccggacacctcccactcttagagcaggttgtcagattctcagagattgcaggtaagatcagtatcatatcattcccaggctacaaccctacaactgtgaatggccttgctcaagattaccatttggcagctgctgctatgtactcagcgatcccagcagcaaatatgaccgactatttatgcatcctttaattccttttcaagtacttctcgcattgtctttgcggcaattttcaggtagcaatatggacacgcagatactgtccttggttttgcacaggatatcagttattattatttctcattgtagaaacatcttgtaaccattgtgtgaattgtcggtacacacaccagtccaatagctaagaagatgccaaagagccaagtaacatctcaacaaaagtgtcatggtctcatggatcacagtaaaagaatgtaaattgtcatagaaggtaaaaccaccttgtcctactgagtccaactgagagatcattgctcaagcattatagctccacatggccgttttttagctagaaaacgagttttggggccaccattttctattgccattacttttaaattatttacctgtaaaaacttttagcgattaacattgccattattttcaatttccactactctccgtttcgaatgataatatacggcactcgaaggagaaatatagctgtaattgaacggtgacaaatgtctatgtttggcagctagttagaaccgccaagaatatatttaaatttagcggctgttttttgaccgccaaagaaatcatttggcctctaagaaaatttacggattcttcattcttatagtgaactggtactcacaacaactttaatctatccacagttgtatgaaaataacttgcttgacagatggcacaatacgcgaacaagaattaaacaacaataactatgcgatggcttaaagcaactgtaatagaggtggccagtacacttctactttatccgtatcatcatactttattttattggtttactcacagtttatcttacctttttctctgtacttttattagaaattacagagagcctactgcacgagggaaagttcatccagttattacatctcctccaacttttcacctctatctcaatggtgttccaagctgccaccccaagttttactgcatatgttcattgcgggctattgacatcttgcatggagctatgctaggattccagattccatggatggatatactactatgtaagaatatgtgtatgaaatttattagcgaggagcagagtttcgaactcagatcaagtgcaactagcttttctaataatggaatagaatatcctggcatttgctcaacaaattacagccaattattacaacgtaacactcaaaacgagtgtagttcacataaataaaacaagacaccaacaggtagcttggtcaatagtacaactaactaacggcatagaaatgaccacgtcggattattgcagctaatacaaag

SEQ ID NO: 69515 - DNA, 6212 bp, Oryza sativa
attctcggccttctgcctttttcatataccaaccagctgttggcaagctagttccaagctcgcgaatagttggccatcaacgacaaactttccagtcatttctcgagtttcagctgaacagtccaagtgactcagagtgtgtatcaattgaacaaccggagtgactcaaagaggctagatcactcctgatgcctcctaattctacgcataaaatattgtatagcagagcctataagttgcatgatacatttccaaggttgaggataattagctagcccgtacccagtgacaggcacattaggattgctgtccttttgtctatatatctaccaatagcacatagcactatatattgtcccacatatgcatgtattgccatggaccacatagtatttagaaatatttaccctaaagtaatattaagaatattttcaataatctagtatttatgatactttatatagtactttccactattcttttgacacattgttaaattaaaccagtacaacacgtttttagcaagcacatgtaacttatcagtcccagtcccactaatgtagtatgaattcatttacaactttcattgcatcacaccaatttgctagtaaatttgttcccaatgattactccatcaagtacaaccaaatatgcatgttcgagctagaaggctcttaatttagcactaacctttgtttgatctccatatataatttgatattttacacaacgcgtttaataaccctctcaaaattaacctagacgcggcctcagtgattagtgatgtgtgatggctcctggacctacaaatccacaatgaggaggatggctcttgttagcttggacttacgtccctccagtgcagaaacaagcaggaaatgcgacatggtgcgtgttatctttgtgccggcaaggtttaaatttgccccctactggtttggaacggttcatccactctgcgcatttttcatgacccccaagcttggtattttaggttccgtcgagatgagggagcttgcttaatttcatgcgcatcttcaggatttaattttaacaggcgtttcaagagagtcttgcagatgtcaattggatggatgtggctatgctattcccgatgccacctaattcgacacaagttgtccaaacatggatgtagagaaactatatatactccctccatctaatttcggtagtcatattttatcttggcacaatgaccaaggataagtaattgtactttatcatccattttaacatgctactagttattcctcgtaaacaagcgattcattaatagtaaagttctcgatgctcatatagccaatcttgtgtggaaaagtagagaatcacacattcaatctgataaagtcattaagaggataggtggctggattgaaatatgcctatcaaaaaataaatctttaagatttggaaatattcctatcaaaatagatagagtatttcaatgttaattagagaaagagtaaaatacagtagcggcccttaaacttgcgggcggatgtcatccaggtccactaacttgcaaattgtgtaattaggccactaaactttctaaatgtaccatcgccggtccaaaatgccgtttgaccgcggtcgcgccaacgtggcatgccacgtgcatagctgagctggcccgcaccgtgcgtgacacaccgcccacgccttgtcgtttttcatccaggtccctctctttttctcatttggtttccaccactgcttcttcttccccggagcgcccaaaatctgagcggcgactagggatgcgattgagggcaaggtttggcggcggagcaggtcgcggcaggttcggcggcggagcaggtctcggcagggttcggcgacggagtatgtcatggcagggttcactactagaaaaatcatttgttgctacgaaaaaaatcgtggcatcaatactaaaattgtggcaatagatccatgttgccacaattttaaaatcgttgctagccgtggtaataaatagcgtcgtaataggttattgcaacgatttttattttgtggtaataaatttagatgttgccacggaatggatgtggcaaaaagtcatattgcaacacttcacgtcgttgtaataaaaattattgccaccactccatatgtggcattagttttatgtaccaaactaaaagtttaaatattaatctatcatcctatctattttatctatttattttttttgatattgtgtcttggctaggattcgaacccaagacctatccttcacacatgctctcctttaccaactcacctacgcatcaattctgttgaaaatgcatatcgttccatttgagcctacgtaactgagatttgaatcatagatttgaatatctaaaagatttcaaatgaaaaggttatcacctataaaattgtagatctcgttgagagctataatttccatataaaatttgtctcaatccgtgttcatatgaaaaaattaagttaaattatgagacaacaatttttttattgcaacgaatttgttgatcgtggcaacaaaaaatagtgaaaaaaagtaccatgtactatgtaaattgccacaaaaattaaaattgtggcgatagaacatgttttttgcaacaatacgattttttgtggtgatatctcattttctattgcaacaaaactactaaataaaacaacgattgtagatcgttgcaataaaatataattatttaccacggaaaaattatcattgcaatagtacaatatattgctacgaattattttttatagtaataatttggtggcaatagctcaattatcttgtagtggttcttcggcggagtaggtctcggcgggcttcggcggcagaggcgatggcaggctcgagctccagtaggagcacaacacggtcggcgaccgaaatatccaggcaaggtaaaacctttccatctcccattcggtacctggagagtagtttgttgaagtcagttggtttattcattttgaatgtgcagaatggtggatgcaaattatggcagtggtatgaaccagggacaacgctgtatttgcagcaggttttgaatgatttagtcagcactgttcgtgaagtgaagacagagaactctgaaattagagcatcccttgccaactcaagagctgtgattgatggacttgtcactgaacgcaatgtctatgaagcaaagagcatgggacaaaaagaggaatgtggctcatttgctgaaatggcctgtagaatcaagatgttagaagagagtagatgatttatgttgtcagtaattgttggttttgtagtagtcatatttgcactattgcttcttaggtagataccaaagtttgatggatatggatgtattggtgctggtgtgttttgtgtcagctaataaggcacttgagtgaccttttgtgtatgctgaatctgaaccatgtatgaaaaatgtatgctaaatgctattatgtgaagctgaaatatgagattttgttctgaaaatcgacatctctaattttttttcagcagacaactgttattttgttctagcttatgaaatgtcttgtaaaacgtcatctagaaatagcaaacatgcatcatgcattacaggcagtaatttcccatattcatcacaataccaaatttctggcatttagtagtatttctagtactacattcagtgaacacatgtctggcatcacaaaattcccatgttctatcataaaatagccgcaagtttggcagcacaaaatcaagcaagcatgcccatgaaatccatacagggttcaaattttggcataacaaattactactagcactaaaggaccatcaaacatatggtctaacacatatcacttgtttgtagcagtagctttcttcccgggagctctgttctttgaagtagtagcagcaactcctgaaactcctttagttgtacacttccttttgttggccctagattttccctcttttgttgctgtggtcataggggtagatactacagctggctagtttgaaaggatgtactggttatctgggagaggaccatgtgtagtttccatttgactcacttgtgatgattcctcaaacatctgtgcaaccataggattaggaacttgtgatagtaattggtcatatgcagactgagattgggtcagcacctacaagtttacaaaggtaattaagatagagttataatagggtagtgataatagagtgataagatagagtattgtttcattacctctgctggttcttgctcagattcatgccactcttctgtagaacttgcagctgggatcctacttgtcttcagtttgggtctgagtccagcctttctcagtgggcaccctttcttgttatgtccaggctctttgcagtaagagcagtgcatctccacaccatgcttggacattttagacccattttttccctgtacctcatgtggtgctttcctcctagacttaggtggtctgccaacctttttctcatatattggaggcttcacttctggcccattcacctgagcccacttagtcatatcattgcagggccaaatgttaaatgcatatgcagggtggaagaactgactcagcactaattctctcactccttaagcatgagatagcatggttacaagggatgcctgtcagatcccatctcctgcagtcacaatgtttagcactaaggtcaacaatgtactaaaaattcctatcttccacctgaaaaatccctttcccggctggcaaaacataacatgtgtttgccatatctgcatttttcagtactttcaatatcatttgctaattggactaactttgcaaaccctccaagtgtcatcttatcatttgctctaaaagtttcaatgtacttctcagatagccatttagcagtacaccttttcagcacccattccttctgacatttatgctccccaagatatgtcttcaccatcattgacttggacctgctatcaaatgatgcatataagttccatgggcaaccctcaacacaatgggccctaagtcttttttgctcattcctaggcatcttgatgtccactctagccttcaaactgtactctgttatggcctttctaagtacttctactgaaggaaacaccatgccaaccttaaaaactgggttcttaacatcctctgccatgaaagccttaaactttaatctcacttcaccatcatcatctgaatctgggagctgcaaatcttcatcatcagtggaaacttcctccccatcagaatttctaactactatttctttccccttcaactgactgcccttagctttcttccaaaactttgccttgcagtcagataagtcttcaacacccacatcaacattgtcaacatacaagtcatcatttgcatctgatatatcatagtcactatccataaaatctgggtcatcttctaagctaccatcactgtcactgtcatcttatttgtttggcaccttcctatcagcagttgacatcttcctaggactaagcaccttaggcaattcactaataggattagctactacatcatcccaatctacacctgcaattgtgtcaccctgatcaaagtagataataaaattcttaaccttgtgcacaactgatttcatcacttcaaagtcagccctagtagatataaccctaaggccatcttcaagagtctttccagggagcaaccaataagccttaaaatctggagtcatatcatacccaagcatagctaaaaattcatccaaacaaacaatatcccatgttcttgcttcacagtggtcaatccaatttatcgtttgatctacatatgccctattgctaccctgaccaacaaaaaaaccaccatggtgtacctcagcggtgaatttaccatcatcaagacctgcattgcaatcctaattagcggtattactctcatgttctagcctactcgagaacaatgtcaggataatcatcctacaggaaaaaataacatctttttgcataatcaaacgccatattcctttgtatctatctaccaacatcaatcagtgcatgctaaccttgcagattaatggatgaaaatttgaaattacactcactgtacaacggaggcccttccccttccaagcggaaaatcatgccgcctccccgcgattatggccagcgggaggccgcaacagccaatctcgcctctttgtgctttcgctggaaccctatttctcggcgatcactccc

SEQ ID NO: 69516 - DNA, 22647 bp, Oryza sativa
aagatcaatccatctttactcccgggtggtatcaccaaccgggactaaagtggtaatcttctagttctggttggtagtataaaccgggactaaagatcctcgacccccggacatacatctgacaggagatgaatcgggactaaaaatcatctttagtcccggttggtgtactaaagatcaaaatttttttaactgagactaaaaatcgtttttattcccggtttttaatggaaccgggactattgtgggatttggtcgaccgaccaaaaatggtttctccaccagcgatggtatcaaattgtttccgattattagatatagaatgggcattgttagattcaacgatcggaaacgatctgatactgtgaggtaccggtacattaagacttttttttttaccggagtaaatctcttatacactacactaacacatgcaagtgctcccccaggtcattagtataaaactaaaaaggtgccacagcaacctgtactgttctgttgactggtttcactgcttgcctcaagtggttatgggtgatgaaccaagtgctaaatgagcgtgcaaccttcgaattgattaaaacatttcgctttgatttgtatgggccatgtgaacaaagaactggattgagcatcatcccatgggggccgctgggctaatatgacaatggagagcaataggaatgcaagcagccagcgggcggcctgcatgctagcttaagctatggagccacattaatactatgtaccaatttcttcgaaccggtatctattggtacttaaaggtaccgctttttaattcttttttcaccttgtgaatgtgggaaacggtcaattggtgccggttttaaatgaatcggcatctataagccgtcacttattaaggtttttgtagtagtcgaaggagatttggagattaaggagagaataaaggagggagggaagaatataataagtgaggtgcgttatctcggtcttttcaggtctctttacactccggctatgaaaattgattttgcaggcatacgcttaatttgccaattagtctacttaagaatttgtccacaaaactcgatattcgcaagaggttaataaccatggaaacttggtgtttttggaagcagctataagcggttatttttctcgtccgcctgcaaaataaaagggacgtgttgtaaaaaaaaaaaacttttttcaagtattgtgggaggctaggagtattttgtgcacacggtcgccaattctatgttttactcttcctacctttcaagcaaaagtacattatttttccatttgagatgaagtagaaaaattaggagaaagtaatgtgaccgaaaagaaaaatacgagggagaaaaaaagagagaagaaaaataacttttgacggtattggtttagtcgtgcaagcccttgtgggaaatccaattgaaacgacattaagacgaaaacagttcgtacatctttctttgtttcattcatctcagaattaccattcactagtactgccatcccattctcgacgggcagatgcatgatataacttaagacaatatcagttgattgtgatgagctagatcgaggcgcgcatcaaactgtcaagcatgtagaagccttatttcctggagctaaaccatgagtcccaatgcctcccaatactaaactagccccttctttcttgttacctaggcgccatcatatggctaccagtgccgcttgcaaatatgcatggatgactatatatttgatgattattttctcagtaaagacatccaacttatattataagtactatccctatctgatattgcctcgtactccctccgtcccaaaaaaagacaaaccctgagtttccgtgtccaacgtttgaccgtccgtcttatttaaaaaaaatataaaaaaaattaaaaagacaagttacgcataaagtattaatcatgttttatcatctaacaataatgaaaatactaattataaaaaacatcatataaaacggatagtcaaacgttagacacggaaactcagattgtctttttttttttttaggacggagggagtacgtgtttcaatctatagccatatttgtaagaagtaaactgctactgtcctgcgtgggctatatgcttttgcaggctgcagccagcgtcaatgctccaagtttgctgcatatgtaatatactttgcatatttctggtgctttatcaactcaataccatgcatgtacatagtgaaaggcctgcaaacttttgaagtatttgcttcagctgcgtattatttatgctccaatatgtttagctctgcgtgtacgtccattatagacgtagagaccgggtttaattttaacacaaattttaatgcttcctccgtttcaaaatgtctgacaccgttgactttttaagcacatgtttgaccgttcgtcttatttaaaaaaaatttatgaaatatgtaaaactatatgtatacatgaaagtatatttaacaatgaatcaaatgatatgaaaagaataaataattactttaattttttatacaaaacgaatggtcaaacacgtactaaaaagttaacggtgtcaaacattttgaaacggagggagtatatctctatgcaatgcagagtattatagtcagaccaaaaagaagctcactcccctttgctaaactttttcacgtttgccatgctaaatttcctagtatacgcgagctcgctctctaactcttagcaacttcttgctgctaaaaataatgaagcctccaagtactcaaatatgtgccgctgctctcctctattgcccgcagaaactagcatgaccaaacctagtactagatttctctgcaatatcgtccctttcatggagtagttccagctcacacaggcctctgcgtctcttgaccacatacaaccagcctgctgtcttggatgaggtatgtaggccgtattagggagaagtttggaaaaagttggtagtttgaaaaaaaaaagttaggagtttatgtgtgtaagaaagttttggatgtgatgtgatgtgatggaaagttgggagttggaggaattttcatgtgactaaacagggccgtagagccaatgttgggcacacagggtcataatcatgtacatatagctatattccctctacaccagagatgacacatatctactcttagtacggaccttcatccaacaagactcattaactcttaccaaggaagtatcatgaaacaggcgtgtaggacaattcctgatgcctcttaatcataattacctttctcaggactaagattaatctctcaaccatattctaagaccaaagatttcagtaggtgctctactctctgtacttatttggttctttttgtcagcaagctggtcttctctgaattttggtgcaggcgtgcagccactccatatatatttgcttgttggctgcctaaggaagatggaaagttcattaaggctatctatgtattgcagcatcaggtatacaggagaaagattaagagaaaatcccctatatacccatgaaagttcacctaatcccttctataccttgaattttgctcaatcccttacatacccctgaattttagtttggatcccttccatgccctttccgctagttgaccgttagttcaccgttaaattcttttgaaaaagtccattttgccctttgctatgaagaaacataataaattaatgaagtatattgttggaatgtaaaaatttattgaatgggactattatatttatgagtatgtgatgcaccatattatttgtgacaaatttacttttacatatgatataaaaagttgatacttatttattattagttattaaaagttcttttatgtagcatatgtgttttcatagtaatacaacagatttgtttattacttcagaacacatatgctaaaaaaaatcttttaataactaataaataagtattaattttttatgtcatatctaaaagtatatttatcgcaaataatatggtgcataactatctcataaatataatagtctcatataacaaatttctatgctccaacaatatactctattaatttatatgcttctttgtactatagggtaaaatggactttttcataagaatttaacggtcaactaacggtcaactagcggaaagggcatggaagagatccaaactaaaattcaagggtatgtaagggattgagcaaaattcagaggtacagaagggattatgtgaactttcaaggatacggagattttctcaaagattaaacaaggcagtaatttcagacatcctaaaatgaattgtgtgagaggacgataaaaacgccatttcgatccatgactcgaactaccagccatatagtgatgagcgctctcaaaattatgcaaatatatatacaacgttttcttggtaaatgcaactcgatgcctcccaaaattacaatagatctggttaatgcagcaacatagcgcatgcaaagtctacttgacaagctgagagaactattaaggttttgtgtaggctatctatcactattttgacgtttgattttgccttgatatttacagcataacacactttgcatttcactggtaattcatatccaacgcatgtggcaatacattttattggaagactactgtggcaatacattatgatttagtccgtaagaacctaagtgtctaatgaacaatgtgcgtgtaaaatttctcagtactgtttacaatcatagcaatgcataggttgcacgtcttggtgacaaatatgagcaaccgttctaaacaacggtgtttctagaccactaacattgtttggccattttaccagattctagagtatgctgtatctaacatccagagaactgttataaaaccggccccgatagcacatcgagaaccaaacattaaaaaaacgtcatgggagatccaaacacgatgatgacaccgagacacgatatttgttagcgaggttcagccgaagcctacatccctaggacactgattacgggcgctcctccccgatccgacatattacagagtatcagaattacaatgtctcacggccggacgctgccggtagctgctccctctcgatatgctaagtcgtcatgcggttataacagatctgtccctctatttaagagagattctaagatagagtgtggctcttattcttttctgaacacgtaatataactctaagttctaaaccgtaaccgactttgtaaacatatttgacgcaaactctaacaagaactatataacagaatttagaatcctccgaatcctaagcttgttaaggtctgtaaacaattaaagatcgatatatcagaggatgccccttagtatacccaatttattagcaagaggccagcgcatacgtgcatggtgaaaggcctcagtttttttttaaacaaactggccctttgtttatactgcttacaatctattctccaatatatttgtggataaaaaaactttatacaccttacaaaggttgccacttcccttcaattcatttgtttatatatactggccttttgtttatactgcttaattactatttattctttgtactgcgcaccacttgcagtccaggttaccaaacattctcattcctggttcccagatgtacctataccttgtgttgtaaatcttatttgtgacttaatttaacaggaacgaccccgcattgcaaatttcctgctttttcctgtgatttctgcaaagttgcccaagaggaaatccggaaacttaacaatcatattttgccgttttcataggtttagctgcatttctagttatccaaatacaccacagaacagcaatcaaattcttcatatccttcttatggttacgaaaccagccccccacgagtgatgacgaatatgctccacccataatgaaagtactatcaactacattccaaattaacaattaagcaaataggcattttagaaacaaggatcgatgtacaagaagatgaatacgtattgcatgacacgaacattttctagcaagtacatagggcatttatagcagagccataagacgtttgacggcattcaatctgcatatattgtgtctttcgtaaagttgtatatgcacgtactgtatgactcgtttgattgcaagaatagagtattgcttgctgatcctctcaatccgccggcatcgagagagagagagataggaggaaattaaagcctgaccctagtcatctactcactgatgccacgggaaggggggaggggtcaccgtcattgccaggggtcgccagcgtcttggagaggggaagaaagccccagctagccttgtcaagctaagaggataaacaagaaggctgggaaagagcatctcgtcctgtttctagaggacgaagttgaccaagaaggaagaagcaggttaacggaaatcttgacggcgatgacatggttttaatttggcaaaaatattttaacaattatatgtacccaattggtgcctcgcaacgcgatcattgtaagagggggatgcagccagaaacgaaacagcaagcatgcatggtttgaaatggttcttcgcgtgctgcctctttcatggaccaacgagctgcaggcaagctatttccatgctctcgaatagttggccatcaactacgaacttcccagtcatttcttgagtttcaactgaacaatcggagcgattcaaagccttgagtagtgactcaaagaggctagagtagactagtcctgatgcctcctaattctacgcaagttgttgataaaagattgtatagcagaaccaatgagttgcatgatacatttccaaggttgaggataattagctagctcgtgcctattgacagtcacattaggattgctggccttttgtctatatatctaccaatagcacatagcactatataatgtcccacatatgcatgtattgccatggaccacaaaatagttatgataagtacttttcacttttcttgggacacattgttaaattataccagtgcaacactttttttagcaagcacatgtaacttatcagtccctctaatgtactatgaattcatttacaaattacaactttcattgcatcgcaccaatttgctggtaaatttgttcgctatgattactccatcaagtacgaccaaatatgcatgttcgagctagaaggctcttaatttagcttttacctttgtttgatctccatatgtaatttgatgttttacacaaattaacctagacgcggcctgatcagtgattagtgatgtgtgatggctcctggacctacaaatccacaacgaggaggatggctcttgttagcttggacatacatagatccctccagtgcagaattcatccaagaaacaaagcaggaaatgagacatggtgcgcgtcctctgtgtcccgacaaggtttaaatttgccccctactggtttgaaatggctcatccactctgcgcatttttcatgacccccaagctaggtatttcaggttgcatcgagatgatgaagcttgtttcatgctcatctacagcatttttacaggcgatccattagagccttgcagatgtcaattggatggatggggctatgccactcccgatgccacctaattctacacaagtcatccaaacatggatgcagagaagggctaaccaaatgtgcatcatatatatatttcaatgttaattagagaaactatctaggagagatagaagcttgagcttccgaatttaattctggcctttggtttgtcttttgttttaaaagaactaagcttctgtctattatatcgattccctatgtacatggattggcaacaacgacatggtatggttgattttatacaccctactacagaaacggtttttacatgcgggtgaaagagatttttgcatgcggttagcacaaccgcatgcgccaaaaggtacgtcaaaatcggttttttcacatgcaaaaaccggccgcatgcaaaaataaatttggcgaaaaaaataaaaaacaaaaaacccacaaaccctatcacgctgcccaccgtcggagcgccggatccgccgccccaccacccgccatcgtcgccggggtcagatcagccgcccccacctccagtagtcatcgctgcccccggatcgactgtccccaccaccggatcgattgtccccaccgcccacagtcgtcactagtcgtcgccagggttagaccagccgcccgcagttgtcggcgaggccggatccgcctcccgcggtcatcgccggcaccggatcggccaccctcactatccgccggtgccacatccatcggccccgccgcctgcggttgtcgctagcgccggatcagccacccctgcctcctgcagtcgtcgctggcgccgcatccgccaccccctctgtcctccgtcgtcaccgacgacggatccgcacaagggagggtccccagtgcctgatccatgcggggtggcaccgcccgaggcggccgagccgccaacttgatcccgctcggtgatccaatgagtgaggctttcaaagaactacaacctttcaagtagtttgtcacccaccaactcagtaaccaccacacaagcatcagcaacgcttggcctccacccaaccacaccagcgcccctccgtcggcctacttttgaacaaccgcaacaccccacaagctcgcttcatcccaccgttcatcccatgagaactagcctaggcctcctccgtcccgccacccgtcggcctccttgccatgttcaaccaaaggagaacctgtgactggacagcgttgcttcggcctcctgagcttccctcgctgaccagtagtctgctcaactcaaccgaaaaccccgacgaagaaggggaggagctccaggaaaggggagggtgctgaccggaatggggaagacgacccaccaccgccagctccctttccactaccgcctctcccttgcgcactgtcaccagggcagcatcgctgaatccgaccgttgcacgaggtctccagccgtgccggcaccaccacaaccttcaggcatcggtgccccagcctcccaatggctgtgcctactcaccactggccttgatgccacccactgccattgctgcgcgaggcgccgccgtcgccactagtcacggcggctttgaagcctcccggtgcagtctctgcgcgagggccccgctaccggccgcgacagcattgaagccacccactgccatcactcatggcctcttcaccatgctgacaattgtcgctggcctcgacagtctccaactgccacgggttgttccgaccagatccgacgcgataacgctagatccacacgtggggtgcccggatccggccacaccggcaccggatccactactctccatgcgccgagtcaccatcctcatgctaaggcaggtcgccactggggagaggcctcaccaccaccctcccggctggccgcttggttctccagcagaacactccggtggcggcgatgggagggacaggaaggaagcgaggcagcaatggggctagggttcgcccccccttgccacccacgtgagaggacagcgtggcgtctcgatcttgcacgcccgcctttctctttcatccaagccaatcggggaagcccattcatgctatttttttgaagtcgacagcatcgtcaataggaaggtaccaagccggtgataggagcattggtgcccgtgcacaaccgtctacatattaatcgatgatatttctttctcatagtgctatctccccgccacctaggtataaattccaaaaaaatgcattgataggagcattgtttcgttattgtacttgccattaagataaagattaagtacgggcacgcaaaatgataaagctattaacgcattaattgagttttaattctttcaaaacctgaaaggatttatttgatattttagagcaacttcaatatagaaaaattttcacacgaaatacaccgtttatcagtttgaaaagcatgctgataaaaaatgaatctgtataatcgaaaaaaaacagggcagtccatgtacactaatttgtcagatatgtcataattaaagtatttctaccattctttgaaggcccatgatcgatcaagaaagctagcagtagttaattttctgagcaatttagcatccatgatgttggatggtaaaattgctctaattttctcgttaattccatagagtcgaaggccgcgaagaactttgcacgtttaaaatctaccagttgttcaacaaggccgaaataacaattcaattaatgttttactttgcacatagcaactaataccataaaaattaacctaggcccttccacaccattattgagctatgagcctatgatgacatgtactcctacatatccaccattagagcaagtataatagtgagctataagcctactataaacttatgtggaggagagatgtaacaaaaagttaagggtgttggctctcatgcaagagctagcttaacacaagctccaagacaaatataattaatatataagttagagatagagatatgagaagaaaattatagccaaccttatagctaatctattagagcaagtataatagtgagttataagcctactataaacttaggtggaggagagagatagtgaaaaattaagaatattggctctcatgcaagaactagcttatcacaagctccaaggcaaatacattaaatgtaataagtgagagatagagagaggagaagaaaattgtagccaaccttgtagctaatctattatatatgttgactttaagatggactaatagtaggaaatgggctatattattatccttgctcttatatgtgctgggtttaagattgactaatagtaggaactgaactctattattatccttgctctttatatgatttcgctagcatagatatccaggcttgcagcgctgaactcgggaacatgtacaggaatgcaatgaggcacgacgtgtgcctcaacaggccgaacactatcttgctatggtttcaactgtttcatcgtttccttgcattttatattatattacccgcaacctatgcagtctagattctgccaatgatgaggcttgtttcgatgttgccaaacatatggccatccagttgcatttcaccggcgattcttgggtaactggtgaaaggaccaatctgagttatggggctacgacactcctgatgcctcccaattctacacaatctgcccaagcatggatataatccggagtagcaagttttcattggcagcaacatgtttgctcctgccctctctttagttatgaagtcttatagagatcgtgatgacagctcccaatcctattgactatgctatactttatccggttaagttctcctagattgataggagtaactgaattacctttcaaggctagagttatgcatggtctatttatatattgcttcgactagctagagtactcatcaaagaaagaagtaaaaatatcataaatcaatagcatgcggtaagttcctatatatgcattcccttgattaagtatatttagaattttcaggccccatattttctcttatgcttatacttatcagtcgaatttgaattttcaaccttaaatttagagtgatttgaaggtttttttcatcaaagtttattttttagcctttgcttttagatcgttcagaacacatatataaaaagttttattcacaatttatttttcatttgcaagtatgtcatttggctttttcctcgaataagcgaaacaatggactgatgacaccttgcaagacaaagggaaaatatatagtgcaaacccacacatatagtgtaaacctaaaaactaccgtagtatccacgtcacctcatgtttaaatatgggagtaaaaattttagtcaaggtcgtaacgtgaacaaatctcatacgtctatttttaaatcatatgataggttacaggtttgcactacatcttataaaccgatttcagggtccgatcccagacgttccattgggccacgtgtcatcgtgtgttgcgctcagtcgagattctcggaaggagaaggtgccacgtattcgcacccctcacacagccgttagatgagaaatcaacgttagaggagggggtgatagcaactcgatttacgtggactgctccgcctggacatgcaccacctgggggagggagaggcgacgccggcggagggggatggaagcccccttgcgcctcctcgatgtgctcgagccggccgcctcctcgcttcaggggatgtcgatcgagggcgagagtggaggggagaggaggctgagctcggcaaggagctgacgctgatagccagcgacggatggagcagttgaccggcgggtggatttgctcgtcatcgccgccatcctgcgccgcgggaggttgctcccactggtccctgtgcctgccgctcatgcgctcctgatggttcattcccgtctctgcttgtggacttgtgattatgggattggaaacgaatggtcgtggcctggtggaaaacgctgctcgttcctaacatgcgcagcagtagtactctgatctgcgttccttttcctttttttttcttttctcatttaaggctgcattaagatgacaaatatagtactatctatatataaaaaagacatatcagatgcccctatattacttataacctattggttgccctaataactcaaagttaaagctaaaattaaaattttcaaacttaattttgaagttgattttaagatattttcaacgttgtttctatttcagtattaacttttaagtcactaacatacatctataaaagctttaattaaaaaattatttttattttaaataagccgttttgatttattagggaatatggataaccgatgagtacattaatctatgttcgacagtgtgagaaggtgaaaagaaaatcttgctttccgcacgcatgctacccgaaccgattgatgacgtatgttttctcaaaagaaaaatttataggaaatttacataaagaacatatccattttcttgatttaaaatattaatcatcattaatcatacgctaatgacttaattttgtgtatcatatcatggttctcttttctcatttactcaaacacactttaagtggtagttattttgggataaattttaaacctaaaagggagaattttttgaacgcatggagtaaattagaatgcaaagtgggctcgcagggtatctatgtaattaattttctcatctatgggttccatagtaaaaaaaatgataaatcgtgtgatttttgcaaataaaaataatagtaaaattcaccttgggctacttttttttatcaccggcgtttcaaagcactttgaatcaccctttaactaattttttcacttttgatcagatacttttaccttagcattttgtaccatccttagttgttttatccatatacatctaaactgtcatatatcaaagaaacaatctatatacaatcaagggagtttattgacgaataagagcataagtactcaaggtcattcatatgcatgaaaagagagtaacaaaggcaatattacccgatccaaagtgaaaacatttggttaaaggatgatcaaatgccaaatatcggtaataaaagatgacccaaagtaaaatttactccaaaaaatttttctagaaaagtgatcttacaagcatattaatccattttcatgtttgaaataattaatacccattaattatacgctgatgacttatctcattttgtgcatcttatcattcttctcttttctccttcactcaaataagcactattatttattttaggataatttttaatttggtgatggagggagtaaactagaatgtgaatatcgaagatttgttaattatatcgaagatttgctaaatggtattgcatgtgaagcgtttacatagttggccaaataaaacattctgcatactaccacattaatattttctacttgcttatattttttgccagtttttatttatctaagtgtaatatgtttgtcaagaaataaacatttccagaattttttcccaaatggaaatattcccaaacagaatttttttcaaaaagaaatatcacaaatatcaccgattattgtcgcttcgttcatttttactccatctcatatatataagaaatcaagctaattctaaataactctacaacatttttatatcctaaaaagtataaatattcacaaggtatttttagttggtgcgccaaaggcgcacccattttctagtattttcctgacatagagtcatgcttcgatagaaatgatattaattacagttcacaaatgttcttccccctgttgtatgcccttgcccttggtgtaagcaacaatggttgaaatgtttatacataatgatggactctatggggtagataattaatctcaaacaacaaagtaggtatataatcgtccaacaatgtaaaaatgtggaaggagaaaatcatgaatttaggctgaggctagtttgcttcccacagtatcagcgacaaacgcatatcgtgccttgcgcatgatctgtgacaagatctcactggtattgtgttttttcttcgaaaataagtactccctccggtttcattttaattgacgctttggacaatggcacgctctacaaaatatacctttgaccttatttttctattataatatataaataaataaatacatgcttatgttttgaaacaaatctttatatgtttttctagtttctttaaactaaatatttttaaagttattgatggttaaaattataaaagtttaacctcaaccttgtctaaaacgtcaattaatatagaaggagtactatgtaaatgacaaaatggccaataattaatcacgcctcaccataataaccagcaaattttcattggcagcaacatgttctgttgctccggtatgatagaatccaaagtggctacgatagaattccagactcctgcaagtactatactttgtctttcatccaagccaattgggatgcccattcacgctattttttttccaagtcgataacaccatcaatagataggcgccaacccggcgataggagcattgctgcccgtgcacaaccgtctgcatattaatcgatgacgtttctctctcattgtactctctctctccgccacctagatataaaatccaacacaaggttactattagccggtgattatttgttattgtacttgctcttaagacgaagattaagtacgggcacgtaaaataataaagtcattaacgtatgattaattaaactttatttactacaaacctgagaggatttatttgatattttagaacaacttctatatagaaagttttcataggaaatacattgtttattagtttgaaaagtatgctaataaaaatcgagatggaatctgtatcttaatcgaaaaataacagggcagtccttatacacttatttgtcagatacttcctctgttttattttttaagactttctagcattgcccatcctagaaagttttataacctgaaacagagggagtatgtcataattaaagtatttctaccattctttgattaagagagctagcggtagttacttttctgagcaattttaccatccaacatttggcactttcaggtatcacattttgcacactaaaattcggtacacctgaagatagtacgtcctaagtatcttgaggtacaaaattttacactagaaagtatctcaagataccaaaaatttgtggtacctcgagttacgaaatgttggattgtaaaattctatatttttctcgttaattccatcgggtccaaggacacgaagaagtttgcacgttataaatctaccagttgttcaacaaggccgatataacaattcaatgtttatacacatagggcccgtttagttccctaaaatattttcccaaaaacatcacatcaaatctttggacacatgcataaagtattaaatatagataaaaagaaaaactaattgcacagttatgggagaaatcgcgagacgaatcttttaagcctaattagtccgtgattagccttaagtgctacagtaacccacaagtgctaatgacggcttaattagtctcaaaagattcgtctcgtggtttccaggcgagttctgaaattagttttttcattcgtgtccgaaaaccccttccgacatccggtcaaacattcgatgtgacacttaaaaatttccttttctccaactaaacacacccatagcaagtactacctccgtcccaaaataactgcagccgtggaaatacgtgtccaacgtttgaccgtccgtcttatttgaaaaatttataattttttttaaaaaaattagccacacataaagtactattcatattttatcatctaataacaataaaaataataattataaaaaaatttcaaataaaacgaacggtcaaacgttggagatgaatagtgcaaaactgcacttattttgggacggagggagtaataccataaaaattaaccttaggccctaccacaccattagagcaatgatgacatgtactcctacacctacatatccaccaatagggtgattttgccagcattgatagcttgcagcgctgaactcggaaacatgtgcaagcaagcaacgaggcgcgacgtgtgtgcctcaacggttggaacggtttcgtcgtcttcgtgcattttatattacccaacctaggcagtttagattctgccagggcccaggatgatgatgcttgtttcgatgttgccaaacatatggccatccagttgcatttcaccggcgattcttgtgtgactggtgaaaggaccaatccgagttatgggccgggctatccaactcctgatgcctcctaattctactcaatctgttcaaacatggatataaaccagaatagcacattccatggcagcaagtagcaacatgttctgttgctccactccagccctttctatagttatgaagtcttatacagaacgtgatgacagcattcctcattccagacacctcccaatcctatttgactacatatgcctatatactttatccggttcagttccaagattgatcggagtaattaaattacctttcaagattagagtaatccatggtctaataatatattgcttggactagctagactcatcaaagagaagtaaaaatagcatataccaatagcatgggggtatgattctatatattactggtggagaaactgtttttactcccgatttataactctcctatagttccggtttcctaaccgggactacgaatccgggactaatgatcgctatctttagtcccgggcgaaataaccgggagtaaagatctatctttagtcccggttgataacaccaaccaggactaaagagagggataccaaccgggactaaagagaggatagggacaatcccggatggtctttttttttttgttactttcttattttctcccgaatcggatggcatgcacatcccaaatcaaaccccaaatcccaaataaagtaacatctcaaatccacatcacaaatcccaaatccacatcacaaatcttaaagttacttatacacacaaatctaaaacatcacaaatcctaaaaaaatttacacacaaatcaaatacatcacagattatacatctcaaatccatacaatgaatcacaaaattacatctcagtgaatcacaaaatatcaaaaaaaaagagatggtcgtctgggccgcacgcctatgcgtccgtccgtccaccgcgtccgcgtggcgcgacctcatcagcggcctcatccgtctccaggggagggaggaggaagggaaaggaaggagtagcggcctcatccgtctccaggggagggaggaggaagggaaggggaaggaaggaggaagaggaggagaggggagggggggagaagagaggaggatcgatctgtgggtgaggaagtggttgtgattgtgaaggagaggataaggaataaggattatatgctatgttgaattttagtcccggttgatatttccaaccgggactaaagatctaaatgatctttactcccggttggtactaccaaccagaactaaagtggtaatctttagtcccggttggtagtatccaccgggagtaaagatcctcggccccctgacatgcctctgacagaggatgaaccgggactaaaaatcatctttagtctcggttaccaaccgggattaaagatcaaaatttttttaaccgggactaaaaatcgtttttaatcccggtttttaatgaaaccaggattattgtagaatttggtcgaccgaccaaagatgattttttcaccagtgtatgcatcccttgattaagtatatctagaattttcatgatgcgaaggagtcatatctttcctaaggagacaatggactgatgacacctcgcaggacacacaagggaaaatatacggtgcaagccccctatacagtgtaaacctaaaaactacagtagtatccaaaaatgaaagactgtgatttgtccacgtcacctcatggttaaatctgggagtaaaaattttagtcaaggtaacatgaacaaatctcaaacgtccatttttagatcatatggtaggtgacaagtttgcactaaatatttttctgacatattatcatgcttcgatagaaatgataataattaaagttcacaaatgttcttccccctgttgaatgttgatgcccttggtgtaagcaacaatggttgaaatgtttatacataatgatggactctatgggtaaataattaatctcagacaacaaagtaagtatataatcgtccaacaaattaaagtaaaaatgtggaaggagaaaataatggatttaggccgaggcttgtcattcgcatgatatgtgacaaaatctcactaatgtcgtgctgatccaacctctatttttcgtcagaaacaagtactatgtaaatgacaaaatgaccatgaatcacgcctcaccataaccaagcaaattttcattggcagcaacatattctgttgctccggtcctctccttagcgacgaagtctagcaatctaatgtggctatgatagaattccagacacctccaagtcctattgacactatactatgctttatctccacttcagtctcgagattgacaggaaattaaaatttctatcaaagcctagagtaatgcatggtgtatgtatatattgcttcacctagctagtccaatcaaagagggaagtaatagcatatgtcaatagtaattgaaatatttgaagtactatttgtgtgattctgtctagtggtttttgcacatgcaaagtgtactatggcttggtcggattgacaagcacgcctctgaaggtaaagcacatacattttcttgtttgatccacttttgtgttgaatactagtggatccctagttttatgcttagagcaagaataataatcactgccatctcacttagccatgctctaaaagctcacctgtataatgggttggctataagctgactgatacattacctaattgaaacatctaagcaattaatatatgcatatgcaaagcatccgttgtggctacatctctatggccatttcagtgaacaccatttcatcagtcaaagtatatcccgatgaataacagattaacataatactgagaaacaaagatggctgattaattcgagctctatagcatagattgcctccaagcaacattattcatcttaatacctagatgacaaataacttatgacaaatagcatgtcgggtcccaaaactaatgattcagtaaccgacatgtttagactatatcaagctctggatcagtagattgatacaggttcaacaatctggatattcattgcatacattttaacatggctccaaaggagatgttattataaaataataggacatatcaagtttgtggctaactattacattagaagctataggttgacccaattctaatattttgctatagacttaaaccaactaactatactagacttgaagacttggtttaaagggaactaacttatatgattgaactcccggcttcggcaagaacatcgaattgactctgaaagaaggggttgaagtaagggtgagtacaacgtactcagcaagctattatattaatcaataatgaatggatgaaatggtagtatttgagtagagctaagtttacttgcagaaggctaggaatatagaggaagaaagcctgtaatgttttagatgcaataatatttaataaagtttgaaattaagtttctaaccaaataccatatgagtcccaatgctcaaatccgtgagcacggctattcgaataaattcatttatactttactgcagtaaatgtacgctttacccacagcccacgacttgccgataatcatcagcttcagtcatagcctagtattaggttactaacaatagtggcacctgttccatgaactcttatccccatacgctctgaaagtacgttatcagtagcgtgaggagttctggtgttctcggggtatttagagaggactgattgtatgacaccatgtcatcacaatcagggtttccaaacaagtcatatatgacatcataattaatctcacacaaatatttacctacgcctcggtaaatatcacaatattgccctgctcggcaaaagtttgcctcctgcgcgaggacttaaacatagaaccactgtacataggtaccacattgttaaataacataatatctaggtctgtgcccatcctagaactgtggtcgtactcgtttgtttttcataagtacttgggcagtcttatgtcagttggaacaatactagccactcggaaatcaaccatttctaccgtactgtcccaatctaagttcattatattttatgcagtctaactaggcagggctaagcaaaagctagcatatatctggtttgttgtatgttcaggttatgcattcaaaatcatggatgactaatgcatagaatagagatatagaatataggataattatgctcaagggaaggaataataacttgccttgctccaacgcaaataaatccgagataggcagcctgtttatctgatgcttgaaataccataggttgccatccaaatataatagactctactgaaaaagaggaagaaccaaattcaatgaaagccataaaagcaagaaagagataaatggttaggagggctagggtttagggtatagcctatctcttttatagggtatatggattactgggctgatattttatgtggagattctagagagttggaggctagacgtgcgccgtgcgtatcactatttttcttttttttctttttctaaaatctaatatatatggtgaccggtcgctcttttttttttgtggtcccacccattagatccgccggtgctaggaagcttacagaagacctagtagtatgacttatacgctccacccgaggggtagtctacagacggtctagtaccagataagactctaagtgaaacttgcttgcataagacttgcaattcaaggcgtagtccattgttcaagttgtgagtaagtgtagcttggagttctaaatagatgttcaaccttaatcggtctccatcgaaccgctggtatataaacggtacattggaaaaggcaaatctcagtgggattttgagatttggtgggggattgttggaattaattgatgggctaaggcccactcagagattaattctttggaaaatcacaaaagcccacctcatgggatggcatacatgtcgagtttagtaccaccttgcttattctagaagagggagacatccttaaaagggaggatgccctcctatccacttgaagcatgtgtggtggagagaagagggagaacacacgcccgcgctcgttcgcctggcctggcaggcggcgcgcgtgcacgtcgaatggtccgcaaaattggctcctcacccttgcgcagatgtagccttcttttgcagttttgttttgctgcaggaaattcgtatttgttttgttttggaaacattccgaaaaatccggtgcgtgaaaacggcgtggagtccggataagttacgcgtgacttatctggttcggttacgtggagtggagatcatgtgggtgccctgatcaagcgacctatctttatataaaccgagccgccgccttcacgcaagacacgcgaaatcaatctagtgtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgttcgtccgcaacggctcgccttcctcttcgctcgcgtgctgcgcgccttcgtcgacgctcgcaaccgcaagtagttcctgccgagcaaccagtttttccgtcacctcggtacgtgttcgacatgttgcgcatatttgatatgttcatgttttactgcttagtttacatgtgtagatctaataatgcgttcaggctagtttacatttgcaatgtcatgatttatttatggattaaattaaatcattatgtgccttatgatttcaacacaatatagtcttccgtctgggcgctatctttgtcgctcttg

SEQ ID NO: 69517 - DNA, 1038 bp, Oryza sativa
tttttttatggatagtcggtgctccccaatcagttaggcaagcccaagacagatttgttaggtctcttcaaacagtacatagtaagttcaatgcagttttgaccgctctactgaaacttgcacaagatatcattaggccaaaagatcccttattcacaacagtccataagaaattgctttctcctcagtacacaccatatttggataattgcattggagcaatagatggtactcacatccaagttgtggtgccaaattcagctgctgttcaacataggaatagacatcaggagaagagtcagaatgttatgtgtgtctgtgacttcgatatgagatttactttcgtgcttgctgggtggcctggttcggttcatgacatgagggtattcaatgatgcacaaactagatttagtgccaagtttccaaagccacctctaggaaagttttatctcgtagactcgggatacccaaataggccgggttatctagcaccatacaagggtataacatatcatttccacgagtacaacgaaagcacattgccaaggggaagaagggagcactttaattactgccattcttcgtgtcggaatgtcattgagaggtcatttggggtcttgaagaacaagtggaggattttgtttagtttaccaagctactcgcaggaaaagcaaagcagaattatccatgcatgcatagcacttcataatttcattagagacagtcaaatggctgatacagagttcgacaattgtgaccatgatgaaaattatgatccattgggtggaacctcttctccatctagcgaaccaacaaacgaattggactcgcgtgtcatgaaccaatttcgggactggattgccgatggattgtggtatttgaaaggaatgtaatgaatggttcaatttttcttgtgaattgtatttggtttaacttgtcaattgaaccatgagtgcttgtaatttctaacattgaaacttctgtgatgtatttgaacaacttgagatgtatatgagcttctttgaatttctgtgattg

SEQ ID NO: 69518 - DNA, 2488 bp, Oryza sativa
gctcatccaactagaactgaacgagaactgaactttttagaccggttcgagaacacaaaccagtcatcaattatggcaaaattgcatgaccattctaattatcatcttagttttgagatttcaccttataacctattttattgcaagaactcacccacccaacgttatccagtcgaaattgtttcctttgcgcatatgagaagttaatttgtcggcccactttaacgctcggtcgctccgccttcgggggcgacgcgggcagcgaaacaggccgcgccgctcccgaccccctcctcccctcccccacctcgccgctgcccgagccaccgccggcaaagccaggcggctgcaaggacggcggcggcggggctctcttccctcgctcgcagtcaagctggttagggcgccggcaagacggagctcagggcaaggcgccggcgccgaggagaaaccgacggcggcgtccagatccggcgctgggatgcatggatccgaccccccccccccatggctggatttgttgctccgggcggcggactgccggggacggcgagtgggcggcgcggaggtggcagtgtcggtggctggagtggcggcgtggcggaggaggcagcggcatggccatgtctgcagtggcaggcggtggccgtggccagatctgatcggtcggctggcgctggaggtggctgcggtggcggcggcggctgcggtgccggcggcgtctgcggtggctggtgacgacggcgacagctgaggcagctgctacggcggttggcgacggcgacgactgcgctggctggtggcgacggtgacggctgaggcagctgctgcggtggttggcgaagacagcgacggtcgaggcagccgcggcagggaccatgcggcagcggctcaagcagccgcacctgtcgtggcggctgcacgcggtgtcggcctgctgcggcgggagaccggatcccctccgttgaactgctgtggcggttggcgacgaggcggcggcttgcggcgacaacggctggctacggacagttggagacggcggctggctcgtagctgccgcggctgtggaggcagcgtctggcggccggggacattggcggatgcgacaacgtctggcggcgtcgtatagatgatcgacggcggcagcaagtggaggcgtgacggtgggaggcatggcggtcttcgacggctagccaggggcgtggaagacgagcgcacctggacggcgcagcagcgatcggaggagggtcgggggtcagcttggcacagagagtcgcagccgatgacaggagaccggattggcgcgagaggcgcgtccggtggaggaggccggcacggcgcgagaggcgctgccgacggcgacggaggacggcttggcgcgagaggcgcggccgatggagggaggccggattggcgcgagaggtgcatccggtggaggaggccggcttggcgcgagaggcgtagccgacggtgggggaggtgacctcggtgtgaggaggagctgccggtgggtgtggtgcggtcttcgacgcaccaaggctgaccggcgagggacgccggtgcaggggtcccacatgtcggcagagcttgagtgatggtggagcatcggtgcgtcagccgtggattcgcaggtggtgagcggcaggtgaaaacccagctcggctgtagctgaaccgacaatgatggttcattccccctcctgagggcgttgtcgtgctgtctcacccctcaagggcggttgtctggcaaaagcccagtcttgacttctttgagccctgacggatggcggcggcggttcttccgtcgcttctcttcctgaagacatcattttggcatcctctagggggcgatctcgtctatgttcctttgttggtctagcggcggtcggtcacgcttagcggcggccggttcggtgctagccttctcccgggtgtgtgtgtgtgttggcgctgtcggtgtgtgggcggtggtattttttttctttttgctggttatgatcctccagggttgtaatcttgtaattttttcctgctctatcaatagaacttcgcaccgtctcgtgcgagtcgttcaaaaaagaagttaatttgtcccatttcttttgacgtagattcgcagcgggtcatatcacctaggttaggcccgtccagtgtgcctataaggtgagcccgactcgagagagctcttaggctattttttttgactcgatattaggtgaaggacttgcttgctatgagttgtaagcaacatcattcttaggtgatgacaagttctagttggactcatcacataaccacgctggacaagcttgacctgcctgatatggccctcgtggatcgacattagaagaaactagtaatcgcaatgcacgtttcccacattagctatagtgataatataaaacacttaaatttttttgcacttttcatgtaatatatgtcacacaaaatatacaaacatactaaaagttattatagtaacttaacat

SEQ ID NO: 69519 - DNA, 1212 bp, Oryza sativa
ctgaatttcagtgaagttttggagttgagtggacactgacagcatgaatctcagcataatatcagatattcacctgaatttctggcagcattgcatccccaaatgagaatgctattgtgcccagtgcattgaaggctctgaagatctttgatgcagcgcttccttgcagactgtaatcaacttccttccgatcaatccgatgccctgcattaggaaattcattctgttcattcttccacatcttcaatttccagaaatcttcagtctgaaaagtgaagatatgaccagattttaccatcataaatggtgacaccaatggctgtccctgcaaatccaatggtgctagcggtgcaggcagcattgacccaccggagtgagtggatgtcaggaagctgggagagtaacagctcgaatgcgccgaagagaatgatgaactgttgcagggtcatggcgccatcatcagtggtgtggtagtgcttgtacacagccttgaggctgctcccagctgcaatctggattgcaatgttgtttccaattgatgccacttgctggaagaacgacacataccagtaaccccagggaccttcagacaaaagcacagatttttaccatcacttgaggtaaatttgcaacaatttctgcactgctaagtatattactgttacaagtagatcatcaaaagtaaatatttatggtgaagaatctgtaatcccatttactatcgtttggcaactcttttcctgctaggctgctactcagaaatcttcttgtgacacagtacagtaagatcaaaagtacaattttgtcgtgacaaaaaaaatggtgatgagtactaaccaaagatgctctttgcaagaagcttgtagctggtgtgcttgtctccattccactgccacagtgaggcaacaaccaggctagaacaccatgtaactagtgttcctgtgaccaagctacaaacacctgtgctcaaacaacagttagctaattacaaattactcaaatcaaacagaagaaaaaatcatgcatgcatatgaactgagaaactttctgttcatggcatttcaggcaacagagcaggagaagctcaaatatcagagaatccatggagaggatgaaacaggatgagtaaagaagcaccaaccaagaggccagccaagggaggcaagagcaaacgggaggggagcataggccgccggcgtggcgatcgtcgtc

SEQ ID NO: 69520 - DNA, 1335 bp, Oryza sativa
ctaaataaaaatagagggagtaccatttatgtaccatacattttaagacaaacagacttcgtgtaccaatcagttcatacagaagccatgttcgaatcaataacgaaatatgaatgttcacctacacatcattagagatcactgtcctctcctcctccctgtcaaactcttttcctttgaaaaccaaggagaccaccatttcctttttgtgcagtactttgtacgagtactgatgggattaaccggataatatagacatatcacaataattaattctagtgtaaatgtgtaatgctgaatgcttgaaatttaataaacttttcttggaaggtttttggtaccgccacagctgaaataatttctcaagtatgttcaacattgtggttggaaagcagtactatagcgctatcttggagaaaaaaaaattcagcaacagttttggacgcatatatacatagcatgtcagagttaattaattaagtttctggtagtggtgaggaaatatatagttatgataattcctagggattctaccgttttctcagcaactttcgagatggactttgtaggattcgatttattcttgtaagcatttcctgtatgcatgttacattttgataagtactgaagaaatggttatgaatattccagtacaactcaatcaatttctctcatttattcaaaggattatttaaccttttcaaacaacatcgtgcccttcaaaggacccttgattatcaaaattccttgaccaattcatccatatatcacttatatttttcactattcatagacaatcacccattgtgaagttaagaacctcccaaatagcttcaggatgccatcattttagctcttttaattttggaaagatttcaaccattagcttaaaaatcatgtgaagtattctcttaaggaaaaagtacgaattacccccgaactatcgcggtcgaccgaattaccccttgaacctaaaaaccagactttgcttaccccgaacttttaataccggacgaattaccctcctcgacccaatccaaagctgttttgtcctacgtggcgtacatgtagcaatctagtcaacattttctttaaataaaatggtgggacccacatgccattactcctcctcccctctactctctctctcgctctctctctctctctcaggcgtgcgtggactagcagtgggcggtggcggcggcgcgtggggaacggacgtgcggtcagcggcggaagagcgtgtggatggcgcgatgggcggcgggcagcgccgaggagggtgttggaggaggcaggcagggccgaggatgagctccgcgtcaacggcgatga

SEQ ID NO: 69521 - DNA, 7475 bp, Oryza sativa
atccgcctctaccgccggccaccatctcctccttctctagccatagacgcaaagcaagagagagagggtgagagaagggaagcagggggaatgggattagggagggattggtgtgaggaaagagatgacatgtgggcctagatatttttttatgttttattttgctgactagatgccatgttggtggccaagtatgcagattgaagtcaaaaccgtccaaaacagtgttcgggggattatttccggtataaatagttcaaggtaaacgatgtctggtcttttagtttaggagggtaattcggttgattgctatagttagtggggaattcgtacttttaattaccttctcttagcaagttcaaacactatcacaggaatacctatcactgtcgactcattgttgtgggttccattagaaccgacagtgataaatggattcggggtaaaaagaaatcgatttgtaacagtcgagcaacactgtcgattacttattgtcggatcaactataggtctttcatctggcagtgttggaggtttatgtgatagtgaaagcacacgaatttctttctcttcccccttttgttatgctttaggacacatcccttgaaaactttcctcaatttctcaaatggagcatataagcatatctttttgggagcattcctcaatacctacaacatactactctaatgctctcacctaatactccgtcttcatctgctacatcgccaacagacttttaattataccatttctgaatattttttccacttactctacgtgttatatatgacaaacagtcttcgtgtacccatcagttcacccaagagagcctcatatccatgacgaaacatgaatgattcacctacacttcataagagaccgctgttcaccactgtcctctccctatgcctctctcaagtcctttttctttgagaaccaaagagaccattactaaaatgtgggttaattggatccatgccattgcaactttaccaaatttataaaatgacactactatttgtcatatcggctatatgccactggaagtttctaaaattggaaccatgccactccagccaccttttccgtcctcctctctcacgccgtctctgttcccgtcctcatccccctatggtgcatgcatgcagtttttgttactgcattcatcaattttgttaccgaagtaaatgtactacgaaagagtttttacttctattggtctcgatgcactcatgttatgtgtgatcaactggaacaaagccacagaggaagtatgacaataatgtttaacaaaaattataacattgtaggagtacttacaaagaaaaagcaacacatctggttttaatgttttcaaatcaaatatgttgagaactattcagggtcagtttttgaaagtttgatccaaaaaaccatcggacttgctaaaaatatgatgccacagtttttactaaattttagtcactgttttccacagaggaaataggaaagatactggcatatttaaatacagagagtagttagtttttatacatccattagttattaaaaacacatatccatccatgacaaggtgtctcttgtaacttcactgatcccaaaatatattgtcatggtctctcttagagatgctcgtaaagacaaggtgtatatttatatgaacaagtatacccgtatgtatataaacgcttacgtttgtatcatattttcttaaaaaaaaaataacgaaacatgaatgattcacctacacttaattaggagaccactgtcctcctcccctctctcaactccttgcctttgaaaaccaaggtgaccaccattttcttttttttttctttttgcagtactttgtaccagtaattaatcaactaactaatcatgggattaaccaaaactaattcttgtgtaaatgtagtgtgcaatgcccagctgccccttacctctcaccaaccaaccatatgtttcgcccactcacacacactgacactgccacctcactctccactccactatatataccctcgctcgcgcgcgcgcactccactcgcgcactcgcgctcgctcgcacgaacgcacgcacgcacgcacgcacgacgcgcggcgcggcgcggcgaggcgaggctagctcaattggcggcgatggaggcggtggcggaggcggtggcggcggcggtggcggccggggtggagccgttcccggcggtggacaagtgcgacgcgtcggggcgggaggcgcacgcggtggcggccgacctggaggggacgctgctccggtcgcggagcgcgttcccgtactacgcgctcgtggcgttcgagtgtggcggcgtgccgcggctggcgctgctgctgctgctggccccgctggcggcggcgctccgggcggcggtgtcggaggcggcggcggtgcgggtgctggtgttcgcggcgacggccggggcgcgggtgcgggagatcgagtccgcggcgcgcgccgtgctgccgaggttatacgccgccgacgtgcacccgggcgcgtggcgcgtgttcgcggcgtgcgcgcgccgccgcgtcgtgctcacggccacgccccgcgtcatggcggagccgttcctcgtcgactgcctcggcgccgacgccgtcgcgggcaccgagctcgccacgtggcgcggccgcgccacgggcctcgtcgacgaccgccgcggcggcgtcctcgtcggccgccgcaaggcgcaggcgctcctcgacatgttcgccggcggcgacgtcccggacgtcggcctcggcgaccgccgctccgactacccgttcatgagcctctgcaaggtactttacaaatataatttaaccattcttttttggaagtaattacaattaatcctctccattaatttttactaccattctatcagcatccgtactgcaccggccgcatgtacgtacttaagtaattaaatctataataactggataattacagtgacttatcagtatcacactgatcacaccgggtaaccgtgcttttggaacagttttaaacaagagaactttttaaccaaattttacaaaacttattaaacgaatttcatgcattaccaagttgataactacttaaatctttatttgcatgcatactgtcattatcaatggcgacatgttgacaaactctcaacaggagcatgcatagccctcttataaaattcgcaaaaacaaaaaaaactactctgcatgatcttccatgctctatgatcatctccatcatgtaacacaattagttacatcaattctttaaaaaaaataaaatttaacaggtgaaatttttaggaaaaacaacacgattagtagaagtacatgctactgtgtgacatgccaaattaagatgcaaaatcagttgctggccggggtccgtacgagtgataagagggcaccactgcatgatgaatctggatggactggtgtggtaccgaatcgcattgcatctcgcatgtgttgtggcagcagctagatagttagaattggtactagcctttttttttcacatttcattttttttctcttttgtgcatgtgcaacaattaattggagatataggagtactgttggcactgtagtggctccagtatagagaggagatgaggaggaaattggttaaaaacaaagttgtgggtgtatagggttttaaaatccggggataattcacggagcgtgaaaaactggctttgagaaaagaagttgcgagtaggtttttagaaatctggggataattcacgaaacgtggaaaatggtgcaagagtcactcaattgttttggaattttctttgtgtttcttgatggttttcaaacatggccatctggaaatcactccatattattcagttctatgaaaatagtagtcagctagttcttgcgtgagagttttttagcccaaaatagctatctagcctcgtgacgaaaaataaaaataactttacaccacatatacacattaattagttagaaattgttgctcaacctacttgaattgagaagaaaaagatccggccgcagacaagaaatggaaggctttttcttttcgtgttgtccttgctgtacttatcaaatcatcacacataactaaacggctaattaattagcgatcgatcgatgggttcggttggctcacatcttcagctcagcaagtaaatttaagtgcgtgctggttaaggacccgacacgccgtctacccatatttattaattcaatctcatctacatctccagctcgatttcttggtggttaggtcggttaaacactttaattacaacccccccaaatgtggttaacaaattgctccaaaaaagggttatctttttcgtacaagatttgtttgtaaatggatggggtcacacgagtagggtgtgtgtcttgcaaggtttgcttagcttagccctctgtttttagtattaaatcgcagcacacacacgcagttgcaatgctgtagctgcttttaggtgcaaccaggtaggtaaaccggttcatatatggccataggcagctgtcatgacaaaaaaaaattggcatttcttcgctctagacacaattcctgtgttccaaataagccctaacaatcgagaatttagccatttctaacaagtctccgagagttggaaactacagtgcatagaatgtgaattctgaacacgtgtttttataacaatattaatcattttcttttttcaaacacaactctgtgtatatatatatttaataagaacacaaaaaaaaagaggaaaatggaaccataatgaatccagattggatgtgtggggcttatggcacggcatgatgagatgctggctgtgatgtgagagcctctttaattctgttttttggtagtactgtgctgtaataataatccttgcgagttaatgcgggcattggttggctgatgccttgtcctgcgacgtcgtgcatggcgtggcgtggcgtggcgtggcgtgacatggcaggaagggtacatcgtgccgcgctcgccggcggtggaggcggtgcccatggacaagctgccgcggccggtgatcttccacgacggccgcctcgcgcggcggccgactccgctggcggcgctgctcgccgtgctctggttccccgtggggttcgcgctggcgtgcgtccgcatcgcggcgggcgcgctgctgccgatgccgtgggtgtactacgcgttctgggcgctgggcgtgcgcgtcgtggtgcgcggcgcgccgccgccgcgcgcggagcgcgccgcggggcgccgcggggtgctcttcgcctgctcccaccgtacgctgctcgacccgatcttcctctcggcggcgctcggccgccccgtggccgccgtcacctactcgctgtcgcggctgtcggagttcctgtcgccgatcaggacggtgcggctgacgcgggaccgcgccgccgacgccgccatgatcggcgagctcctcgacgagggcgacctggcgatctgccccgaggggacgacgtgccgggagccgttcctgctgcggttctcggcgctgttcgcggagctcaccgacgaggtggtgccggtggcgatggagagccggatgggcatgttccacggcacgacggcgagggggtggaaggggatggaccccttctacttcttcatgaaccccagcccggcgtacgtcgtcacgttcctcggcaagctgccgccggagcacacctgcggcgccggcggcaggtccagccacgaggtggccaactacatccagaggctcatcgccgccacgctctcctacgagtgcaccagcctcaccaggaaggacaagtacagggcgctcgccggcaacgacggcgtcgtcgacaacgccaccggcaagctgccatcgccggcgacggcgacggcgaacaacagcaaggacaaagcttgctaggagaagggaaaaaaaagggggaagtggatgttctagtagtgtaaaactataatgttattaatttttacctgtgtcgatttgcatggggcggtaaatttcctctttcttttggttatttgtactgtgtatgcacttgcaatgtaccaacggggagttgaatgcaatttgcataagtaaaagcaatgggccaggacaagcaaactattcttgtgagtcagaaactcagaagcatgcatctttctgcaggcaacagctaagaacataaaagcaaatttatttggtttggtagattgggtatcacacattacacataggccagggcataggtgttccattcgattcggcaactgaacaacaacccaacaagtaaaacgacaccagacattattgatatatacatactacgagtctacttatcaaatctggtccagatcaattgagttgtctctcgtttttgtaaattgcaagcaaccagtttcaccagaagaataactttcctttccaagaagaaaagcaatcgattgccacagaaagtgaagcaaagaagagtgtacaatccgtggtcgtagattccattgcttcagctaaaatgagtaactagcctcgagcttgaacaatgaacagaaacaagagtctggctataatttttctaggtgcatataggcgaaatggatcttagtacatcttaactccttccaggttacacatgctatgctcagtcctatatacacccggtaccgcggcaacaattatcgagggcgtgctgctatgtatcacaagggtggatcagtaacttactgtgcacacacattgcagctcttccggcagaagccaggtgcttcattggtacccaccatgtagttcggattcttggcacactcccctactgcagcccactgggggcagaggacgttctcatcctcgcacccgtcagtggaagctccctgcttgacagagatgtcgaaggacctcacatggatccatttagttgcggaccacttctgaccttcaatgaccgggcagctcccgtgcaggctgtcagagtctgttgttgcatcggggtggagactgaagaacagaagggcatcaccctttaccggttttactgaagaggagaaccaacagttaaacagctgattaaataatgatcataatggaaggtataactcatatatgcacggctaagacaacatgctgagtgctaagcccacagaatttatcagctgacaaggaacatacatagttctgcattatttaatatctggttttagaagcaaagtaacttaaaattctattacaggcaattcactatacctgcatatccatttttagcacagtcagaccatgtatcatccttgggttgtaataacttcccctaaaaaaaatagtcgagttactgcaagggaaatccaagtggctaacactgtagaaagttaaagaggacaggtaaactacctctgcttctggaaagatggtctctccccccttcccaacgtctgaaaggtacatgagcacagtggcgatccgatgtcctccaagagcttgattatttttgtcatggaagtaatcatagtgtgg

SEQ ID NO: 69522 - DNA, 3436 bp, Oryza sativa
ctttaatgccaaaaaaaaccttaccaaattttagcattaccaaaatttcagtatagttgccaaaattttggcaggattttttatatagctaccaaaatttgacagcaaactaaatgtagccacttttttagcaactttactaaaatttggtaaggttgaaaatggcatcaaagtaaacaggccctacatcttttgtgcccctatttggttggatgcaaaatttgtagattgagacaacacaaaaattcctttattgctactacaactaaagttttaaatatgcaacctcctaaatagaaattgtgcggtctaaaatcatataaacatttcctaatacatttaatttctccttttacttgaatgcagagcgtatgagttcagtttgtatttataagcaccatgtatctgcacaatatatgagatgcatacgtataagatttataatgaatatgtgtacacatggatgtatgccagtctgtatatgtatgtacgtaagtacgtacgtacgtacgtatgtatgtatgcaacctataaccaaatagtttgtgaataatttactatagtttcagttctgatttctactgtgcatgtatacctagcttcgtgacaactaatctacgtatagtttgatcgaaactaaattatcccactcctcaacagatttagtctaactaacaataaatcaatgatgcatatggatatgacttgataaataaatgacaagaaaacgatcgaaatatcatttaagatccataatagaacaacaatcaacatatttataggtcctagccagaatcgtggctcaatcaataccgctctcagccagtgtgatcaagtcatagcgtgattaatactatagctaaatacccaagatgttacaattagagatcttaagggtggaggatttaaaaaagtaataatttaatagagaagatgtcctagttaattgtatgcaaacatgcatgccttatattatggaacacctaaaaaaatagttgtgttttatattatagaatggagggagtatataacaatgatcttgttcactttgatgccattttcaaccttaccaaattttggtaaagttaccaaaaaaagtggctacatttagtttgctaccaaattttggtaactatataagaaattttatcaaaattttggcaaattttgacaactatgccaaaatttggtaaggttttttttggcatcaaagtgaacaagtctaatgttttactaatttttaagtatagagagagatcgcttacatatcaggtacaactgcaaactgcataaagcataaagcataaagtcagttgatcaggtctgtttcctacggccattttctaatgtcatataaactgattcatgcatgcacaaaagactgatcgagagaagtacggagtaggttggaaatttcggacctcggaaatttcggtcatttcagtcaccttcgatacgatattacttcgaccaaaattttttcatgaatttaggtaatatttgttcaaatttaactaaattttgctcaaaattttggaaatttcggaccaaaatttccgaaattttcaaaatttcgggatttcggccctaatacaaagtcctcaaacgacagagtgaaccactacggaccaaaaggaagtcgtacagtaaataaatcaaacggcgaagcaaagcccctcactcagaatataattactcgtcatcagaacagaaaagtaaaaaataaaaaataaacccagttaattaactacagtgaggcctcactccgattttaattattaatttactgcctgcattttcgactcgccgccgatcgagacgtccacttgatcagctactagtagcatgtagggacgccgcgagaacagccactagcagcgccgccatggccgcgccggcggcgaggaggtcgtcgtcgccgcgaggtgggctcgcggcggcgcacatttggacgtaggacgccgccgccgccctcgtgagcgcgccgcccccgccggcgcggaggaaccacggcgactgcagggcggcgagcatccgcggcacgacggtgatcgccgccgcggcgacgaccgccgcggcgcgtgacagcgccgccgccgccgtcgtggccgcggcggggaacaggagtaagtagacgacggcggcggcggcgatcacgagggcggcggaggtggtggtgctgatcacgtcgcgattcttggctagcgacgacgaagctgccattaatttgggagaagagaagcacacacacggggagagattagatcacaggaggtggaggagaattaggccggagaggaggcgattgaggaatggaagatcaaaatgtgcgatgatcgatcgatacgtttgctgcccctcggtgaggcacttaagtagcgatgacgatcaagctcaactcaacgtcagacgcatacctttcaaagttgcaactcataccaactccgtttatttaatatgtgatgtcattgagttttttataaatattttatcattcgattttatttaaaacttttatatagatataaagaatttaagttgggcttaaaaaacatttgacaataaattaagtcagaataaagcaaacgatacttacataaatttttaaaatagaataaatggttaaacgtttaaaataatcaattgtgtcatacgttaaaaacgaaagtggtactccctccgtcccgtaatataagggattttgagtttttgcttgcaacgtttgaccactcattttattcaaaattttttaaaattattatttattttatttgtgacttactttattatttatagtactttaaacacaactttttgttttttatatttgaaaaaaaatttgaataagacgagtggtcaaacgttacaaataaaaactcaaaatcgttatattatattgtaggcaggagggagtaacagctaacgaagacgctcggaaaatatgcttatcattgtattcatcaagtgtcatttatatattatatatatattctagcttcgatcgaccctttgctaattgctatcgacgactagattactcttctggtccatgcttatctttcaaagtaaacaccattaccgtcagatctaacatttttaagctgatagatgcaatgctactgctccgtgtgttaacgtggggggtccaagttcagctatattataaaattttaattcagtcacgttgttgacctgggtcaagttaacgtttagtactttagtagtgtcgttggttgcaattctatcgtgcgtagagtggtggcgggtatatacgtgccggatggatcgccgaaactgcccagcaacggccaaagcttctatccaatcctttcgattttttttctctttgagattagcatgtgttatatatgtcactcttaggagtaccatatcatggtacgtaggttaggtaacaaagaggtgatttgactactct

SEQ ID NO: 69523 - DNA, 2808 bp, Oryza sativa
cgtagagtttttattaatttgtgaaaggatggtagtgtcaatatttagttccagaaaatggtgtattgtatagttggagttagcaagagtaatcgtctagctcatggttttgggaaaggattttggtgttaactattttttcgatcagattatcaaattcaaaactacaagtattttcacccgaatgttgttcgtgaacccgtgaactttattagcttcaaatgtttttattttctgatacaactcacatgctattttattcaccaactttcgttgtttgtagatttgtattactaccatatgaaaactataaacatgtgatataattattattcgtgctatattaaaatttttattataaaggaattacacttaataattatttaacattatcttactgtgtgcttttaaattggtttataacttttacccgttgcaacgcacgggcatctaactagtcaatataaaagttgatgtagacaatatttatataagttccataagaaatctatcaaatccagtgttttaattcgttatagtaattacttaattaattgcatggtaatgtaccaagcttttttttccctttattttttctatggtataggtgaggatataataggcattttaattctactatgcatgcgactatgaaatgccatgtgtacgtacgtgatattctttttacagagaactactgaactttaacaacttattacattcgtcctaaaatatgagcattttagctatgtatctatagataattatttatttagattttgtagctaaaaatatttatattttaaaactgaggaagcacttaattaaccctataacgaaagtgttcgcccgataatgaatgtaaatacgtaatagtacacgtataaatacatactccgtatatagtacatactactcctacttagatacacgcatgccggagtgttactcgtctactcgatacgtctcacatcatatccgtcaagcctgggccacacgatctgcccccgcgccccatctggacggacagaatgtgagcacgtacacctccgcgtagcacctcgccgccgccgtgtcgtacgggtagctgacgtacgccgggcacgcgtcccggaacacccgcgagtacgcgctgccgcggcacgtctccgccgtgccgtgcgcgccgcggcagcagaacgcgtccgtcccgaacgccacgcacgcgctcttgcacgccaccaccgccgccgccgccgtcacctgcagctccggcgggcacaccgcgttgacgttcttggcgcagccggggatgacgcacttgcgatcggcggcggcggcgccgggggtggggggcttcgtccacacggccaccggcaggttgtagccgtcgacgaggctgacgtcgtaggagctccccttgctctggtcctcgtggaggtccacctcgacgagggtggccggaggggcgccggcggtgccgttgcacgcgaggcggccgccgcagtcgccggtgaggcaggacgcggcggcgttgccgtggtggttggtggcggtggaggtgaagttgcagccggtgcggccccagaagcggccgttccaggtgggcggcgcgctgacgcgcctggactggcccggcgggaggaggaagccgccgccggcgagcaccgggtggccggcgttgggcgccgccgccggccacaccgggaacgggcacttgttcaccacgcggaaggtgacgccgcgcacgagcgccaccggtcctgatcatcatccacagcagcacaacaaaattcatggaaattaccaatgctgaaaagtaaattttgccaaaagaaaaagaacgtaggtgggtgtgatttacggtatccatttcatattaaaagaacgtaggttttattctctctctttaacagagtttataaaaatagctagcaatttcagtttcaaataaatcagacatattttattgtagattttaatggaactaatttaatatacaaaagccatggatgtgatctacttcctccgttttacaataagttcaattttcctattctccacatatcaattaaaacctaaaagactaaaatatcttcactttatcaatcctgatacaattattttttgctttatctactcttaatgtatccatctcctaattttacaaactccaatataataatgactaaaaataaatttatttatgataaatcggagggttgaaaagtaaacttattctagaacgaaggagtacctaagagagtaatgagcaggagtagtggtaggggatgaacgccggagagcaaggataagcacgccatctgtgtctaaatctatatagcaaaccagagaaactaactaagctgtcatggagatggtgcagtcgcagagagtaaacaagggtttttataccctgcaagagtctgcaaatacaatgatgccatggctaaggagatagctaagatcaatgagcaatgtgccatgtgtgtgtgtgtgtgtgtgacttgcattgcaatggaagcaaaggaagacatgatttggggtagcaggccagcagccacacctggtgcaggcctgagggcaaaaaggttgagtggtgaggtaggtaaaaaaaaaggatttaaaatggatgtgccacaccacaacttgaaaactgaatttaaaatactgctagttcattgaatttcatcagcccattttggtcatttgggcatgcatcttcccttgaaaacattataggagtactttctattttagactttgagcacagatacacaattatgtctaagcagaatttatcggcccagttgactgggctgcaggaat

SEQ ID NO: 69524 - DNA, 708 bp, Oryza sativa
attcctgcagccccaaagtgttggagcccttccgcctcctcgtccgggccgcggacgttggccctcgccgcatcgcggaatggctccccgtcgccgcccgccgcctcgccggagatctgttcttggtgaatagtacgaaagattcggagctcatcgaacaaggtacatttcttgagcttccctgcttcgggagcgccacctcgctctcgctggagctagggttccttggcctcgccgtgccgccgtcctgtgtgttcgcccggctcaccaatctgccatctgcggtgtcctcttccatggcccatgcgagctcggcgacgccgtctcctcgccgtagttcccgtccctgaagaagctcaccgtgctatctgctcacaggatgaacaatttcaacatccactccaattctctcgtggagattgtgctccaggggataggattgcaacagttcaatgtggtggcaccagcacttgaattattagatgttaattaccacttttctgatggttcagctcagagtcaacccgtcgccaacatctcagcacctaagctggagattctcgggtggagtactactaatttagatcagagctctgtcaattttggcaagatgtcgtatctcaaagggctgttcatcgcatatttctatgtgtatggagaagaggatcgcaatcacgattgtctaaggctcttgcagcactttcagtt

SEQ ID NO: 69525 - DNA, 1833 bp, Oryza sativa
tatacatcctggagacaaatggcaaaactgtccagacatatcttttgatatttgcgattttcttttgagatgtttgtggtccacaatcatcatcttctgaaacattacaaaggaccactaaaataaatctttctaaatttccaccaaaattatctgagaatttagtttgagttctattgccatgagctacctaactatgatgtagtttgtgttgcagtctgaccagtcgatttctaaccgcggaaacaacagacagatatcggtatttcgagcagtaccagagaaatccaacccacgattgcagccagtgaagaacggagatgagttacagcaaatggctagctatctcgtatattgcatggtttataagttcattattatagaaaccagctcaagttccttttatttttttggcctaacatgttactgaaagaaatgcttcaggtcccggtcaaaaaaaagaaagaaatgcttcaggatgttgatagtattgccgcatgaaattttttgattaaacaacaaatttcttgagtaccttctcctgaactattgactggtttatgtacatgtgatccgtggatcaagcatccatctattttgcttccagttccagatatccagaggtatattatataatatcactgtgccgttctgaatgtaaatcgtgactgcaagttgtaacccattcattcgtggtgtggtcctacacactaagctttttgttcctgcttttgatgctactttactgctttgtgatctcctggtcgcaacagcttgcattcaaggatgtattagtaagggtatgtttgctgcagcttctttcaaaatcagaaactcattcaaacaatctagcttttgatttagattttaagaagccatagttgtagaatctaggaaataaactagaagtcacaagctaaaaaacctagttttttttattcttagaagcttagctaccaacaagcttaaataggcctaaaacaaggtgcggtttgaagttggacttattctggtgacctggtcagcaaaggtgcttagaaggtgccttgtcagctgattaaaaagtgacgcttttgttcgtgcattgatatttctccatgattttctttgtgacctgaacacgacaccttgctgcacgatgcttccaacggcagatacgtacgcacactcgttgggatgggatcgtcacctcggtgtttccgtttcattctgggtcgatctggcgtcaacatgtggcgtggcgacaacaacaacaaagtcgtcaaaacctaggagcataataacgaggaaatcgctcacggctcctccaacagccgaaccggttctagcgaaaattcctatgtttcaaattcactttaatccattggactacagctaattaggaaaaagattaatgagtgagcttttatatttatatccttactatccctaaactatcacggtcgatcgaattatacccttaaatcacaaaactagacattcttcatctataactatgcaaactggacaaataacccccccggctcaatccatggtggttttaatcctacgtgcgcggtagttttgatcctacgtggcgtgcgagaggatcaaaaccaccgcgaattgaaccgggggttatttgtccgatttatatagttgggaggtgaagaatgtctggtttgtggtttaggggtgtaattcaatcgaccactatagttcaggaggccattcatattttttcctttaatttaaaagcacacgaaaaaaactacgaaaaaataaatctctaaattaactctaaaatcacttttaaaattttaaattttgtctacggttcataagccaaaagaa

SEQ ID NO: 69526 - DNA, 1719 bp, Oryza sativa
agccccgcctggcctcctccccctccccgccgcgcgccgccggcgagctgcccctgaggcacacggcgtgtgcggcctcctcctcctccccttctcccccacccctgcgcggcctcctcgcgcgcacggccggcgcagcaaggtccggagacgcgacgcggccggcctcattccactcgcctccatccccggctcgaatcgaacccccaaggtactcgttcttctcccgtagcactctctcccttcctccctccccgccgcttcatgagccgtcgtggcgtggatttggaaatccatcccgacctggattgactactttgcctccaattaacccattcagtttcttccgtatttcttagtataatagtagttttttttttgaaaaaatgctgaacccccacgccccacgttaggtcggtttattttaacaaatttggtggtttacacttcaacgcttgtgctaatttcttggcttgctaattaattttcactaattattactgcgttcttcatatgctaatcatttgtagcactctaaatttagggggtacccgatttcttaaggtggacgcatgtcttactgtgtgcagcatgccatttttttttttgtgtgtgtgtgttttgcagttgaacaatgactgctcagaccaagaagaggggtggcggggagagcgggaacggtggcgctggcttgggccttgctgccttcatcgccaacggcgaggatctgggccctatcgtccgccacgcgttcgagtccgggaagcccgagtccctcctgcaaggcctcaggagcatcgtgaaaatgaaggaggttgagattgaggagctctgtagggtccactacgaggagttcatccttgcagtcgatgagctccgcggcgtgttggttgacgccgatgagcttaagggtatgctgtccggcgaaaacctgcgcctgcaagaggttgctagctccctgctgttgaagcttgatgagcttcttgagttgtattcagtgaataagaatgttgaggaagccctagggatgttgaagatctgtttgcaagtcaccagtctgtgccagatgtgcaacaaggacattgcagaagccaggcttcattctgctttgaaaagtttggagttgattgagaaggattttctgcaaaatattcctctaaagcttctaaaaaaggctgttcagaagcaaataccaattgtcaagctgtacattgagaagaaagtttgcaatgagtttaatgagtggctggtgtatatcagaaggacagcaaaggaaattggtaaggtttcgataagccaggcatccttggctcgtcagaaaaatgagggaatacattcccaacagagggaagcagaggactgcagccgtattgggtttgacgagcatgcttatgccttggatttggatctcataggtgaggaggaagtactggaattcgatcttacaccagtataccgagcaaactacattcacacatgccttggtcttggggaaaaattccgagaatactactacaataacaggcttatgcaacttaatttggacctgcaaattcccacgacacaaccgttcatggagtctcatcagcacttccttgctcagatagctgggttctttattgttgaggaccgtgtccttcgaactgcagatgggcttctttctgatagtcaggttgagacaatgtgggggacagctatttctaagggggcggcaggaat

SEQ ID NO: 69527 - DNA, 2624 bp, Oryza sativa
ggcaatagtttttttttcatttacttactatttaatctctaatttattttctcccaaattaggtgggatgcgtaccatcccaaatacacaaatcaatcatatacactacagattatacatccgaaatcaaaccccaaatcaaagaaacatcccaaatatacaaatcatacacaaatcatgtacatctcagatccatacaatgagattccaaaaaaaaattatacatctcaatccatacaatgaaccacagattcttcatctcaatctacacatggatcacaaattctttgaaaaaaaaaagaaaaaaaaacgaagcaaagccgccggccggctgagccggccgccgcctcccctcctccccggctgccgccgccgccacgcggccctccgcgccggccgccgccgcgctgccctccgccggccgggccgcccaccccctcctgctgcgcacactggatcgagttgggaaggggagttgggaaggataagaagaaaaagagataaggaggaagggaagagataagattagagatggagggagagaggagtgggtgtggatgagaaaagagtggacgaaaaaagaggataagtaatagggattatatagtgtattttgatctttaatcccggttcgtaactccaaccgcgactaaagatcctggaggggcctgacaacacctgacagcatgtgaaccgggactaaagatcatcggtaacaccaacctggactaaagatcacgtagtctcgttctacttataaaccgggactaaaaaccatctttagtcccggtttttactgcatccgagactattgtggtttttggtcgaccggacaatgatggtttctccactagtgaatgaagatgagcgaatgggtataagagactgggaaatttaactatttgccactattagatttggcaattatcaaaatgcccttcttatatttgtacatacttttttccctcttaagtggtggttccttaactattcgttacttttgcccacgtggcatgccaacatggcatataggtctaaacgggctccaactcgctccatgtgctgacatggcatgacacctaaaacaaattcggagacctaaatatgtattttgggagttcaagaacctggatgatacactcgcacaagtttaaagaataccgtgtacatcactcaaaatataaattgtcgtcctcctctcccaatcgtacttccccacacaaaaatcaaactgtttcaaaaccaacctaaactataaaaagaaccattattccgacgagaagatttgatagacaagtcgttcgtattgctctaaatcacattgccacgcatggacacgttggtactaaggataaagataagggaaaatgtacgaattacccccccaaccctccgaactatcacgttcgaccgaattaccccctcgacccaacccagagcggttttgtcctacgtggcaatccggtcagcattttattttttaaaaaatggtgggacccacatgtcataccccctctttctctcttcctctatctatctctctctcagtcagtcactggcagcggcgcgcacgccggcacgcatggcatggcacggggacgagcggtgggcaccggcgcgcgggggcgagccggcggtcgaagtgcacggcggcacgcggggagggagaggtcggtgcgcacgacggccatggcggagaggcgggcaacagccggaagtgtcagcgaagggaggtagagggaatgggggtgagtggaggtggatggggaggtggaggaaatgcagggagtaggccggcagtcggcgcacacagcggcggccatggtggagaggcgggcggcggcgctcgccattgtggcgctggcggagaggcgaaggtccgcgaggaggcagccacgcgacggcctccgcctccatcgccgacctttcggtccgtctccgtctccgcgagctctgcctcagccgaccgcccgggcgagctccgcttccgccacctccgcctggtccgtccctactcggtgactccgactcggagcaggatggagaagaggaccgccgtccacgctgaccgccctcccccgtccccacgccggcatgcgcgcggcgcgccatctcgcgtcgaccagagatccgctggcgagcggcaagagaagaggcgccggtggagatccgccatgctcaccgcccgtagtggccttccggccgtcgccccctgtgcccccgccatcgccgccggccgctgcgcccccgtcacgcccgccgcacgccacacccattgctgccgtatgcaagagagaggaaaagaggaagaggagtatgacatgtggatcccacatttttttaataaataaaatgctgactggattgccacgtgtacgccacgtaggacaaaaccactctggattgagtcgagggaggtaatttgtccgatattgaaagttgaaggtgaacgatgtttggttttcgggttagggggtaatttggttgaccacgatagttcgggaggggggtaattcgtattttttccaaagataatacacctatatgtttccattagcccaatttcctagtgatcaaacccattgtacatttgtacgttaagtctattgtgtgatttaattttc

SEQ ID NO: 69528 - DNA, 757 bp, Oryza sativa
cggattaccccccacccgaactatcgcggtcgaccgaattaccccctaaaccacaaatccggacattcctgactcccaactatgtaaaccggacgaattacccccttgactcaatccgcggtggttttggtttacgtggcatacgcgtggcagttcagtcagcattttattgattaaaaaaatgtaggacccactctcttctctctctcactctctgtcttctctctcactcttcctctctctcacgcgcatagcggcgaggacggcagcacgcacggcgcggcggcgcgcacgcacgcggccgggggccggaggcggcagcgaggacggtggtttgccccgcgcgctccatcgacctccctccgccccgcgcgctccgtcgacctccctggctacctcgatctccgggctgtgctttcccttccttcctttcaccttcccctccattggatcggtgctgtcgccgcaggagctcaccatcacatggcccgacgactgacaactccacctctgggaaggcgatgtcctctcagccgtgctccccgcagattggtctgctcggctcggcatcgctggctcgttttactggtgacgcacgcctagtgttcgatgtaatgtctcagtgaggtggcctgactgcttgcatgatcgttttttcatgttgttgggcagcgcgatgcatattgggaggccatgatgcccaacctgaagccaccggtgaccacgacggcacgagctttggagtacagggaggaga

SEQ ID NO: 69529 - DNA, 1078 bp, Oryza sativa
aaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgatcggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcagggctgcaggaat

SEQ ID NO: 69530 - DNA, 1963 bp, Oryza sativa
acgtgcagtgcaggcacagaatcaagtcaaacaacaaacaagatctgatgtttgttcgtttccagcttcttaaaaatagcagcagagtagaaacactcaaagcgaaaaaaggtagaagtatcctaaaaataaaacaggaatcctgatacagagaggtttcagagttttacagctcaaaaggaaaaacccattttatttcaggagaactaggtctgataagagtaactgcattttcgttcacaaagaaaacggagtaactgaatgatggtgcagatgaagtcatgaaactatgcagggggaacgcattggtgcttaaaaacagcaatacaacctatcatggtaacctaaacagcaaggcaacatataatggtaaccaagcatcatggaagtgtccattcttgtttttctctcaaaacaaacattggccatccaaggtgcagaaacaaaatgtcacaccagatgagcaaatcaagcactattattacgtataccctgattcctgataattcagttgatcagtacaggagtgaagcataacatttgccggaatgaccgaaggaggtcatttaatgtaattaagataagaagggagtgaagcataacataaggtggcctgcataatctagcagtccacatgaacaaaacaaatacctcacacaaattcatttgaagtcataatggagcaattcatgcatagatcactaagaaatgtgtattctaaaaaataaaacatatggctgagcggaccaaactttcaatcattttgttgtactgaacagcataacatctgcttattacagtgaatgaatttataaatctcactagcagaaaacaacaataatggtgtaataccaaaaggtacctcttctatctctcgatttaacaaggtatgattcatatgcagcaaatagtgcatatggtattgaactattgacatttggaatgacaaaataccaaatgtcctcaaaatttgtctcctaaaatacaaggagctctcctggatcccaattccattctaacaacttattattgcctgatgataaattacaaatggagatcacatacacctccaagaacacaacaaaaaatttgcatgcgcagctaagttctcatgatcaaactctcctcgtaaccaaagcacaaggcacactttgtcgaattataccgtgatccgtgaccaaaactacaacacggatcatatgcatcgctgagtttggaagggaaatttgtatcacctttttataccggattcagtcaagaaatccggtttgccggagaacggcgtcgcgcacgcggcggaggtcgcgccccttgagcgtccggccgacgccctcgagcatcgaggacggcttcaccggcccgccgaagccgccgccggcggacgcgcgcgccaccatctcgtgcgggggcagcatagcggcgtccccacggaggagctcctcgtcgtcgtcgtcgtcgtatccgtcgcctggcacgccggccagatggtcccacccgctcctccgcggcggcggcggccggacgggcaccttcacgggagccgactggtggtacggcaccgcggggggctgctccgggaggtggaacctcaccctgggggccgatgggatcgcgcgcgcggcggacgggggcgactgggtctgcgccgaggacgacgccgccgcctccgcggcggcgatggtcgccttgcggcggagcagcgccccggcggcgccggcggtggccacggcagcagcgccgccgcgcccggagagcttcctgtccccctcgtgaagcgcggcgaggagccctacgtggccgccctggacgcgggccggtttaccggacggatcgggaggcggcggcggcggagggtccgaggacggggccggcgcgaagaggaggtccccctcgaggagctcgtcgcccgccgcggtcggggaggtggggagagactgggtcggcgaggtgaacatgccgagga

SEQ ID NO: 69531 - DNA, 1598 bp, Oryza sativa
aataaaaggaagcgaaaggaaaggagaatctcggcgcggcccccgccctcttaaatactacgccgccgcggccgcaaaagctccgagcacatagcacgcgcgcactcgtctcgccgcgtccacacccatcggctccaacaccgacgagtagctcggtcgccggggccgccgccgcgcgcgcgcgccaccgtgtcgcgacttcctccgtgaccgggccgatcgatcgcgaggcgcggcgcggcgaggccggcatggcggcaccgggagatggggaagagaagaaggccgggagcgggaggaacaagcacgggttcccgcgcggcttccgcttcgtgccccgggaccaggagctcctcgacatcctcgacgacaagctccgcggcgccccgctcgaccgcgcgctcgacgccgtcttccacgacacgcggatcctcgacttccaccccgccaagctctacggtagccaccgcctctcgatccctctccccctctctctctctctctccttcttcttcttctccggcgacgggctgggtgggtgctcttggggatttgattttgactcgggtggattggactggtttggggcgacgcagggatgtacgcggaggacgaggagaacggctacatctacttcttcagcacgatagagttcaaggcagccaagcccaagcagaagaagtggccgcggcgcgcggcgcagggcggacggtggaaggccgtcctcggctccagccagatggtggaggttggcggcgtccccgtcggccggaagctctccatggagttctacgtcaagggggtcaggaccaactggggcatgcacgagttcgtcaggatcatcggccccaacatcgaggtaaactccccatgttgtatctccttgtgatgatcgaattcatttggtctgatttggatgcaatttgtgcgatcttgagttcttgactcgtacaattttttctctgaactttcgtttcgccaaggttgcggatcttgccgtgtaccgcctacacaagctatggacgaacggcgaggagaagccgggagacctcgccgcggacgttgccaagagcacgaaccagagtggacaagcgtcggcggcggactactaccagacttaccagaacgcggtctctcaggcgtatgcgtatgcgccgccgtacgtcctccagccaggatggagccaagggtacccctacgatgtcgcggcggcgccaccgaccgcgccctggcctgtctgttgggcgccgccgtccgcgccgggatcctatgactgctgctacgcgtccacgttttcaaggccgccgccgccaccaccaattgctgcgagcacgctggacaaggcgccgataaccagtaccgaccacggcgcatcaacgaacacttcggcggcgacacccgtggcgaacaacaagccgccgccgccaccagttgctgcgacagcgaccacgctgggcaagaagggggagggcaagggcaaggcgccgacgaccaccagtaccgatcacgccggatcaacgaacacctcggcgccacccgccgcgaactaccagccgccgccgacgacgactacgccgccgctgcagggcacgcagcac

SEQ ID NO: 69532 - DNA, 1208 bp, Oryza sativa
agactccgactccgatgagtcggaggaagaagagtcgttcgccggagacgacaccggaccgggtggagagtccggcagcgagagcgacacggcggaagaagcgcgcctcctcctccgctgcccggcggccaccacacccgtgctggcactgtgcaattcaagcacctacgacaacgacaacggcggcggctgcatcgcgatcgacgcgccgaagctacgctccttgcacaacctcgagtcctcgtcgccggcaaggcgagacgagagccgagcacctccgcactttccccgacctcgagcgcctcaagctagtaacggaggcgcggctgcccgctgccggcgatgaggacggcggcggcagcgatcgccaacctactcgatccgttgctgcccttctcttcgagacctcagcctcaagctcgacacgttgcctacaccatactcgatgtcatttcatgcacaattaatttcaacaagatttcgacaagtccattggtcccttcacacgccggaaatggatgccggcgacggcggtttcattatcggcacggcagcaatggtgatcgtcatgacgacatccccgcgcgttgagtgaacgatcgttcacctgctttgcacagcagtctgagaagagttagcctcaagtttcagatggattcacccgacaactttggagctcggcttgtcagattcttcgctcaaattacgctatggttctagaagaaatgtgcatcgatagtggtttgtactccctccgtttcaggttataagatgttttgacttttgtcaaagtcaaactactttaaatttgaccaagtttatagaaaaaagtagtaacatttttaacccaagacaaatttattatgaaaatatatgcaattattgatttaatgacattaatttagtattataaatattactatatttgtctataaatttagtcaaatttaaaaaaaaccaaagtcaaaatatcttataacataaaacggaggaagtaataaacagaggtctacaatgaaacaaatgtggcagcagatggctcatccaagatttctctgaaacaaaagaacttcgttgatggttcgtcattggtcttctcaagaactcatatccaggtaggagtgaccaacaagctttatggtgttaccacttgaaatggggaagagtagtatggatgatttaagtttgatctgattctgatgtggaat

SEQ ID NO: 69533 - DNA, 715 bp, Oryza sativa
attcctgcagccccacacaacatggtgcaaatgtgcaactacttgtgattcatgaacaaaaacattagaatgcagttaactcacaagaggtgtcttgatgttataatgttgaagtagctttccagaatgccttgtgtcttctgatagtatgacatcagcacatttgaggatacgcaatgccctgcagcaaggaccatccaagcttaaagctaggagcatgtttcaggaaaggagcacacgctccagttacagcctattactacatggaggtagcctcaagttcagccaaaacaactatgttttgtttttcctttttcttcttctttttttttgtgcagaacagaaagcatgccctccctgatattttcctcatggtaaaaagtaaaggggattgataaaaaataataataactgatgctaattgtgctatcaaacaattaaagtttttttttctccctgtagagattttagcagaacattgctctatttcctcttttattctaaaagaagtgctgctaatcagctgattgcctattcacaaattttgttaagagtttacaacaattgtataatcagacaagtcccaatactttcgccttttctttttaagtaaaacggcataccactgtcagttctattaccctggtatacccttatgaatcactagatattatgacatagacatcaaaattcagaagatatttcgtaggcgtca

SEQ ID NO: 69534 - DNA, 711 bp, Oryza sativa
attcctgcagcccagaaacaacatgcagagtcttttttgacactatattctaaccaattaaatttatctaaccaattcttttgaaatgatcttataaccttaccaacaaatataccatccttatttcatctctcatttcgtgacaaaacttacctattgttattcttattttgtgcacaatcagcaaaaattccattctgttctcatcagtttgattggtactacttgaattgcttgcataataatttaacaacattgttttcttctccatcgaaaatctacgaataaatcaaaactatgaatcgcgaagctcaattcttataaatcacatcatctagatgcattactgaaacagagacgaagagtatgaacaccggcaccgggctaggactcaccgcttgctctgctagctgctgctgcttgcccctcgtcgtctgatgcccttcatggagggatggcctgatctgctagctcctcgccctcacctcctgctgctcgctcctcgtcgcccggttgccgcgtctgctcgtcactacggcgctgcgccacaacgctgcagcctgccacaactgcttgccacattagctatgtactactacaaattaatatgtgaaatgaggatgacctcggctccgttgagcgcagcggtggactgcagtggcgtcgccggatgggaagacctcagcttcgagggcaggggaagaggggggg

SEQ ID NO: 69535 - DNA, 733 bp, Oryza sativa
tcccaagtactaccaagtagcatcattgcgcattgcccgaaacgaaaactcgaaccaagcccaacacggtcaccaacggagaacaactcgctatagcgacgccgacgcatcaaagcatacaaacaagcaaacaaaaaaaaaatgaataaaacgaaccaaccccctttagtgccttaagaactcagagcgacacatataaccccatggattagaccaacaagccgtacacctcccagctcgatacccaagtaagtccccaaccccgccaaacccagcagaaatggggccggcgatccccgccccgcgcggcaccggagcacggccgccgccgctgctgccgcatcgcttgcatgcgcgcgagcggagaaaaggtaggagagagagagagaggaggaggaggaggagggggagagagctagggacgcggagatcaccttcgcgacgcacggcgtcggcggcggcggcggcggcggcgcaatggcgacggcgacgcggcgggggcggagcaaggagagtggggttttgtggggggaggaggaggaggaggggttttgatggccagagcgtggaacggaacggaggaatgaaacggaaaaaagaataaatgggccgtgttggaagtgggctttctagggccgaaaagaggatgtaggccttgcttggatgggccagaattctggcccatacagttcaggccttgtttggaacgggcccaatctgtctgtcatgggct

SEQ ID NO: 69536 - DNA, 2030 bp, Oryza sativa
tgcaagcgttgcatcagtgggtgcacgcgcgtggcaggggtctggcgtccgctcacctcctccctctcattttcatcttcccattctcaactgctctcctcttccctctctcccttgccgccgccgcctccaccaaatcccctacggtcaccaccactcgttcggcgtcttctccgatggtggactggcggccgacctcgagctccctcggccgaccccggtggagaagctgcagccgctattacatcccttgccatctccatcgccggcttcctcgccattgccggcgccgcctctcttttctgtcgccacaatcgccttctccgaccgccaggccaccagatccggcgaccatggtggcgttgagcagctaggagcagctgggagcgccggtgaagcaagtcaacgatgagattgaggggatttttttttgttttctcttttctattttcaattgagagaagagcggaggagcgcgcgtggcagatccgtatgagaggccagcgacggaggagcgtggtactggccggccggcggcagaggagccgggaacggctggcagcgatgaggcaagaactcctctcctcgacgacaatgaggaggacaaacgcttctatctttcttttctttttttttccagcgctttgcagtcaaatggtggggaaattttggtgactttttttttttgagaactcaacaaatttcgctttggtgcaaagaatgctggctgatttttaataccaatattattctttgtatgtgaaaaattgtttatacctattgtctagatttgaaatttttgtatgggatattatagaggtaacctcacccaattaaatgaagaggtaaccagactcaaatctatccaaccaaccaaacaaaatattttccaaaccgcatctctcatgcactcaaccaaacaaaatctcatctcagccgggctaaaccgatgcaaacaaccaaaacagttgcatgtgtatctcttcatctgggctagactcaaccaggatgaaagagatgagccaggctaggaaaatgcaagcaaccaaacacacccaattgttgctgtggtgtggtggatgactcaggctgggccgtggttgctctcatgagtcatagcaaatgggttgatggcgtctattcttgattgtgcttttgatgcgttcttcggtagcaatgtttgttctctagcaatagcccatggatcaatatggattaagcaaacccttgggccttccggtgctaattaaggagttttgtcatgtgtggttcacattatcaatgagattttgttttaggaccttgttacagtgcaatgagtctgcgttcaggatttgtggttggttgggatgacaaattggggaaaatgtgttacaccttagtaacagatctggtttaggatagccagataaacggtacatatgcctattgaagtgtaatttatggatgtattccctatatttccccccctattttgacacaaatccatagcttacaaaacaaccactgtatgaaacttctatcaggatcatgagcaagtttgcaaggggtcttattacctggaaagatcaacttgtatttactttgtaaaggtcgtgttactgaaatatgaatttgttcttgaatatgtttactctctaaaagcctaacatgtcatcgaaaatatggctaccaaatgcttgccatttcataattatccagaaatttcttatataaaagtgttgctttattcaaaagcacatcaacactgattttcatttgtcacccagctttggggattaggtaaatgaatcaactttagttgtgatattggggtccatgaaagattgggaaaaattaaatatattggacctttgccgagcaaggttccgattctccctgaactgtggtagtcttagtcatcttcttggatttgtgcaacacatggattgactggttatgctgtattgtaatgtaatgtcatggactcgatttgtcctaatcttttgctaattacactatatgtattatgcctttttttttcttttcag

SEQ ID NO: 69537 - DNA, 901 bp, Oryza sativa
actatcgatgataatatcttactatcgatgtttctctcctccgttactttttttttccgaagtacatattagcctcaaccaatattcctttccttgctaaatcatttttcctatgcaaggtggcattttttccaaagaaaagaaaatcattttactcccctaaagcacttaatacttaaactatttttttcttcattttatccctaaactattagaaatggttcactcttgtattttaagctgaaactttttaagctataaatgatatcattatcaaagttctaaaatgttttcatgagtatttgcttgaaatttaaaactttcatgtttaaattagtcacagtgttttcaacctacgtaaacaatgataatttttttctaaagaatattgagaggtaaactataacgcatcttcaattctaccaaattttaatacaaaatatgacttatatagagagaagagagaaataccattaagagtaacgaaagagcctgtaacctagtggttataagagcctcagtagcaccataggtcctgggttcgactcccaatgggagtgaattttccaggatttaacggctttgtgctttcagtggtaggcgacgtaaccgtcgacagtgaggcgcctgtggtgacttcgtcaatctccaggatggatttgctggcccaatcttcgaagatgctcatagggatagggtttgcgtgcgtgtgttaagttgaaccattccaatagtttgaggtataaaatgagccaaaaaattatttaggagattaattgctcaagtgaaatagtttgggactgttttcgtttccaaataagccaagctgatcattttggtatttatggagtataattagatcgacttctctttcttccgactccctctaatcacaaataaa

SEQ ID NO: 69538 - DNA, 1269 bp, Oryza sativa
tacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcacgaaccaaaacagcgttgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacagtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattc

SEQ ID NO: 69539 - DNA, 1837 bp, Oryza sativa
ctataatctttagtcccggttcttaaccctaaccgggtttaaaaagaatttcgaaatagcgggaaaagatatttactcccggttgttgagaacaaccgggagtaaagatccatgggtatatatatgcccggtgcgccctcgtcttcttcaccaacacttaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgcatctcccttcatgcatctcgatctctccgatctcgatctctctccgtcgccttcgacgccgccgccttcgacgccgcgcaacgccgccgccgcatgccaacgccacgccgccgccgccttcgccgccgcgcgcgcaatgccgccgccgccacgccacgccgccgccgccacgccacgccacgccaccgccgccacgccacgccgccgccgccacggccccacaacgccacgccgccgccgccgtcgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgacaacgatcgaacgaacgtgaacgagctagggaacgtgaacgagcgaacgaacgaggacgaacgttaacgtgaaatgcaatatatatatatatatacatgtatatatatatacatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgctcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaatcagcaggggcacgtggaaagggatgtggaggggaacc

SEQ ID NO: 69540 - DNA, 3553 bp, Oryza sativa
caatgctgcatctgaatcaataacatgctctatccctggaatgtctggcatggatggccgaccaccaactgcaatgagtatgttttttgcagtataaagctttccatcaacactgacagtatgtggatcaacaacctgcataatatgaacaggtagtatatcaacactgtcattgctgcattgatcctttcaacaaaactgtatatgcaaacttaacccaatttacaaatttgtcccaacctttccacggccttcaattatagtgaccccagaattctttagcatgtttgtctgaacccccaccaagcgctgcaactctaaattcttgttggtcatcagagtgctccagtcatgctttggctcagtgccatacctccacccaaagccatgactctcttcaaactcatgagagtatttggatgcatacaccagcagtttctttgggacacagccacgaagcacacatctgaagtatggaaaaactgaacatcttacttgcacatttttgcaattggatatgaaatggaagaaagatgctatccgcacattatagatactaagcatttcactctgcagacgctataagcaaattacagatatagaaggaagctggaaacgcgtaaggctaactggttgataacaaccagccatcgtgacagagctctctaacttttttgttacttgcgtatatggagagccattcatgtaagtatgtaaccctaatagtaaatctcatatcatcatctctacacatatattgaacaacattatagtgaataccacaaaagcctctgaaattaagcatgagctccaggaatggtgaataagaatctgttcttatagtcatagagtagactcctagtggtcgttgatcataacagagcactggatcgtgcgtgaaattgttcaatcctctcctcactactaaatcataatcctaaacaaacaatcagaagcaaaccatgcacaccatccgaattccaaacaaacattaccactgaacaatgtgtgcgacttgaactaggaagaagggtggcgaagttcactcacgttccgccgacgccgccgaggctgtcggacgcgacggtggcgaagggcatctcgcagacggcggcgcgggcgccgtagagggaggcggcgacgcgcgacgcccgcatcccgccgctcccggcgccgatggtgaagaggtcgtagtcgtagtcgcacccacccccatcgccgcccgcagcggccccgttatccccggcggaggcggaggcggagaacgggcggcgcgggccgaggcggaggagcgggccccggccccgggtggcggcagccgcagccgcgagggggtggcggcggaggtggaggaagcccccgccgccgcggcgggggaaggagaggacgcgggatatggtctggaccgcggcggcggcggaggaggaggaggaggggagggtcgccgccgtcgccatggctgctgctccgaggcttccgcggcggcgcgggggcgcgtgacgagacgagacgagacgaggcggaaatcaaatgcgttgcttcgaggcggggcgcgtggtgtggccgtgtgtggggctagccaggagacaaaaggcgaggctttgttgcttcggtgaggcatgacgtggcatcggcgggtataggtcataggtggcgctggcgcatagccgcggagccgcctgagccttgggccctcgaggtgccataagatacgctttgtaagttttaaagcgtatttttgtaactccctccgtaccaaattagatgtcattttgactctgtaaattaggtgtcgttttaactttttgctttcaattttcgatcattcgttttatttaaaaaattagtgtaaatataaagaaagtcatacttaaaatattattgataataaagtaagtcacaaataaaataaataataattatataatcttctaaacaagataattggtaataaaaactcaaaaataagtattttgggacggcggtaatgggccggatggcctgcaaacgtctactgtgtaccatcattagcttagtttagctttgtgctaggtgtgtactatgtagcctagaacggcccattcctaatagacgtggacagatggggtatcatcatttggtgacccatttcagtactccaacatgcgggaagagagggataggtggaaccgtggatgttcacttaggccattcacggtgcataactgtatacatgtaccattcaatcctaacattccacgtcatggattccataccacatctgctactcccgtaacaaagtgaagtccggagagccaaagttagccacgagttcctcgtcagatttgttagagtgttggggagggaggggaatagcttgggctatgcatccgggggaggaaccgggggaaagaggggagacaggagtggcaccgtcgtggggctcgtcgccgcccccggctccgcaggtcgccggcactaccgttgttccccgctcttccccgatgccaccatcaccaccacaggggaaagaggggagagaggagcagcgctagagaggggagaggccaccgacggagagagaggtagcgccgccacagctgcccgctaccctccagctccactcgactcgacgcctgagatggctgccgcgcttttcctcgtccttactcgatccaccgccaccagagaggagagggtaaggcaaggggggagggaagaagccgccgccggagatgggagaagccggcatggcgagaggagaggggcagcctcaaccgaggaggggtggatctagtcgcccctctctggcaccgtcgcgccgccaacgccgccgctgcttcgggggaggagaggaagggtggatctagccgccccgccgccgttgtcgccctagtgccggtgccgccccagtgccacctcgcccgccgttttctgcgcgatggggaaaggaggaagctgtgcaatggggaaaggaggaaaggagagagaaagggagataaaaagtgaaaaaaagatactagtggaacccactataggtaacttgcattgtaaagtagtatgtggctaatgcggttcttcatctaggtggcatgtgaagttcgccaaaatcacagggcgcactgctactgcccttactaggatgccacatgtggaccccacatgttttgttttactaggatgtcacgtcagtcaagacaaccatctatactaccataggatcttatttaacctggttgtaaaagatgaaggtttaatattttcagtattacgatttgaggatgtaattcaaactcgatgtcaatataagatgtaaagtgaacttattcctctatgcttggccttaaccccacccaaagaagaaagactgttacccaatttgaatttcttggtgcaaccaaggacatcatttttttttcaattttggtatatatatgttgacaaatattctggagaaaatttgtcaaattttgggacatcaatttttttcgattttgctatatatatgttgacaaatattctagagaaaaattgtcaaattttgagacattagatttactctaagattcgggta

SEQ ID NO: 69541 - DNA, 6120 bp, Oryza sativa
  unsure (1)..(6120): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggagtctacattcagatgattttgatcccacatcaaaattctgaataagttgtcaggaatctgcaaaacaagccacataactcatccaatccgagtctgatttgggccttcggtcttataattgtatcgtggctaagctcaagggatggaaatcctaggctaaccctatgataaccctagtcatatatattcagttgttgtcatagtttcgagttggttttgcttagattatttctgttattacagtttcgccgttactttggtttgtggaactccaacaaatgcaatagtgttgcaattattcttgcttgtgttctttgatttgcatgtggagattagccttctcggcgagatcaattgggcagtgcacagttgataaccataggagacatggtgttgcaattgtagggtttggatcgtgttgatcggaagtcggaccatgtgtgccaagcttccgctgaatcgagtgttatcaatacctatcggatgattgggacctagtttctcatcacggtacagttttggagttagataacctgatgaggacatcattggctcggatataaccatgcttattttacacatcaacaagttaatggtacatatgtgctctattagatttacttaattaatatatgtttgaacaaacgttactgtaccataagtttttgtatattcttatttgcagaaatacttgcgtggatgaaggaaagaagtacgggctcatgaagtactttaaagatcaaagaatttgactagggacataaccaagaccttctccaagtctattcctaaatcaccactttactttcggtccatagaaggcaagagatgaagttttacaccttctgaattcggatcccgtcctcctgacaacatcaacttgagaaggacctagccactaatctagaagcaatctcggagcctataagtacttgttggaaaattatggagtctactttcagatggttttaatcttacgtcaaaattcataccgagctatcggtaatctgcgaaacaagtcacatacctgatccagtctaagactaatttaagccttgtaattgtgtcgtgggctaagctcaagaggttggcgccctagggcaaccctagcatggcctaatgatatttatttagttgccatcatagtttagacgaggttttgattagattattctaccaattgcagtttcgctgcaaagttcggtttgtaaaactccaaattcgagtgattcatcattcatatgcaattgagttacaatctaccttgttcttgcttatgctcttcgattcgcatgcagggattaacgttcttggtgaggccagccaggttgtgcacagttgatacccagaggaaatgtggtgcttcaattgcagggttcggatcgtgttgatcggaagccatatcgtgtgtgtatcaagtttccgccaaatcgagagttatcaatactatcgaaagattaggacctagttctcatcaattggtatcagagcaccagattgcccgttaggtataccttgtctcttctaatcactggttgcttctctccacttgtaaacactcaaaagtagtattatctaatttgaagcttccggtctcaaggccggaagtgctctttcaacgttttcctagatcgcatagtgcgcaatgtatatgtatacagtaccggttgaaagacaaaaaaaaaagattatcttagtatcctataaaacacacactacggctgctcttggtgataaaaaccaaagtacatctcattaataacaacatattattattgaaatggtaggaacttatcgatttgtgaacctagagtagctaagaaggtactccctccgtaaaaaaaaaaaaacccaaccctagatttgactatgtccagattgaaactcaagattggtttttttttttttttttttttggggtggggggggggagagggagagtagaactgtactccttactctttaccaaagttagatggctgaaatcaagccttctcgggagaaaaaaatgtggatgtgtataagttttggtaacaattttgtgaaaaataatctatgtagctttctggctagaactatatcagcaacgttgtacgatggagaatgacatatagaatggatgttttcagccggtaacgatcaagataaagatatagctacaggttcctggatttagctagcgctgattgcaagtgatttgtagggtccaggctagttcagtcatgggttttatgtcgatcgtcagacttatcttcatagttcgacacgacttttctttggctgcagtgcaatgtcctagctagcttccaaaatacacatttcgattgagaagcagagatccatctgcaactagcatcacacttaatttgtacttttatatatcctcaatttatataaaaaagttaataagttgaaagggccgtggtttagagacgtagatttgtatgctaatccaaaaatatccaactttcatatggtagcgtaatttcatcaacacacaaccataaaccacggaattaagcatctattattaggctaagggtatttaccatggagaaattcctctctttttgattatcatttacgagcacatttattcatcgataggtaccccttctcattcaatagcctaaacatttgaattagacacatatatatataggcatagtaagttgcgcagtgcgagtatattaaccttttaggattttttgtcttgtttattttgttgcttcttataggtttgcacatcatagagaggctatataattaaatgcagatcaatatataccagataaacagatggtccacaattagggatatatatctatatggacatgagagtggacaacagtgggcagcaagcagcgatagcttggttccatgattgcatcaaaccaacagttttgctgctccaagtaaattcagataaggttagggctgagtattgagtggacaggatcaaaccaaactgtgcaatatatatattgatggtgatcctatcaaaggagttgcggtttgtgccttaattatctctaattgaattactatatatactaacatagctcagatatattctgctcgtgatctcagtacaagcataaaaaggattactacaactttattctgaaagttgtgaagtactgcattgaacttgttaacctaaatatgtaacttctaggtacacattgttagatttaattgggtaattaatccatttaaatcaattaaatcaaataaattccaaggctcattatgctaggaattcatgattgttgatgcttattcaacgttaagcatgctcatgttgattacattcaccactatcactggatcaaatcctattgtaaatatcatgattattatcttgttattttggattaaaatatgccgaattatgaccaaatttccaacattccaaaaacctgataggtcattttcggtagttggctttgctgctgcactgaaaccacatgcttttgatggttcaaactataagagatggaaagcacgtgcactattgtggttgacagcgatgcagtgcttttatgtttcacggggcaaacgaagtgaaccacttttttcttctgagaaagagcttagttcgaggctttggattgccctgttccgtggagcattgatcagtgtcctcgctgacacaatagtgancgtgtacatgcacatgcctctgggaaggacatgtggaatgcacttgaggcaaagttcgaggtttctgatgccggcagtgagctgtatgttatggagcagttctatgactacaagatggtcgatgaccgttctgtagttgaacaagctcatgagattcagatgctggctaaggaacttgagaacaccaactgtgagttgccggacaagtttgtggcaggtggcattattgccaaactaccaccttcttggtcggactttgccacttctctaaagcaccaagagacaaagagttcagtgttcctgatctcattggctctttgggtgttgaggagaaggcgagggcaaaggacgtccgggggaaaaaggttgagggaggttctagtgccaatatggtacagaagaagaaccctcatgcatcccacaacaacaagaaagttaagcctgatgtcaaacccaaggctgcaaccaattttaagaagaaaagcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatactacctacagttctctctgtttttcattcacctgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggaccttttgntggaaaaggttatgacagcggaagcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaaggggaaaagaaatatttcatgacactgatagatgattgcactagattttgctatgtgtatctattgaaaacaaaggatgaggcattgcatttctttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacagtgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctagagtacccgacatgcatgttggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaattctgagaaggacaacat

SEQ ID NO: 69542 - DNA, 6297 bp, Oryza sativa
gctctggcagcctctcatggtcttctcgtccatcagatggacgttaagacagctttcctaaacggagagctggaggaggagatctatatggatcaaccagacgggtatgtactagaagtcagagggaatggtgtgtaaactattgaaatccttgtatggcctcaagcaagcacctaagcaatggcatgagaagtttgacaccacgctttcatctgtaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttatagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctagcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgaagagacccttgaaaagagctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagaagaagaagacacactttcatccattttccaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgattattatcttgttattttggattaaaatatgccgaattatgaccaaatttccaacacacatttcagtaaagtgaggtcagaataggtgtaagctcatatagctaacttcacgctaggtttagccatggtttaatatatcgattgggcaatttctattgggggaacctatacgactgaaatttaggatattttggtccaaaaaaatttgaacaaaatgggtcaaatttgagttttttctaaattcatgaaaatttgaaaaaaaaagatctaaaaatttcgggcaaaatagtttcctatcccggggaccgataaaatgaaaatttccaaaactgaaattttgttctggaattttgaacccaagtttacgccttgagcaagttctaggctgcatacctacaaaactagaaaatacattaaatatttatttcttcagaaatgacttgcttcaaattgagacacatgagaaaacgacatacgcttcaaatttagtggtactaggtttcctcgtagcttgtgttttgaagctcccattgcatgcactctactagtgcatgctaaaacaaacattataaataagggctattaggcaattccttttgataaattagggccggcctccacatcttgctatggagcctgacttctgcattaccaaaggatatggagaagctagctatatgaagaactcaaagctacaattttgtatactacccaacttgttctctatgtaacattaccatagtgctattttagtagatacatctacgtatttcatgctaaataaggttgttttctttcattatagaaatagaactacatcaccgacctgtttgtactttccttttcatctttagggtgaaatcatgtgttcatgcaaattagccatctctttaaatgtcagaacctatttaaacatcagatcagcgttaccatggatgaaaaacatctatctatttattatatactaaaagtccattaaacttcctacaaacgctctcatgccgccacacgagactcttacaaacgctcccaagccgtcacgtgttaatctaataatctggtgaacccaatattatatgaaattaaatctatttttggaaaaaaaaatccacatcccacgtccagcttggtctgtgcgtacgggatatgtacgtacgccctcccatgtttcccctttaattatctcctatttccatgctacatgatctcttctatttccatactatattagttcctatttttatgatatattagtcaaatgtaaatcataatttataataatagttttcaaaaaaataactaaatcaccgtcatataaatacacatatatatgtacaaacgtacgtactccctccctcctgttccacaggaattagataagaagtgcattttatttttatccgttcgtgagtatgagaccatcacaaatgatttatcatggatggcttcgcttaagcgtgtcttaaattgaatgtgtagatcggctaaaaaagtaattatttatttatgtcaccaagatcattcatatataaattaaagttcatagatccaataatttttatagtaataaatgatggtgcataaccttaataaaaaataaaaaagaaagagaatactgagggggaggggagcagatgtggtggtacgtgcgtattatacgtacctgtgggtccaagagaaaagggtgatcggatcggtggatttaatctaatggttagtattatcgggttcatcgttttaaataaaaataaacggttagatatctttcttttttcttagaatttattagagtgccacgtggcggcttatgaccgtttataggaatcccacgtgacggtttgagagcgtttgtaggaagtttaatggacttttagtatttttaatttatttgaacagtaattttatttgttattaattatactatataaaagtcaataaaacttcatacaaacattctcaagccgctatatggacatcctacaaacgctcttaagtcgtcatcgtcatgtggcattttaataaattaaaaaatatcacactactccaaccgtatgtacgtatgttttcctccctctccctactcttctttaaattaattttttaatgaaaaaacaattaataatttaatatccatatcacccatattttactataaaaaactaaaatacattatttgaacagattgcaaccaaacaacatccaatttttaatttatttgtaattaattattaatctatctattaggtactaaaagtccattaaacttcctacaaacgttcttaagccgccatgtggcactcctatagatcctcctaagtcgccacatggcaatatctaatctcaccgttgattttatttaaattaatggacccattagtttacactattagattagatttattacttaaaaaataataattttctcatgtttataacgtacaggcggtactactgtccgtacgtatgagtttgtacgatacaaatgctactgctgttctttccatacgtacaaacgtacatgatctttcctaatcttgctgaaaaaaaacatacacatgtacagaaaaagacagaaaaaacatacatccataaaaatcagcggtctttgaaatataatttttgataaaatatattacttcacaaatataaatatatttagttaaacaaagatctataataaatatccaatcaatattctttaaaccatcttctgaatctatctattatatattaaaagtacattaaacttctacaaacgcttttacaccgctatgtggctctcaaatatattagcgaaatcctagaaatctattatatattataagtctattaaacttcctgcaaacgctcctacatcgtcacgtggcgctttaatttagattaatcctagaaatttagagtaaaaaaaaagagaaaagcatccaatcttcaattgtcacttaaattagtgacacattattttaaacattggattagagctcttaaaattcccacgctgctaatctctatcccggaaaaaaacatagtgtgcttacatcgtacgatcgtctccctaccaagaaaacaaaacttaaatacctacgccatatacgatcaaaaaaaataaagctaaaaaataaaaaagaaaacatgcacacgtacatagaacaattggaaagaaatactaatcaggaaaaatcatcggtgtgagcacatatttgttgtcaacggcctttaatctacaattttaagatcttcctccccactctgttatttatagtcctggtgtagatagaacttcctttatggtttaattccgagcggtagtaaataccaggacttagcaatatttgattgatcacaactcattatattccatttattataaatcttccaaagtaattcattataggaatgctttcaagaaatggtttgcttttgcacatcgaaacaaaaaattaatcgcgcggatatgtataattcaaaagaatagatgagtgattcatacacagatatcgggatttttatttaaatctaagaggcattcttatcatattagtagtatattaaaatctcccatgtattttaggataatctaaattcacttccaatatatatatatatag

SEQ ID NO: 69543 - DNA, 48761 bp, Oryza sativa
agattatttcattctattcaatcgagcctctacttattcttgttgatttgtgttctcctgaattgtcatactttctccacttgtaccctttgccttagcagaagattttcttctgatctgttgcttcatatatatatatccatctcctattagcccaaccagtcacatgcatgggcttcttgaatactccttgttcatctgatccaagcccggttttttactcccttgtctctatttgtacctaattgatcagctctcctctttatagctcatagagctttgctctcatcccacttgatccctctatttgattgctcaagcttcccgttgaccacgatgggttgtcgatgttaagcccccgatggtgtacctttgggcactaggtttgtcgaaagtatatgtatgtagttgcaaaaatgctaccttaaatcgttctaatgattattattcaagtgagttccaatggagcaaaaggattgtgttctttattctagttggtttcttgtatttggtttgcatttaattagttggttgtctttatgctagttggtttcttgtatgttggttttcctttaatttgtaataatattgcttaatgaaagggataggtataactctatgaggatgatgggcgaccctacttggggatgagagaagtaaaataaatatgtgtaacaactttacattatgatataattctatgcccaacacgattttattagaccacctaccagttatataaactagtgatctcttagaactagcaaggtgggactaaataaattattttactatgtgtgcacatgcaaccatgttgtataagctatcagcataggcctagtaccaagcagtcacattatgagtgagagacatgctataaacatgaaaaagtggcaatctatatgaatatgaatgagagacatgctataaagatagggaaaaaatgcaattttactagttatataggctatgttgttgtaatatatgttaatgtcaacggtacaaattttgttgacggtaatggggtgcccgatcttccatcaagtagagattatcgatttggcagaaacttggtacacacaatctggttttcaatcaacaaatataggttctagctacgtcgatcaaggacctctagaagcatcattattggacttcaatacgatacatggcccagcggcccaaaagatggtgatgcagcactcagatagattctggacgccactttttttagaaagaaattttgacgtgagaccagacccattggaaaggtggtctccgtagctttccatatgtgagtctgaatgcggctgcgtgatgtttttagcgcagactactcctagagcctaaggtagactcattcttgttatgagttggccctccatcttgacttcaacgcctgacatcatccttctagcctctctttttggtcttctccatagtttctattataattaaatcattggttagtattttatcaaaatcacatgaagaaatacttaggaatgagctcacctgttattgcaatttatgaatgcgagctctagtgattggacctttcatgacaacttagagagttttgtgtgtatccaaagcagtcatatgttctcatcactagtttaactcaaagtgaaattatcttcagattaaattaattacatgtaccatgcatatatttttctagcttgcagtactggtttcccacagttagtcacaatgccatgtatttatgtttgctttgaatgttagggaaaggctctgcttcagacaaaaccgatgattgaaaaggccattaaaaaagtacacactgctcttcaaccaatgatgatacttgtagctgacctaggatgctcctcggggccaaataccctaatgtttgtctctctctaccatgattagagagatcgctgaatattataacaggatcggtcagtgccccgtggatgttcagtttttcctgaatgatctacctagcaatgattttaatcacctgtttaaatctttagaacagattgataattttgttgctaaagatcaaaacagacaagcaactacactgcctcaatactatgttgctggattggcaagctcatactatagaaggctcttccccaaaaatagtgttcatctgttccactcctcgtatgctctgcactggcgatctaaggtaatcagacaagcttatcacagttaattgcagatgtccaggtgaagcatacttttagagtagtgcatttagacatcaatctcatttgtatttagccttttgagatatatgctttactaaaattgtagtatttgttttgaatttatatatgaatatatacaccttggccatcgatatagatcatgcaagagtattgatgaataatttacctgctatcgccagatcttgtcaaaggagcatttttttgggatatattctaaatgttatttttatttggttttaccataaattttgatcatagtactagcattcaattattgagataactaggtgaaaccccgcgcattgctgcgggaatttagtattataacaataaaaaaaataacgtgtaagatagctatgatagctagataacaccagattaagtaaattaatgtggtttatgataatttaaatttaaatagtatgtagaatggtgattcaaacgtaaaaagtaaggtggtatgattttatagaagaagaaaaatagggagatagtttaggtgtgtggaccatagattaatcatctaaaggctaaaaacaattgatgggatatgacttaattagagggaaaaaggagaaagataatctggaccatagattaatcatttaagcactaactaagtgatgatgaactatataagtatataggatatcataaaacataataaagatgtatattgaaacattatgtgaattatgttggatgataatttaacatgtttgtatttgaaaagctcttaaattataaaaactataaagacatagcatgtttgcatgatgtttaaatgtgatgattgttagtggatgatgatgtggcatcttgttaattagtagattagtgaatgatgatgtggcatcttgttagtggatgatgatgtggcatctttgcatgttaagcttaagtagttagtgggggataactttatagtaagatagaataagttgggacttgttatcatactttttctttcacctatgatataaaaagagtaaatttcactttggcctacatttgtgaccgatgtttcacttaatttggatcacccttcaattaatgctttcactttggactgagtaattttacctttgtattactttggactaacctgactctttttcgagcatatatatgaatgatctcaagtacatcggctcctactcgtcaataaactctcacagttatacgcaataccatttctttggcatatgataaattggttgtagatagataaaagagttaagggtggttgaaagtgcctcaaaggtaaaaatacctgatacaaagggataacatagtttaaagggtggtccaaatcataaacaaaaactgatgtagtaaatgcgtatatcttgtatatgcaggcatgagatatagataactgttattattgagggatcaaaattgctgttagcactatagcaaaatatcaagattttgttcttcatatccagatgttcgaaatgaaaaatataaaggagcccctgaacgaaggcaatatttacatctccaagactacacccatatcaacagtcaagttatatcaggagttatttgagaaggatttctcaaatttcctcgagttgcgctcaaacgaacttatatctagtggtcagatgctactcactttccttggaaggaagaacgaagatgtatctgatggagatcaatgtactcttcatgtattaatttcacgagcaatacaatctcttgttatggaggtctacacaatccatattactcatgatatattaattactatacattgtcatatatatatctagctagattcttcaatgaattaatgtgcttaatttccactttcaacacattagggtctgatggagaagaaaaagcttaacaacttcaacatgccggtctacatgccgtcaacgcatgaagtgaaaacaatcatcatgcggagcaagctgttcatcatcaaccagatccaactctctgaatcaaactgggatccttacgacgatgacttagaaggagaggttgtgctctacccggcgcaaagcgggttgaatgtcgcgaggtctttgaggccagtgttgaggcggttgttcactacctattttggggaatcggttcaagatgttctcttcttaaggattgccagtaatgtaagcaaataccttgacaaaaggaagggaaagcacaatgtcattgcactgtcattggcaagaacatatggagatggagtgctatagatgatgatgatctggctggtacatcttacttcctatgtttcatattataagttcttttctaatcaagtttggttaagtttgactaagtttgtagaaaaaattagcaacatctaatatattaaattagtttcattatatctaacattgaatatattttgataatatgtttgttttgtgttgaaaatactactatatttttctctaaacttgattaaagttaaaagaagtttaactagaaaaaaagttaaatgacttataatataaaacggatgaagtaactatgttagtggccagaatgacgatttttggctggtttgtcgtttgtgccaatctgggcagaggtggagaccccacagtttcaaaatttgcattgtatttactggagtttgaacaaaatctgaaaaaaactaaagtattggcttcgttcaatcgaatatttttagtggtcctgtttccgccgctgattctggctattttgatccatacatattccatttttttttcctttttagtgattattgcaaggctcacatgcacaaatttatgtgacatcaaatttgatcataaaaagtataggttctacgatgaatttggtttattcatggatgatacaagttccatgacaaaatttgctgattcgtcgtgactaaacgaatgtcacgctccgttttttacgaacacgtacgaatacgtcacagaaattttcttatgacgaattcgtcatcgaccatgacattaaagttttatcatagatatgcacatttctactagcgactacaagctgccaccagcccaccaccacacctctgaaacatacgtcgagcaccttgtgtgcgtgcccaaagcactaccagttcaatgtacatatatgacggctagattcctgatcaattatttccgatcataccatatcgccgtgaagacccttctttcctcccacgcatggccgccatgcaccggcgaaactaggagtttgccgtcgcgccaacccatttggaaaaggaaaaattggaaccatgccattataattttgtaaaatttgtaaatttaagatatgacatgctgacccacatatcattgactcatgtggatgctacatatcattgagataccgatggcatatcttaaactttgtataattacaatggcatggttccaatttaccctttgcaaaatcaaaccaactctcacaggcgcaatatgctcgtgcgctaggttgaaattaggctgtttggttggctctcaaaggttgctatatcaaacgttaagcataccataatttgttagtatagtatttggttagttgccacacctaaatcatgcctcactttataaattattgggcctgcacgccatatactcaaattcttgccaaacttaattatacttgtggctaacaaattgctagtctcactttgtatggcataacacacttgtgacagagtgaggtgtggcaaacttagtcatcaaccaaacaacccgttaaaacctatgatccgagtcagctctgcgcatgtcgtgtcgccgtcgctacagtgccttgcgagggccatatgccatcactgtcctgtccggtttgtcgtggtcgcctcgtcgacatgccattgcgcgtgcagacggcgccatgccgtgcctgtgccgctcgtcatgcacaacatgtgcgagagagggcgagatggagaagaaacagatggaatgggagaagttggcatgaccccacttttgtcggcctccctggtttttttcctctgagagataaatatcatgtggaaccacctgtcagtggtggcaatattttgatcttagaaaaataaatcaagaaatctatatacctaataaaaaaataaggtaaggtaaggttcctaataaaagtttttgtccggcgtccatcgcaagcggaatcaccttcagtaatcggtttatttttacaataatcaatatttttggtaatcacatccgtttcctaatctgcaaatctgcaaagccatgcccaccatcaaacccaaataaatacggtaatcagttttttttagtaataacatttgttcatgatagcatcaagtttttgcaaccgtcggcttgtttggttttagggtttattgtttggtccacgttcaatttaagattgttttttaattcatgtttatttcttgtcaattgaggtataatttccctggtaattatgttatacttaagtttcatgtacttaatttccccccttttattttcaagttctgatctagcgtaattaaggctcaatatctatgtaagttgcatcttgcctttcaaattcatggcttgagtagcacttagaagtaggggatcacgaatgggattgaaatcaagcaaatttccaatattccccaaattcaaaacccaaaactttagttttcctcaaatccgaaatcctaatttcatttcccccaatatcaagaactctaacctcctaaattagacaatcccgaacccaaaaaaaccccaaattgatcaaatcttgaaacaattagggcctttgctaaccgaattaggacttacggatcgtccaagataactacacgaggcatgagctatgtcatcatgcgcatctccgatatcctcctccgttatcatgcgggtgatgtgctacttcagctgcgccgtgtaccggccatatttcgccgcctggacaatcccgcgcatgcctgacttggccgtgtgacaatgaggctcgcctcttctacagcctcaaccacaccaaggaggagaaccatggttggggagcggaccattgacctcaggccaccgtgcgccatcgccgccgtcgtcatcaccttgacatcgctgtcctttgtgcatatgggcaccctgctcgggtagacttggtgatgtcgactcacggcgcactatcggcttgaccttcgtatccgtgcacggcctaagcccgccacacacaggcacgccgttgcgaatcatcgccaccgtcgcctagctcccttgctcacaccggagaaatcggggaaaatgggagaaatggcctaagattaaggtttttcagaaaaccctgcttccatgatcagtttgaagcaccctgcaggactgatttattaaagtttaaccatacaaacagaaaactaagcgcacaactgtcatgtaaacttttgaaatattttgtaacgtagtttatgctgccatcgaaggatactatggaatttcaccctaaaatatgacctgtgtacaaggagattttttttagataatgtgtacaaggagatatcggctaaaaagagaaatatgctcataatctggagtgatttgtagcttttcctttcttttatttttgggggagtaaaatatgtcaaaaatagtttaggggccggtcaattgtaaaaaaagtaaatagattgaggtagttttttttttctggcgacctaacccattataaaaaaatcagcgacttacgtaaaatgtataaattaagcgcgctgctatttaacggcgactgatggcggaaacatgaattagagatttttttttagataatggaactttttattgaacttagactagatcgccatccatattcctgggtaaaaaacaaagactaaattgccactcatgaacaactcattggccatttcctctaaaagcacagagttttaagggccaccaattctaagactagatcgccatccatattcctgggtgaaaaacttcttaaccatcttctccaaatattgacataccacaactaccatatcctgcgaaccaggcaaccaaacttctataggatagcctatgtacgaagccaatggataagagaatatataaccttcaaatggatgtgaggatactaattaaaagtcatggaggaagcctaaacactgtatggcctaatcagtttgatgattatatgtgagaaaaaaaatgctggatcggagggcccaagctactgatcgttccaccctgcagtctccgccactatggaatgtacctcgttgctgtctagctgcctgaagcatgtggatcacacgccacaaagtttatatgtggatgagatttttttcaggattataatcttgggagtgttgcaaattaatgtcatatatatatggaccatatgtgatagcccttaattttcgcacttttcggtggtagagattgattgtcctgaatgcggacaaacacagcagcaatatatacgtggggaaacaacaattaattaccatcccactttgtaaatatatatttgtatatatatcattaattgttgtaggcgtgataaacgtgtacaatcaccatttgcatctataaatataatggcaccatgatttctatatctatatatgctacttgtgtgttgaacctcccagttgtatacactcctaaaaagaagttattaggtctcctcctgtatcacattatccacactcttagtcttagctatatggaaattgactttggcatggttgaaggggacggagaaaatagctatgcgaagaactcgaagcttcaagttagtacacactacacactaactctgtttctttgagaaattgcagattcatttcagtagatatatattatatatatttatagggaaatttacttttaattcggtatattatgttgatttgatttgtctaaattgggctacacatatttgtattttcttggatcaagttgtttcgtgaggacttctgtctatattatagtaaaatttttcagtccttccgaaagtctcaaggtagtttcctctggtaccaaatattggatggtaaaattgctcaaattttatactaaaaattttggtatctcgatacacctactacctgatactacaaaatatggtacatcccttaaggatggtaaaatcacttttatatgcatgcaagtccaatgtaaaatcaaacatcatggttctgggtgaaaaaaaaaactaaaaatagaaaacatgcataagctaggttttgtttagataagggattttcattaatccggccactatgcccacgaggggtatacatatccaaaaaggatacaagagtatttaaactcacacctcaatagagaggagaacacaaacccaaaaaatgaaaaacctacaacctctgcatatccctgtatcccgacatcctctagtgaacaaaattgacgagtggaagttgtcttctcatcaccgcccctaatgcgttctcgctgctaatctccactggtgccatcttcatccactttaagtgaaccggtgccacacgccaccgggtagcccaccttcatccatcgtcgtccagtcagaactagccgaccaaatgcgagatgaaaggatatgcttatgctttgccggattcctaagcctttgcagccgatagggccgttgccaacgttggaatcctctactacctctcggactctcagcctgccgccacctctaccggcgtcctctgccgtggtgatcgagcatatcatctttcgtccggacacccaggcctccaccacccctagggctgccatcaccgacgagatccaccttcgcctgtaccaccttgcaccagtccttatgccgccgccgcccctaagaccgcagctgccgtaactaaggagatcgctgctcggactcgcaggccgtcgcggcctctagggtcgcagctgcctacgacatcaccttcatcggaacggccttctccttgctgaggactgagcatcgaagcttaggccccctgctgtcctccgctgcacccgctgtcctccgctacacccgccgccgcagagacgtcgcggccgacccgctgtgacaccgcctcccgacccctccgctgccgcatgccaatctcgggttcagccactgctgctgtccaacgcttgcgcctccatccctcccaacaacctccgctggcacgcgcggccttgaccaccactgcccatggcccctccgcctcccacgtcgctagatttgggggctggaacccgcagacccgacactcccctccgccgcaccgaggtctcctctggaaaaccccgtcgccgctttcctcacagctgcactgctcaggtggtggcaaggccatgggaagaaatgagataccagatatggggaaaaagccgaatcaggccagtagtatgaccatataaaaagggttaattggatggatgtcattgcaactttactattttgaaagaaatgttactactagtcgagtgaaatctattagtatgtgctactccctctgtattttaatgttgacaccgttaactttttgaccaatgtttgaccattcgttttatttaaattttttatgcaaatacgaaaatatttatatcatgcttcaaagaatatttgatgatgaatcaagtcacaataaaataaatgataattacataaaatttttaaataagacgaatggtcaaacgttggataaaccactcttctcaaagacctgctaatctccccccaaagcatgtaatgagaataaaacatgcaaaagaaattgaaaattcatttcagtagatcagaatgtgccaaaaaaaagtgaagcctttatctcagtaaagccgggcgtgaagcctttgatctaaaaaaaatgtgcaaaaaaaaaacagatctggtgtggtttctttctttcctccagcaaaatgtagggaaaaacaaccatggataaaatcgttcgccgtttgctgaagaattgaaagccctagagttcttccgtggcggcggcgacaaaagaatgcgtgcttgtgcggcaggggaagaaattgattgttttgctgaccttaacgtattgttgcctcggctcagctcgtgtcgtcttgccggcatccgctcacagcacggatgaagaactgcacatcaagaagctcaagaatgacaaatggggcggtataacttgattgctggcccgtgatagctcgccggcgtctatgcacggaggcaactcttgccacaggaggcttcgcgcatccgccgcaggcaacagggcctccatgtgcggcgatggaagctcgtcggagtccaggacaatgactcaggagtgtgatgtggaggaggggacgggggatgagggcagaagggggttggggaagaggggattcctagagcatacctgatggaagtcctcggccggagactcggcgagactggatggagtgccgcttccgccaaaggaagatgcaacggggatgcggccggctagcggcgagcggccgcggcggcggcgggtggcgattcggtcccgataactcttgagaatctggacgagaataggaggtgtcatacacacgtattggtcccccccccacaacaacccacatacgaatcttcaggtgggccagcgctgtatttcgagcgtgcactcaaaataaagaaaatacgatcctaaattcctaacatctccgtatactatttgacgcacgaatctttaaaccatcgtgtggtttctagcctaggtgccgcagcacctaggtgctaaaaatactttccgaactatctcctccttccgcacggccgcaagtctccagtagatcgtcgccatcggcttctcacaggcacagctcgcctcgtcgcggagctgcagggagacacctgccacgccaccaatggttgccgcacgcatggggtggcgacccgccgccgccgcccgagccgttcttcttcgcgaagctcgccacctgcgcccaggcccagcacactacgtacgacgtggctcgcgcgccggagtgaagctgtagctagccatcactagactagaaggcacgacgacatgtactctacccaacggcacgaacagctagcaccagcatgacgcgctccttgtagacccgagaagttggtgctgccgcacgccagcacactcgccatgccgatcgaacgtcgactaatcaaaattgaccaagaaaccatccacaaattcaacaaataagtggtagaaattgaagcagttcttgcgtgcgatcgagaggggcgttcgatcgaccattacatacgagaagctagggaagcgccggcagggggagctagcttgccgcatccacaccacgttcccgcgcgcagtacgccgctggccaccagctgcccgcgcctgctctcgcccttcttgccggaaccaagaagcagccaccagcggcacgaacagagcttctccatggccatgggattgggggaaggggacagaaattgtgacggcagtgacgtacggtagtggtatgttttcaaatttagaaaattttgatggcacgtagtaggttttcgttagtaccgatggtattttttctagaaaatatataagaaaaaggaaaaggtgtaactaaatttatagaaaaaaatagtaacatctacgacaccaaaatagttttattaaatttaatattgaatatattttgatgcaatttttgtttcgtattgaaaatgttactatattttgctacaaacttgatcaaacataaagaagtttgactaagaaaaaaaatcaaacaacttataatatgaaacagatggagtagtttgtttactagtatgcaactgttaattccaaacaatttaacttgatttaatataatgtgcacatgaattttaggagaagactttggttgctactaagcctatgattcagaaggccattcaagaactatactctgcagttcttcctaggacgatgcttgtcgctgacatgggctgttcttcgggaccaaatacactaaactttatcttcgaggtgataaaagcgaccagcgaatattgtcaaaggataggtcaccgccctgttgttttatgaatgatctacctggcaatgactttaactacctatttaaatctttagaacaactagataacttggtcgccaaagatcaaaacagagaagcagcaatactgcctaagtactatgttgtaggcttgccaagatcctactatacaagagttttccctgacaagagtgttcacctcttccattcatcttattccctacattggagatctcaagtaagtctgtctctgaaaacctatcccagttgagtggtaactcattaaataggccatgcatttttttttactgatcgaaagagtacaaataaactggttattagttgctaaagatttctactgaattctagtattctacaacaaataaagtagttatttctatatgtacattttgtaagttcccatcgattatatactcccataatttgtcgctttttttgagaaaataatttctctattcactcaattcatacaacatacaaaacagtgatattatgaaagtagtaaagtgaatgcattttttgctgcaatgcatgagatatccaaaaagagagaccgcattttctgtaccagcattaggagttcatagcaccaataattaatatgtgtttatatcttccactgcttttgtgcacagatgtttcaggagagcaacaatggggaattcctaaatgaagggaacatttacatcgccaagactacccctaaatcggtgataaagctataccaagagctattttacgatgatttctcaaagtttcttgagttgcgctaccaggaacttgtgtctggtggtcagatggtgcttagttttcttgcaaggaagaaagatgacctatatgatggaaacctaagtgttctttacggattaatctcacaagcattgcaatctctagttatggaggtacactaaaccactaaccctactaattacgaactagcattatacactcccattttcctatagcttaactaatttctatattggtggatatggaagccatgaaatttagaggtccgtgtatatatgaacatacacacattttccaattcaaaaaaaaaaactttgggctttcctcaggacatattctgtaaaaagaagattttcaaaccaatttgattaattgaaatgacaatttactcaggacaatgcagatttgtttcaatctaaaatgagccacttagcacttactactatttttttaaaaaaatggattaaaatccggtctctatatccaaacattattacaccttgttttctacgctgatacttcacatttccagtcttatgtacaggatgattggttgatagcaagaagagtgttataaaatgaacaatacatattattttcctcgcctgatcagtatattataaacagagtctctaaaatgaaagaacttgctttctgctttcaacatggcagggactcgtggagaaggaaaagcttgactccttcaacattccaaattacgagccatctatccatgaagtcaaaacagtggtgataagcagcaagcttttcaccatcaacaaaatttacgtctttgagtcgaactgggatccttatgacgactcatcagatcaaggacaagcaactaatattaatcctatcaagagtggcttgaacgtcgccaagtgcattagagctgtgcttgagccgttgatcgctagccattttggagaatctatactagacgtgctcttctctaggttcgcacgtaatgtcacccagcaccttgagaaaaggaagggaaagcacagcgtcattgtgctgtcgctcagcaaaagaaagaattaatcacaagagcggatggagcatgagaatttagccgttaatttcctcttattttgatttgtaatggtggtaatggcctggtcattgtgtagtttgtgcttgttcaagccttttgtgtgttctggaatgcaccatagtattttgtagtttaataattcttaaatttagaattaataggtattgagctgtatctgtgttggaatttgcttgtattatattgtacaaggaaatatcatttctctaaaattaatgattatccggttgtacctaacatgaactgctattgtttttatctcaatcatattcatctaatatttttttctttctttttttttgaatttccgttagtttgtacgtagtaaacttaattactttccatggctatttaattagtctgcatataatctttttgtcagacttttacaggagaaatctgaataggaatgctagcaaaaacgtcatgtgtattatcatatcagacatatagaagtttttctgtgacttctacgttggtaaaaaatcagattacgcctctatcaagcccacatttaaggaaacgaaatgtcgtaccgatatccgacctagtaagtaacattgattttagcgtttctcttaatccgttaatcgaatttgaatgaaacaagccacattacaacgacgaggacagtgcctaaaatttctgtttagactacataacccaatttcaaaacattttttcagcatactggttgataaattaaaatctgaacgtttgactatcgaatcaatttctattcattttttatacgaacagggatgaaaagtgtaagatcaatctgtgttttgattcttattctgtgttaaacagttggcatctgtgattattggttttgatatttgcagattatcgtcgaagtggttttggagataatcaattttcaggtgatgaacatggtttactgttttgttgggaccggtcagaccgggcggaggttgccggtcagaccagctcatgtgtagtggtcagactggccaggcccgtggtctgaccgggcaacgctgtgtcggtttcggtttcgggttgtttctttggatatccgtgattgtttcaaggttatggcttttagatggatactatacgtatgtaatactgttgtttgctaataatgagtcaagtgggggatagtttggtctcgaaatatagtttctttgtttgtttcatgtgtaggtgactcgatgcctcgggagagtatttgtggtgatggaccgggagtcggattggtggtaagacgatgtccgtgatggtcagatatcatgcgggatactaagactagagttgatgcacgtggttggtgaaaattccaaatggcatacgatagaggtattgtgtgcgtatgggatgcggagtcgaatttggaagtagtccaaatttggtatgattggttatgtaaagtttgtgtcttgtactagagggtttcctaaggtgtttaggactcttagtatgagtttggttcgtggctttaggctgcctacctcatgtataaatatagggggagagtgaggcttcccggtatcgtttttgagagcaattgagttactagtttagttagggtttcgagtttagtcgagatttttgtaaggagtgctattggtgcactttgtaaacacagagagaagcaataaagttatcatctactttaagagttcttcgatttgtgtttcatcgggttcggcggtctaaccggcgacatatcggcggtcagaccggcggcaggcggcggtcagaccgacggaggagaggcggtcagaccggtggtgacttcacacgcggcaggcaatctttaggcggttggaccggcggatcaacaccggtcagaccggtggcacgagctcggtcagaccggcggatcaacctcggtcagaccgatctacattgaatttgagagtaacttttattcccgctaaaagtttgggtttttgggtatatcaaccatttacaccccctctggttggcttagtttttgtgattcgatcttaaaaaaaggagctacccattgcaaattaaggacaaactgcatatttgaggttgaggcaaacccgctaaatctctgcagaaaatacccgaaatccttcagttctcgtctcgatctgtttcccagacgaaagcctctggctgttgcagcagctagcagcaaggatttacggtagcagcagcaagcatgcatcaagcatcattggcagcagcaactcagcgggtaaggaactgagtctaaaccaagtctaggcgattgattagtagttcgattttcattagactttatctttttaactaacagaaaaaaaaataaaaaaagatggaaaatgagagatcgatagcgctgctgtgcgcttgtgccgcttgctgtcctctgctcagttccttacctgctgagttgctgctgccaaaccaagtctaggctcagagttattaatttcgaggctttctatttgaagtggcaaaatatccgtacattgcaacgggtgaagataattttaatacattgaataagatggtgcctaaaaataacaaagtaggaatcatgcagctgtttccatgtttttttgtgttgcatgggaacctaagcttatacgggtcgaccctacgctctatttcacggtatcagcatatagtacttcgtgatctaattttgttaaaacaagagaagagggaaaaaaatctacatttatagtatcataaatcgattatgcatgtaataaacaaacacattaatccttttattatttttttcgagttcaatacatcaattagtcacatgcaattaaaacaaacactattcaaatcatgtctaccttttggatcccctccagacaaaggtcacacatatatttttttctcctataaatactaattagccaaaaaaaaaactgataaccggtgtcgatgatcggtaatttttgaagtcaccacagatgtcttggtgtcaacggataagtcacttataaatgaaagaataattagccgtaaatttgagcacccatgtcaaatttagtatttaaacacgggttgactgattcaaccacaaggaagctaactagttgaactacgcttactttgcaatgctaccagtttatttctagtggaatatattttgacactatatgatatcggtgattacatgcaacacaatttgccatgacaaaagaattatttttgatagacccacaaataggtaataagaataaaacaatacaaagaaccgtaaaaacttttctaattttaacctagaaactctaaggacttagtcttgttttaatatggttccagtccttttgcctatcagctaacattattcattttgtattttttacatggacttctttttttcaaataaatagtttctgcccgtgcaccccaagggcccaccttgggagagacagcccagtagcccacggcatggctttcaagcagcagcaccagaccgaggcccaagcgacctaacatatgttgccgacttctatacggacgggtagacgtccaagtcaaaaaaaaaaaaaatccgtattagaagcggcttgacggacgaaaagtcgaaaaaagatgtgtaaacgaggtgatgagtttttaaaatgtactggcaaaaatgcccgtacgttgcaacagaaagaaaaaacaaaaaagatgaattaaaacatattaaattctaattaaatgaaatacaaactttctagaatatttaggtattttttaagcaggtaggtatataattaaattaatttacaagtaaagtaagtgtgaggaataaaatgatatggtaggatttaatttttattaaattctccatattaattacactttttgaaattttcttcaaatttatagagattaattgctaattttgataatgcaaatattattttagtatttatttaaataaaaatctaaataaatatccttcttctctgtggaccattttcagcccattttcttcctcagccagcaagcgaccaaagtctaattaatatcctcatattcctcctttcacttgccatgtgagccgtaaccagaaatgtggtgcggtccggtgatgcaggccagcccaacacgatcgatcgatctgagctgttcgttttgatggacggctcggatcggttccaaatcaattaaaaccataacactaaccctcccccctcccccgaccggctctcccatcccccatcccccctcccaccatcggccgcctccccgcccgacgccgagaaagctaatcggcgaatagtcacgcgcccgccaccccgcgcggtgcgcgcgcggagagaccaggcgctgacacgtgtgtgattttttcctttttctggttttttctttccccttttttgtggttttctgttccggttttttctttctgtttttttatgtttttttgcacttctggtatttaacatatacatatacaaactatgtatacacacagatacaaactttatatacgcatatacaaacttatttttacatgcgtatacaaactttgtatacatgtatttttgggtttttatgcgtacgtatactaattttgtatacatgtatacaaagtttatatgcacgtatacaaagtttgtatacacgtattttttaaattttttatacgttcgtacacaaactttatatacatgtgtatattttttatacattacaagtgtatacatacaaaaaaaaattatatacacacacgcgcatgtatatactatatatacatacgtatacaaagtttatacgtatgtatatatagtatatactatactacatatagcagtatgtatagtagtatagactagagggggggcagctgatcgcgcggtgctccgctcgcgaccagtcgcgtatcagcgccccccgcccgatgtcgcctctcccctctcccctccagcggcgccgctccctctcccctccctctaccctccggcggcgctgctcagtctccccctctccctcctgtctcgccggcacagcgcggcgacagtggggtgcggcagagatggcggcgacggccgtccctccccctctacctctccacgtcggcctcgacggccgtccctccatctcgacaacggtgccctctccaccctcaagatccggcagtgccctcccaacggcggtgtcagcggcgacgacggcgtcagttgcgtccgcaggtagatccatcggtggtggcgatccagcagcggcggctctctccgcggcctctattctccctccagtggcgccccgtggtcggatccaatggtgacaacagcattggcggcttcccagtgatgttttagttttcttcctgttctttttctcaatcgcttgattgtccgattagattttgtatttttttttggctttatttgccttattaagcactcgtacggacgaaaaatcacgtggactgactaaacggatggtgacgaaatgaaaattacgaatattttaattagttaagattaagattttggccggcgtttttttctctttggcttttttttcgctttttttttccgccgcttttcttgctgacggcgttcgggcctttttttttttctgttttttccttccttttccgaattgttttctgattccatatttgagacggttttttcggcgttttgtatttttacttttttgggcgcttttttaaaaaatgcctttttagatggattttttttttctcgccggtgttttttaaatcggaatggtttttctctctctctttcttttcggacgatggaaacattttgcacttttaaaacagtagaatagatagatagtagagaaatagactaacaaaataccggtgcgttgcattctaatctcttttgtttttcattactttactctgtggaattgggctaggaacctatgatgtgttcttcaatgcaattccgtttcaacacacatgcatatttgctagccatatgaaagtaattccaaacataaatctaaaaatgcaacatgcatgacaaaatattactagttaagctattaactttaaagttggtaaatgttgattttttaagaaaattgtggctgccttataataatttaggatagagatagtagtaaattagcgcggagagatgaattaatcacgtggcttcatcactccgccaataattttgaacaagggaaataatagcagcaactttgtctttttccttgtttgttaggcggagaaggactgggagagaccgaccggtgacaacgagatgtagctagcgacgagcagaggaattcccatggcagcgtccatggaggcaaagagggatggagaggggaggttaaggggaagcccttagctcttagcattcccttgacatgctagaggcatatgcctagaaggtcggagatggcacacagtggtgaattgactgcgcgcctgcgcgggcgtggtggcttggagaaattggcggaagcggattgatgtgatgttgctcatcttttaataagtactccctacgtcaatccaaaatcagatgtgacactatatagtacgacgaatctgaacatgaggcatgttcatgttaggttcattctaatatgtagtgtcccattcgtatctcccaatttgttacactacattggatcctaggatgcaatattataggatggagggagtaggtaaaatatataaagttttttttcgaaacaacgtaagatatatacggtttcaaagtcctattgtattgttttgtagtatgatattgcgtttaggtgaagcctataacagcccttcctccagaactgtgtagccaacccatccgatgggcgggcccacttacacataccactccgcttatacttttgtcctcgcttcgtgtaaaagggttaacccgagagtgacatggttggaggaaagaggccttataagttggtcctcactttgtgtaaaagggttaaacctggggtgatatggttggagggaggagtccttgtaagttggaacatggttgtaaggaagaggccttataagttgcttcaagagaccttataaattgcttctcgcttcgtgtagaagggtaaacccgggagtcatatggttgaagggaagaaacattataagtttgttccaaaccttgctaaactagcaagctgtaggccgtgccgtaaaattcaggggtcctgtgcaaaatcactaaattgataataataataataataataataataataataataataataataataataataataataataataataataataataataataataattgatggatcttctttttaatatatttgcatagctcctttcttctattgttttttttcttcttacgcttttcacgaccgaagttatattttgtaatctgatttgtagacgatgtggcttgaaaattaaaatactagataaacttatacacgtatagatacaacatgaaaagaaaaaaaataatttagtccacatagtagataaaccaaataacctatgcaccaaaattgagaaacattatcatcaaataacatatgcaaccaggaggccagaagcagcgacgtaacacgtcgactcccccggtaaggcagaaagacggacgagcgatcaaggagacgaagaggcaacaaaaaaattggaagacgaaacgacagacggatgagcagtcgatttaattttttattgagctgcccacacgcatgtacttggggtattgggcctttgtggcccctcgaagatggggccgggacgggcctggcaaggtgaatttaaacatatgcagatagctcttatgggtcatacaggtcaaatcctagttggaccagaatgtcgcaaagccaaacctattgtgctatagaaatgaccaagatggaccaccgacagaaaaagttcgtattttcgaagtagtagagaaacggtttcaaagttaatttttttacatatttcttttaaatatttttaacttgaatttatattttttcagaaacttacatttgtttgaagcacatggatattgcacctaagttaaatatttcgtgtgcttagcgtgttcagtttgatatgataagacaagtggagagaggggaaggcagagagggcgacatgacaggtatagcggtacttattatgccagttgacattaattgatggcatggcaagctgattgcaacatggaacaaacgagtggccatggccatgtccacatagccgcccaagtcctttttgtaattagctttctcaactcacatttcttgtttttcacgtttctgaaactactaaacggtatatttttataaaaaaattctataaaaaatgttttaaaaaatcatattgatccattttcaaaaaaatacgtagctaatacttaattgatattgcacctaagtcaaatatttcatgtgctcagcgtgctcagtatgatatgataagacgagtagagagaggggaaggcaaagagggtgacatgacaggcacggcggtacttattatgccggttgatattaattgatggcgaacaaacgagtggtcatggccaagtctacatagccgccccaagtcctttttgttagctttctcaactcacattccttgtttttcacgtgccggcttgtgaaactactaaatggtatgttttctaaaaaaatatataaaaaattgttttagaaaatcatattgatttattttttaaaaaacatagctaatatttaattaatcacatgttaatggactgttcttttttgcatgtttgaacggagagttcccaactctaacaaaagaacatagcatttcccatactttcccaactcatctctctcgtttttcgtgcgcgcacttcccaaactactaaactgtgtgtcttttaaaaaaaatttatataggaaagttgctttaaaaattatattaatttattttaaattaatacttaattaattatatggtaatgagttattcgttatacgtgccgaagaggaggagggttaccaactcttctctgaatccagcctagaccctccctttcctcacctacatccctccagcttctctatcttgttgcagtactatttgtgacagagatggtgacgggggctgtgtccggtagcacgaaaaatagagctgtccattagcacatgattgattaagtattagctaattttttaataaatggattaatttgattttttaaaacaactttcgtatataaactttttgcaaaaaatacaccatttagcagtttgaaaagcgtgtgcgtggaaaatgagggagaggggttgggaactagaagttccgaacacaccctgggactgcgatagtgatggcttggtgctttgatgaagcctagtcttgcgctaattctagatccaacgctgataagctgatcactagaggtggatcggccgccacaaggcttgggagtgacggattcgccgccggcgagctgagaggcagatcattgccagcatgttggggagctagtggcctctactggcatggtgggtcctcgcattccatccgtccaaaaactgactctgcctcatcctcgccttcatgttggctattgtctactccctccattctaaaatataagcattttttggactctgatacggtttccaagatgctacttttaccaataatatataaaagtaagatgttttaaataaaaatagttacacattatgatagtttgtttaatgataaatctagtaacattaattttacatgattgatctgtcgaaactagatttcggcaatataaacggggtagcgcatgagacctacaagtggatggatgcagaaacaaggatttagacaggtttaggccctcttaacgagagttaataccctactactattcggggatttgaatccgccgggtgtaatattgatccgacgatctaattgtgaatcctctaccctagaggacctcctatccgccttatataggatgaggggcaggattattacgagatagaaaccttaaccaatacggtatcgattttctaaacctactttacaatattatcaaaccaggactttagactgttccgtaatatacaaggaaatgtaatacccaagtcatgatccgtacatattccatagatataagttatcctctataactagtcggataactatgccctgtgggtatggggtacccataatctccacgtgatcttttttatttttgttctttttaatagtcaaagttgaaaatgtttgatacgtcactgtgctaaaaattcttatattttgaaacggagggattacctcgctctctccttcggactagcttcgaagcagctgaagaccccaatccacatcttgatttgtgctgcgtgtttcccgtctgtgaagatcgatgtttcttaggcctttggttccgtgtggtctgtttacttgtctatgaaaattcgttttcaccgccagcgaaactaatttagtacgtactactccagtagttacacctgctttctgtacgactgtaccagtgttagcttgtgggttggcacagatttctcttgcacaattttagatattctggcttctagctagctggcatatgtatagtactgctggtacatgtcttggtgatggtctatatatgatggcacctcgcaatggagagagtacccacacttgagttgcattaatattgtgcttattgttgctactcaaagacccacatatctaataatccaagacaagccatggtcaatatcgaaggcgatttacacatgaccagtggggaaggagaaggtagctatgccaagtactccaggcgtcaggtgattatattgctcttcgttttattttattttttggctgtcaggttacatatatgtgtacaaataacaacatcatgacgtgtttggtttaccttggtaaattatgtttattgtgatttatcaaatatatataacaattagcttttcctcgtataataattattttctctgcatcttcttttctgctgaaaagcacgaatctctgtcgtctcttaattaattatcctcacagaaaatatatatgtgctgcaattaacaattagccataactattcgtagtactggagaaatttgtttagaagaatggatatatctgtcagttattgataatattaacctagcatctacatactatacaagatatacatgcattagacataggtcgacattgtataacaccatataacgtgtctatatcatgattaagagctcaaaattttcttttctgctcattgctagacaattgttatagatgaaactaagccagtcatcgagaaagctataatagaagtgtacaaggctattctccccaaaactatggtcattgcagacttaggttgctctgcaggaccaaatacgatgttcttcatgtccaatgtcatcaacatcatagcagaccactgtactaagttggatgaacatgatcctatcgaacttcagttcttcctaaatgacttaccaggtaatgatttcaaccaactctttcgatcactcgaaaagatcaagacctcaactacgatgtatcacaagggagattcgcttccatcatactacatatccggtttgccaaaatcatattactctagacttttccctcgtcagagtgttcatctcttccactcctcgtattgtcttcattggcgctcccaggtacgattattgatataaaaatgttgttgggaacatatcctatacacacaagtttcccgtaatacactccatacacagcaactaacaaatatcacagaaaattatatgaaaaattcggcacatactttcaatagtattgcacctatatgtgaaatcttatcttcaaatttattatattttagctgtaaaaaaatagagaaaattctaacagctttgtactctgaaaattgttagatttttcacttttttgttacagctaaaatataatgaatttgaatatgagactttgtcactttgcatatatgtgtcatcctattaggagtacatgtctattttttcgacatttgctagttggtgtgtatgggaaacttgtgtgcataggatatgtttcccaaagttgtttatgcattattgcatatatctgacgtatatacatgatgtgtaccaatcttgcatacatgtgatattgcttttaatttgtagctaacttgagctgtgaaattttctaaattaagtgatgtgtacatataggtgccagagggactagaggctggtggaaaatctctctcaaataaggacaacatatacatcagctccaccacaacaccattagtagtgaaattattcaaagaacagtttcgaaaggacttttcccttttcctcaagctccgccatgaagaactagtaaacgatggacacatggtgctaatattttttggacggaaggatgaggatgtatacaatggaagtctcagccatattttgggatgtgtcgcaaagtcactagaatcacttgtttgcaaggtaagagtagagatatcgctaattaacattctaagaagagatgtgctagtcagaattaaccattgattgatcatatagggccttgtgaacaaggaaaagttggaatccttcaacctacctatctatgggccatcagatgacgaagtaatggaaatagttatggaaagccatatgtttgacttggttcacatgaaactctttgaggcaaactgggatccttatgacgattcagtagatgacgttgttcatgacattgccagcagtagccaaaatatcactacgggcattagatctgtgctggagtctttgatagcaagtcattttggagaaagcatacttgacgtgttgtttcaagagtttagaccccttgtggcccaacaccttgagagggagaagacaaagtatgccgtcatcgtcatgtccttgaagaaaatatagtagcacgtgtggtccatgaatgtcctctctcttaattacgagatgcttttaaagagatcaaacacaatatggtgacatatatcgtaataagaacacttgtgtggttttgtttccctcctttcaaccatttgcaatattgcataatgctcatattctgtaaaactctagctaaatggattgtttctccattgtttagctatatatggtgtttggttacttggctatattgatttgcctcggcaagtatctataggttaatttgcaaaatgaacttcaacatatatatacaaataattataccgtgtaagaccattatgtcaattttaccagttatacatgaaatcgtgaatgagccgctatgcataattgccattgccaaactaatcagctaccatttgttcaagagtggttttcccactgaaaatttggtaacatgcaacgttaactagcggatccaggcaaaatggtcccggggatcatagactagtcaatagcattaataataagttgaacaaactaagaaaaacatatgacgacaatatataatacaactgtatatagatccctaatatatgatctcctctctagctacatcttcgcaggtgaattatcacatcatcatttggaattgcaggtagaaaaaacatcgcaaatgaagcatatacgataaaaatcattcataaatttatcatatatatacagttccataactttatcttcatttttttaccaggaaacagtgagggaagccccacggtaattttcattaattaaaaagaactgtacaaaggaatgatgaacgccacgatgcatcgaagaataatgatatggcctagccctatgggtggctatttcctcattagggttggtcctcgtccccaacgggagagggggcaggtgggaattcctacctgcgggtgagcgaggacgggggagagaatggacccgcaggtctcccagcaggcccccggagctatgagaaaccactatgaagacaatccatttaaagacccggctgatctattttggtggtgaaattgatagaaccatgtaaaagctgaaccctaatcaaccaaacctaacttcctatatccttcactgttccccttccatcgccgccaagcgtgctctccccatccaccaccaatccgtgccctcgccggccccaaccgtcctcaccacccctagacatcgtcgcatcgtctacgccgaccgaccacaactgttgcaagagggaacgactgatgtggttgtccgactgagggttgttgtaacgtaactttgatacgttgtaattatgttggattggggaggagcgtccataatcaatgtcccagtgatgtaggtttcagctggacatcgttaacaaatatcgtgcttctgtgtgttcattaaatttgaattttctatagtgtcggttttcaagatatatatctaggctgcgtcttataacaagctgtattagagcttgcgggagatcccaggtagaggtacgagggaggtgccccacaccacaccaggttacatatgtgtctgagataggactggcacaaggtggaacaaggtgatgatcaacgaagtttaattggtgggtcttcaggtggcgatctgtaccattagatgggttgcaatcaatactgtgaggactagatgtggtgttcggattgatggcagtgggagcgattggcactactccggtggtgtcggaaactttggttggatgactcgaactttcaggcgagctactatcaacttaattatcatatattttttatatgggaaaacctgtaaatatgatgatgaagaacttatcgcagttaattgtcaactggttggattcatatttatgaagtgtcttagtgccacaccaacattttgtgtaaaaaaagaggagcttgtaaaatccttggaataaataaaatctgagtttccatatcattcattgtttctgtccatactcatcttgtatacgattgtatactggagcgtctactttttattgtccaaacatagataaatatagtgatcgaaaagacgaaaacaagatgcaacgcctatagttagccctaataattaaatcttctctagggcttgtagtatgtcgtccttgaggtcctcaaacttttcgatcccaaaactaaacctcacaaggttatccttgatcccattctcggtcttctccgcttcactcttgcccctagtaaaattaagcacgaactaattatgccaacattaattaacacatgttacgtgcgtgcaccagattaaatccgttaaatgtatgaaattgagcgagcagttaattactccatcctttccaaaatgatcgatcatcatatatgtttatacaccaagactaaaaaaatcacctcaatcaagacaccatgcacatattctcccacaatgcatgtgtcgattaaaacatcataccaattataccttagcatgcacacattctctcatgctgcattacttgtattatgataaaatctatgtccatgtggttatatgatgatcaatttaaaaaatattgttttctattatatgatgataaatttggaaagggagtaatatttactgttgtcaacttaataaaacacaaacaagggtgcataccagtaggacatgatggccggctgctgcactaggctctcgcacccgccgagcgaagtcgcgatgaagggcaactccagcgcgtcgacgaacctcatcgccccgcgcatgtccgacgccacctcgaagctgatcacgccgccggcgccggtcatctgcttcctcgcgacgccgtgccacgggctgctctccagccacgggtagttgacacgctccaccttggggtgcctctccagcagccgtgccacccgcagcgccgtccggttctgcgcctccacccgcagcgccatcgtctttagaccgcgaatgatcatgtacgctgcattctgaaaaaaaaaatatgtttgttgttgtaacagtatataagtgaactgtaacaaaacggttaggtattgctccccccgtttcaagttgtaaggcgttttgactttatttaaagttaaactactctaagtttgactaattcggtagaaaatagtagtaatatttacatcaccagtatagtttcattaaatttaattgaataaattttcataatatatttgtcttggattaaaaatattactatttttcttgtccacatgagcgcccacagcaaaataaaccggcacctttatgaagaaatagatgtcagttttagagaaaaaccgacatcaataatatataggtaccggttttgttccacctctaatttattatatgtgccaattatttaaaaaaaccaatagctataatatattataggtaccgacacctctaaaaactgggccaagctcctctctctccagcgtcgacggccgcactgccccactgtgagcggcggcagcagcaccctcccccatcgtgagcggctgcggcgtactcctcaccctcaagatctggcggcgacagcggtgtccatagccttccgcgggcagacctggtggtgacgatggtgtcagcgacttcccagtgttttgttaattaatttttgtgatttttgcggtcaatgttgttggttgatggatcaatattgatgaatcattagaatttttgtgatttgtgtgggtgatgttattgaatgtgggctgctttgcgagtgatgtggaactgctcgatgcattagcttgaatcgagatgtattttttttttgcattatggaaccttaaggtgccagttcctaaaccgacacctttgaggaggactcaaacatacgtgatgtctaccgggtgccagttaagaaatccaacacccataccggttgtaaaatccgtcacccatggggtttcccaaccggcaccaatcaccttttgcatagtagtgaatacactttttaagttttagttaattcttaattaacgatgtaataatcaaccgctccgttatatgtaccaagggggaaggttcccaatcctcttaaaacaagaaagctagccaaagggttactggactgatggcgccgccaaggtcgtggtgccacacgcgtatgcgcgagatgagctcctccgagccgctgacgcagccggcgatcacgtcgtggtggcctgcgatgtacttggtgatgggagtggaggacgacgtcggcgccgagggtgagcggcttctggttgatgggcgacgccagcgtgctgtcgatgcacaccagagcgccccgctggtggcacagctccgcgacgcgccgcacgtccacgcacttgaggtgagggttcgtcagcgagtccgcgtagaacatcgttacctgcacacatgtacattctcgatcgttagaatattttatccatgtgtgtgtgtctgtgcatcggaatatcgggggttcgtgtgtcacgtacattgccctgatcaagaacggattgcaacgcctccatgtcgtccagatcgacgaacgtcgtctgcaaattaatgaaacaatcgacatcattcaatctgcaaattaatgtcatagtaggagctatatattgcaatggtgcgtgtatattaatatgagatttactctggtccaacaaaaaatatctcgaggtaccggtaccgtacggtattaaatcgtttctcaatgttggatctagctgggtaggatgggtattgttagatccaacgatcagaaacaatttggtaccatatctcaaaatactttttgttggatcggagcaaatctctattaatatagcttaccctaatgcccattttggagagcctgtcacgtatgaaggcacgcgcctcgctgtagcagtcggtggtggcgacgacgtggccgcccggcgggacgacggccagcagcgtcgcaacgatcgcgttcatgccggaggaggtgacgatcgtcgcctcggccttctccatggcgctgatcttgtcctccaggacctccacggtggggttgccgtaacgggcgtactcgaagctgtgccgccgccgccgccgccgcccgccgccttccctgaaggcgacgaggtcggccgagtcgcggaaccagcgcgccgtgccggtcacgatcggcgtcgcgatcgagtagtccgtcacctccgccgcgacgccgccgatcgcgcgcgcgccgccgctccccggcgtggacgacgagcgtgtcgtcggaggtgtgccgccggcgccgctgcggcgtcggagcgtcatcatggcgatctacgtcgtcgagggtagtcttggaagtccggcgaccgagggcaaagcgtggcaccaaagatatcggcagctccatcaacggtggcgagaagaaccacgtacacctcggagttaattaagctcagggtcagggacgagcgcggccgtggctacgtgttcagccttgcagggacaaacgacgagggcacggtgcattcagtgcatgtgccgttgtagtgggagtggaattgtaattagctgtttgacgtccacctgataattgtttattaagtactaattaaatagttatgaaattgctaaacactattatataaatgattttcttgcatgagcatccattagatcgccggtgggccataagtggctgcacctgcaaaaaaccaatccccaggaacgggttgacctaccacacgtcaaggggggtggctgaagtgcggtcagccgcgagcggttgcacccgcgcggcgcacctcctccctttagcctcttacgtatctacgtatgtagataatacgaatgttatacatatgtatacaaagtatatacatatatatatacatacactatatatatatatacacacacacattgacgtataaaaatgtatactaaattgtatatatgcatataaaaattttatatacacatgtatacaaagtttgcatacatatgtatactaactttgtataaatgaaaaaaatacaccatatatagttcgtatacatatgtatgtatacaaactttatatacataaatattaaaaaacaaaaaaagaaaaaaaaccaaaaataccgaaagaaaaacgacaaaacagaaaaaacctaaaaaaatgaaaacacctgaaccaggctaccacttgcgcccctcccccgcgccgttccaccgccgccctctgcatgcacgccacatagctgcgccgcacgggagaggcggcgcgcagatatccttgtattagggatttcgcaagcgaagaccgattatcatcagcggtcgcttaagaggcccgcacgcgataacgcggccaaatctcatgcgaccttcttaagcgaccgcatgcaataatcgatcttcgcatgcgctcccttaattaagatacttgtaggtgattatggaccatatatcttctcctagcctaagttgccgccatttgaaagcgatgtttctctctctaaaacgaagatataaatagggggaggtttttcaactcgaaatatttgcttgcaatccatataaaaagttacatgcttcatttcctctttcatttgccgccttttatttctcagtttattggtgaaatgtgacaatttttatagtttttttaatggaattttaaaaactattttgctatatttagtgcaaatatattgtttagatgaccaaaatttttattctaatcactagttcttgatgcttcaatgtattgtagtttaaatttttaggagatatttgtttttccatgatgtgtgagaaacacatgcactaaaattttattcgtactgtaattatttataaattgattgggcatggatgtacgagacgtggataactcatccggcgttcatgaaggaagcatcaaaatttactgatcaggcaaggcatatgccccgagggagaataagagggatatttttctgtccgtgctttgattgcaagaatcagaaaatgttgaaagatccgaagataattttgaagcacatagtgaagtgtggattaaggatgattacaagatatggacatatcacgaggaagttgccattcctaaagagactcttgatatatatttccttcgatggggcagaaaattttacaatagaggacatgtcccgtgatatggttgatgaatttggtggctcggatattgatgatttagatgctgattttgatttagaggatatgttatgccatgctgaaccagaggttctaactggtacaatgcaatggttagacaattgggaggtgttttataaatgagcgaaggatcttctttacgacgaatccaagacatgtgataaggattatatggtgctatgttatgtgctagagcttctcagattgaaagctagacacggatggtctaatactagtttcaacgatttgatgggtctattgagagttatggttcctaagcctaacttgttgccattcaacacgtatcaagcgaagaaactgattttccattatctctaggtgttcaaaaaaatccatgcatgtgttaatcactatactatactacaaggaatacactgacttggacatgtgcccaacttgtgggacgagtcggtacaaaagggtaacggggcctctgatagtgatgttgtcgacccagttttgttggtggatacaaagagaaagattttggccatggtgatgtggtacctgccaatgaaagatcgcatgaagcacatgttctcaaaccctatcaatgtcgagttaataagatggtatctaaagaatcagaagatagatagatgatatgattctgtagtagtgaaaaatctgtagtatttttttttcaaaatacttccaaatcaaatgcaactacttgtagtgtaatacaatataaagttgcattggaatctctatataacttataacttaggaacaaagttgcatatattttttgtaacatttatatataggttatattaaagttatagtatagttatgatataattatattacaactatactatactgtagtacatttgaaagttttccacttcaaaatacttgtggtgacattttagatagtcccaatggttattaaaaagtttcgaagaaattgacaagatagattaatatgaagtatatcacttcacaaatatgctagatcaaattcaaattctacaagttgtaacaaaaataataaatttaactgtaaatatgtgtatactaattagaatttaatctgtcatttttgtaacatcttgtagaagttcaattcaaatttctatgtttgtgaaagtgacatatttcatataattttgttcatagctgtttagttgatataattaaatgggtggatgtccacgtaagttgaattcaaatcaagcgcgtaagtaagacaataataatgccaaagtattccatgtctccatctttttgttcgtttgcagatatggatattataaaaaattgatggaccaaaatgtataaatgcataaattactctcacggtgcaaaatatttggtaaggtcaaatagataaaataatatttagttttggtgtagcaacttatctctggtccgtgcgaaccaaggcaaaaatagtgcacataaacgaaaattatctgaggtggcactcatattgatggtacgtagacctgcggtacatagttgtacactactaagaaaaagacacgtatagatcggcactataggtgttggaatagctaaaactggcagccgagccgggagcctagtctgaacttttttagcgcaaagcggctgagagaggggggcaagtggataagccccacactcgcccatctctctctctccccctcaccccctcagcctctcctcccctccatctcccgtctccgcggtccctccacctcccctatccacagctctctctctctctctcccctaccctcctcctcccctctatggcgtcaacaacggttgggcggcgtaagcggtggctccaagcatggatctggcgttgttggcaagcggggcggcgtcagcagtggatccagcatcggtggcgtgtaagatagaatcggtgacggatcagacatctgtggcatgcgaggcggcatcagtggcggtcgggaagcagcgacggcggctcctagcacggatccagcgtcgctggcaagcggggcaacatctgcggtggatccaacatcggtcgcatatgggatgatgtctacgttggatctggcgtctgtggtgtgtgaggtagtgttggtggtaagcgggatggtgtccatggtggatccggcatcggtggcatgcggggtggcattgctggtgtgcggggcaacgtcagcggcggcaggggcgatgtcaacggccattcccacaacatatcaagcatcatctgcgtcggcggcgggcgagatagtgtcggctaccgttcccgcagaggatggtgaaatgttcaaatacagcaaagtgcaaaatgaataaattatggcctacaacaaagcccatcatgcgtcgtcttcctctatttcaatgattggatccgtcttcttcctatacagtggttatatccgccttcttcctccactatggtgaatggatccgccttcttcctctggcatcacctcacgtgtggccagacggagatcattggcagcaaagtagacctccataatgagagaaatcaaatcgtcacgatacgagaggacttgcttgatttgtcgccatggtggatgagatctgcccacacacaacgtatattgtctcacttgtatgaattgaggcaccacgggaagtgcggaaatgtagtggagggtcacgtcttatttttgttcccgtgtcggatgtgggacatacatcatttccctatagcaaaaccaacatcttttatacaagtgaatttcaattattgattttctttgttttttatttttttgattaatctagatgcataattgtgcttatatacattatattgtctaatttcacattggtatgaatttaaaccaaagcatacattatttcatattggtaagaatggtaagaatttaaaccaaaacattcttttttttaacatttaaggatggaaccttatttgtttcaccataagaaagaatatatgtaagtgtgaacttgttgatcacgccaaagtatcgctgcctcgattaccagctatgtttcttcaggaatcctactttgtgcacgttacctagcaacggaattagtgcaagccttatccacttatcctttccccccatcgctcgatccctttcatccatggttcctcctgtgattcttttcttccttctacggttctcgctttgtcacctcccggccggtgacgcaactagcttgggcaccacctacttacccctctaccttctcttgaactagacgatggcgagctaatagcatcctggtggcatgcagcacatatctttttcatctcttcagcaacactttgcttcaccctaccccgcctcctccaccacggcatacatgtaagcctagacttttgtgtttcgatgacctcctacctagcatgctgattcaccctaccccctcttcctctaccacgacacgaagagatgcttacaaccgtaggctcatccttccgagtgacatgtaagtgcctcttttttttcctcctctttatctgatccagataggagtatccctagaaacttccactgatttgagtataaagttttcagttgaaacatttcaaattgaaataattttgatttgaaagtttaggattttgggtagaaacttttgaatttttcaattgataagtttttttagaaagaatgaatcggtagttatagcccacaagtttaaaggttttatatttttaattaaaaattttgccattttttagatgaatgttttgagattttagttggaagtttcatatttcagatcgaaaggttttttacacttagttgaaattttaattcagattagcaaaaatgcttgtgcgttgcaacaagtgaacataattttcatgattgataaaaactctaccagtttaaacgacaaaccgaaacaagataaacaaaataaaggtaaagcaaagccagaaaccatatatagtattgaacccggttgcacttgcttcatgcatcatcacacaaaagaaatcccttatctacacatttccatagcctaaaaaatcgatcgggtcgctattccataagttgatacatgtgtattttgcagtacgttatcgactaaagattgagattttgattattcaaattagtgaaattctttttacatgtagatggaaagcatttgcaaagcaacaaactttctgcatacacaacttaataataatttcaaaaggaaaatattcgtgggagaaaattttgggagagaaaaaaagaggaaaaagataaaaggaggaggaaagagaggatatttgtaggagagggagaggacatgataattggaaaaaaggaaaaggagaaatagaaaaaaaaaggagagaaagaagacgttgtcgaggtaggggtgcacggcgccgagtggaggcatgcgggacggtgtggtgggatgatatgggtcagttgggttgggctgagagatggagggggaggggttgggctgggaaggggtgtcttttttttttataatgcaatagagtgccgacatttgatcaacgagctacaaccaattattacataagctcgcgctagaaaagagcacataaacaagtcttaaaaagcacaccgaaaaaacctaaagcaacgacaagctaataaaagcccacaaaacataaagaccctttaattattgaatcctatttgtaaacctccaaccataattggccaaaaactgcaagaccatcgacttaacaatgtgatatctagttttagctcggtgtcctcatcacacttttgtatctaaggctagaaccggagctaatacgttaccctaaagataacctgcatataagatgaattggatacaggtgactaaaactaattaaaaaaccaacactaacactgatgacgtaccaatttttttacgaaaacatcctcaatttttttaatagtaaagaagagattataaataaaaacagtggatctcaagttctatcccctccggggtactgcatacgcgagttaagttcgacgtgcggctgcacgaattagcagcccctatgtttcctcttacatatgatgagaatacgattaaatataaattacctcttcgcacatgatttaccataaaattccgttaaataatgtattcttttatgagtgatatgatcgatgatcgatacttttctgcatgttatttggttctgaaataattctaattaatgggattagcagtacagtatagaatgctagagggcggtacagacgttaggggataatgttacatcctgacccacatccggcggcgccgagcactaaaatctcgtcgcgccggaacttggatgccactaccgtcttcccttgggtcccacggtaggtagctagcgacaccaaacacagctgaatcctccagccaaattcgccgccaatttcttggatctagctagatcgtgccattgccacacgagaacctctcgatgacgcgtcatcatatcgctctcgtacgtccgaggatgcagactgatcgtcctgctatacgtacgcttgaatcgaaactggacatcgttggatagacttgttgggggtagttctcatcttgttgaatgccgtgccgctgtcgattatttctgagattctggccggccgcctccacgggtcgctaacacagcaccaatgatcgatcacctttggccattgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaacctcaacaactacatgcatgcaagctgtcaggtcgtgatcacatgatccgaacctttcttgctaactaacaccctctctcaatccggacctaaccaggttcagattgcttttgaaattctccaggagtcttactgacagaggtttagtgaatccatctgcaacttgatcattagtggaaacaaaatcaatttctagaagtttctgacttacccgttctctgacaaagtgatagtcaacttctatgtgtttcgttctggcatgaaacactggattagctgacaaatacttagctccaagattatcacaccatattttagcagcttttggacttttaatctctaactctgcaagtaaagtctgcacccacattatttctgcagtggcattggcaatagctttgtattctgactctgtgctagatctagacacagtggcttgttttctagcattccaggagaccagatttgaacccagaaatattgcaaatcctcctgttgatcttctgtcatctaaacagcctgcccagtctgcatcagagaagccactaactaaagtagatcctgacttatgaatttcaagtcctaaccgagtgcattgctttaagtacctaagaatccttttcacagcaatccaatgtacagttgtgggagcatgcaagtattggcaaactttattaacagagaaagctatgtcaggtctagtaagagtcaaatattgcaaagcaccaacaacactgcgatagtgacttgcatcttcaggccctaacaatgagccttcatgaagagagagtttctcacttactgaaagaggtgtattagcaggtttacaatctatcatgcccactttcttcaataaatcattggcatacttgtcttgattcagtacaatgccattctgaaccttgcttacctctattccgagaaaataatgcagctcaccaagatctttgagtgcaaattccccttttagatcctgaagtaaagctgcagtggccctctctgaagagctggctacaatgatatcatcaacatataccagaacaaacatagttatatcacctttattcagaaagaacagagacgtatcagcttttgatcctttaaaaccaaggtccatcaactttttacttagtctagagaaccaggctctaggtgcctgttttaacccatacagagctttatcaagtttacacacatgatgtggcttagtaggatcctcaaaacctggtggctgtagcatataaacttcttcttctaggtacccatgcagaaaggcattttgaacatctagctgtctaagactccaacctttagacactgctaaagacaatattattctgatagtggcagctttaacaacagggctaaaggtatcttcataatcaataccatacctctgtttaaatccttttgctactaaccttgccttatacctatctagggtaccatcagctttccttttaattttatacacccacttacagccaataatatttctccctctctgaggaggaacaagatgccaagttttattcttaactaaagcatcatactctgaatccattgctagtttccaatttttatcctttaaggcttctaaatcatttgtaggttcacctgaagcagtaaaccaagaatgcttatatttaatagtaccatcagtatataccttttccttgcgaactccactttgcaacctggtgcgcggtcctgccggtgcctctgaacctgtgtcagtcacatctgcatgctgtaatgtattagtctcatctgtgacagcctgtgcatgttcctgcgctggtgaggactgctcctgctcctgcaccacctgcgactcctgctcctgcaccgcctgcgacactgagtcttctgctgtctcctctgctagcgatgatgctgccccccgtggcacagaaccaggtgtgggacccggatgacggcctgatgacgtggccgcaggggagtggtggacgacacggtctggttctggaccagaactggcatccagaggaggcgtcgccggcggatcttctgcatcagcgggatgtactgcaccatctctatgtggctcattagcacgattagataaagcagcagaaacatcagcagataatggattagtcactggatgcatgcattgttcattcccaacagaccgtatgggtcctagcagttcaggagtgagaatatcaatctcagaacgaagacgggcaccagcattggcatgaagttcagtgaagggaaaaatattctcatcaaagacaacatcgcgagaaatatagatgcgtcctgtagagacctcaagacacttgaaccctttatgcatagtgctaaacccaagaaaaacacaatgcttagagcgaaattgtaatttgtggttattgtaggggcgaagattaggccaacaggcacaaccaaaaattctcaaggaggagtaatcgggtttttgtttgaacagtttttcaaggggactaatattatggataactctgctaggcacacggttaataagataagttgccgcctgaaaggcttcatcccaaaactttaatggcatgaatgcatgagataggagagataaaccgatctcaactatatgacgatgttttctctcagccgacccattctgttggtgagtatgaggacaggaaacatgatgaacaatgccaatcttagaaaaaaaagagttaagggattgatattcgcctccccagtcagtttgcatggctagaatttttctatcaaattgacgttctaccatgacttgaaactcctgaaacttgtcaaacacttgagacttatgttgtatgagataaatccaagtaaatttactaaaatcatcaataaaactaacataatatttttttctcccaacagactctggagcaggtccccaaacatcagaaaagacaagttctaaggggtgtttggaaacactggaagaaataggaaaaggtaattgatgactctttgcttgttgacaagcattacaaactgactcactagacaaatctgaacaggggaggctaaacttattgactacttgtttaaccgtggtaatggaaggatgaccaagacgatgatgccaccggtccaaagatagtttgatggcactgtaggcttgcttcaaggaggagtgtggtagaggatatagcctgcgccatgatcttcccttaaggagagttttcctggtgatttgatccttaagaaagaaataatcacgatgtaattcaagaaaggcagagttatcattaactaagcgatgtactgaaacaagatttttcttagcttgaggcacatataaaacatttctaaggtggatattacgactattgggattatgaacaatagcatgaccaatatgactaatatccatacctgcaccacttgctgtgtggatttgttcaccaccgttgtatttttccttcatagtgagcttgtctagctctcccgtgacatgatctgtagcaccagtgtcgatgtaccaatttgtgtcaattccataggagttaaccgctgcagctgcaacatgcttggcgtcaggaacgtaatcctcgtcgtacctataccaacaatctgctgccgtgtgcccccgtttgaaacacacttggcaaattggtcttttatcaacgcctcctggtgtgcggcctcgaccacggccacctcctccgttgccgcgaccatggccgccgccgtcgccgccgccgcgcgaacctccttggccaccattgctgttgccacgccccccgtggctgaagcctccacggttgacaacattgacggtgacctcctgtgcgccgcggtagatggcttggcgagcttcaaagttcaacacttgagagtacagatcactcacagagattggttcaacccgagcgtagacagccgacaccacctcgctgtagccctcgccaaggccggtgatgatatactgaatcagctcctcttcatcgattgggcgacctccggcagtagccatctcatctcctaaggatttcatttttgcaaaatactcaggagttgacatgttacctttctttgtattggtgagagcaaaccgagtgttaatcgctcttgctcgtgtgtgggtggagtacatctgctcaatggcgctccacacttcagccgcggtgtcgcatgtagcgacctgcatcagcacctctcttgtcagcgacgagagaaggtaccccagaacttgctggtcggtggcttcccagtcttcatgggctgggttcggctccttcttggtggcgccatcttttgtgacagcgatctctgccggcggccgcttggttgcgccggtgagatgcccctgaagccgcgctcctctgactgcggcgcttacttgcaccttccagagcgcatgatttgccctcccaagcttctctgagattgggtggccttggaacggatttgtggcagccgtactggacgacaaggccatgagtattgatctcttagggaattgatcaacgctctgataccatgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaacctcaacaactacatgcatgcaagctgtcaggtcgtgatcacatgatccgaacctttcatgctaactaacagccataacttcttttttctttttttctttctatatacaggagacacatgcacataccaatatacacgcaacatgacattcacatctcatgaatgtatctcctaacacacgctataaaagacagaaaccatcatcacaacccctatcttattaaaatcttacggaaagccctgtgtaatcactagtacagatcctatcatctgtgacgggctcaattatatctgtactacttgggccgtcagaacgaagtcatctcaattatatctgtgacgggctcaattatatctgtactcactctaagcccaagtacatatagcccgtcactgataacactcatctttgacgggcaaagatttaggcccgattgagatgacctcgcatatctcaatagggcctagacaccgagcccatcagatatgagggtcatcggtgacgggctccaaatatggcccgattgagatgactttaaagcccgtcaccgatgattcatatcggtatcgggcttttgttgatgcccgttagagataacttttacttaggtcatttttttatataactttttttctgaacagcttgagtttgaatttgaaaatatgacaacttcaaacaatatttttaaatactaaatgatttcaaatgaaaaaaattatcaacaacaaagttacataacataccaatatttacaacttctatttttattttggttatttttctatataaaatttttttttgaacagtttgaatttgaatttaaaaaatatgacaacttcaaaacaacattttcaaatactaaatgatttaaactaaaaaagtcatcaacaacaaagttgtataactcatcgagatctataacttttattttggtcatttttctatataacgttttttttaacagtttgaatttgaatttgaaaatatgacaacttcaaacaatattttcatatactaaatgatttcaactaaaaaagtcatcaacaacaaagttgcataactcatcaagatctataagttttatttttgtcatttttctatataacgttttcttgaacagtttgaatttgaatttgaaaatatgacaacttcaaacaatattttcatatactaaatgatttcaactaaaaaagccatcaacaacaaagttgtataactcaacaagatctataactttaatgtttgtcatttcttcatccgataaagtgctagtaacattgttcacaaaatttacatacatgttttatagtttataaactagatgagagatatgtgaattttgttaacaattttactatcactttgtcggatgaaaaaatgaccaaaataaaagttatagatcttgatgagttatacaattttgttgttgatgactttttcaattgaaatcatttagtatttgaaaatattgtttgaagttgtcatatttttaaattcaaattcaaactgttaaaaaaaatgttgtatagaaaaataaataaaataaaagttatagacactgatgagttatacaattttgttgttgatgactttttcagttgaaatcatttagtagttgaaaatattatttgaagttgtcatatttctaaattcaaattcaagctgttcaaaaaatgttatatagaaaaaatgccaaagtaaaagttatagatgttatacaactttgttgttgatgatttttccatttgaaatcatttactatcaaaaaaatatttgaatttcttatattttaaaatacaaattttatatagttcaatcaaacccggatggagaaatgaccaaaataaaaatggtagatctcaatgagttctacaactttgtttttgatagttttttcatatgagtttcatttagtatcataaaattgaattcgaaatttattttttcctagaagtctgatttgcctccttctcatgataatacttgctaaatatatatttgatccaattaacttggatttgctggtgaaatatgtgatcaaaatagatgttatgtgaatgaatgtatatgaataggggatgctagggtgtgacatccaggcccagggtttaatattattaatagaatactcataccaacaaattacaatttctttctcggaagccaatctccaaataacttggccgatgggtgacctatcgggaaggcacacaagtgaggttcaaatgggtgaccgaccgggaaggcacacaaggctaaccaaaaaacaaaatttattttttcgtggattatactcatctgtgacgggctataatctaggcccgttagagatgagagtcatccgtgacgggtgataatctaggcccgttagagatgagagtcgtccgtgacgtgctataatctagacccgttagagatgagagtcatctgtgacgggcttttgtattggcccgattgagatgtgtcatccatgacggccggatgcccgattgagttacggttttgaaccggatctggcacatatctttccttccaaagaaaggtgccgcaaatagttgccagttttaaactggatctggcaccaatctttccttttaaagaaaggtgccggtttcagctaaaataactggtacctatatatttattagacatatcagctatgagctcagaatatagcttatcctcttccgtttgagctgatcgagtaaagaacaaaggggcgcctcttgttattgctcgaccagctagaggatggggaggttttgccctaaattaaaattgattgctaaaaggttattttttttatttctcactctattccactcttgcttgttgaattgaactgtttgctatgtatacatataaagtgtgcaactgaaacaattatgtgtatttgttttctaggggtatttttttatctgctttttttattaaattagatccatcctcggatgaccacatgacatttttgaatttaagtattgacatgacggtagttgattttgtacataatattaattattaggggctttaaataatattcaaagagtattatagagcacaatgttataataattaaataattgaattgcttgtaaattacaaaatcctaactgtattattctgcgaggtttgtaataaacggtaaattattggatgcgactacacgtcggtcgcccgatggaaagctcgggaaatcgggcgaccgacgtgtagtcgcatccaataattaaccgtaaattacaaacctcgcagaataatacagaaaggattt

SEQ ID NO: 69544 - DNA, 18541 bp, Oryza sativa
tatccaaatcatgatccgattggaccattaaattcgttgcgattaaatctttaaaacaagaccacacatagatatattccgacgaatttttttaacttattattgaattatttttaaatgtttcacgatgttccaccaggtatatcggaattgtttcactgagtagatcgaaaatgtttcactcgtttaaatcaggtgttgtttcaccttatataaaaaacaatgtttcagcaaatagcgaaataatgtttcagttcactgcaacattagatatatacatagtgaaacattgtgaatacactagatgaaacatttttttggtggaacaaaaaataaaccaaattcccttaatagggggtttcaaaatatgtgggttattttattgcaatgaaatgtttcgttcactgcaacattagatctatacatagtgaaacattgcgagtacattaggtgaaacatttttagtgcaacaaaaagtaaaccaaattcccttaatagagggtttacaaaatatgtggttgatttgttgcaggtgggggcaggtaatgtggtggggcccaacagtagcgggggcggagccgcgggacagcgctcgatttttttctcccccgtcggtcgaccgacgaagagcattatcgtaaattattatattatttttctaggggtggtaaatttcttttatccttttccggttcgttttattaaattacggctgttttgggtccatttcaacggaagaaaattggtctagcagggccacagggtcatactttcttttcgataaaagctggtcttggtggtctcaatctcgagttcgctttgtttatccttcggtctccacacctcgcctgcacagttactgcaactgccgtcggtgtgttcggttaggcagtatagccaaagagcaattctacgtaatttagtaccttatagtatctaactatcgagacattctaaatttataataaaaaaaatagtatccccttaaaatcgtaaaattgctcgtaaccagatgtctactacatggctgtatctgattgcaaacgtggtcgaaacaaacgacttttgaggggataacttcataattgcttccgaaagaatcagaactaaacacgtctgatgacaaataattgacatgcgacaaaagcaatgggttttgtccataagcaaatgttttaattatatatcgtgctatacaaaggaaaggaatcttgctattaatcatctcgtcaaattcgtcgccgtttcttggatctagaaagatcgtgccattgccacacgagcttaattaataattgaacctctctcgtacgtccgaggatgcaattaaacccggtcgtcctgctatgtactccatccgtcccaaaataacttaattcttggtttccgtgtccaacgtttgaccgtccgttttattttaaaaaattataaaaaaatttaaaaagataagccacgcataaagtattattcatgttttatcatctaacaacaatgaaaatattaattataaaaaaaattcatataaaatggatagtcaaacgttagatacagaaactttggaattaagtcttcttgagacggagggagtacgcttggatggaaaaacgtaccggatatcgtagttggatcgacttgttggagtagtcctctcatcttgttgaaagccatttccccgtcgattaattctgagatttccggccgcgtacacatgtactcacctttggccgtaactgatcaaccacctccaggaacagtagccatcgatatactcgtagccgcttcctttgctatgtatatcgttctgttctattgtttgtgtttcctcgttgctgaatcgatcaagataaggacggaagtagctagtaataatcaagtacgccagctgcatcagcccagtaagcatcaccaaagagtattctaatattttattctcaaaactatatttttatctcctaaactgaatatataggaagtgagaaaactattatttttaatagatagcttaaaattgatttcctataattaaatgtgagccctccctttaactatcaacagaaaaaatgggtttttctatcctgccctgcgcgcgcacaacgcgagatgccgatctcctcatctctctcgcgatttttcttcactgacaccgatcaatctattcgagccgtctgttggttgctgatctccctcgattcccctctgccagctcctccatcccctccaatgccgccgacgcttgtgagggagacgatgatggctgctcgcgagtagggcgagaaaaggagcacgggaacattttctcccagcgcgcgcgagagagcgaagacagcgattgggaagaaaaaatcgctctctaacagtgggtaacgagatttccggaattgagaatctggattattggaagataggttagggaatctgttagatgcgatttttgaccaaactttcctaaatttgaggatagggaatagaataaggaagctgttagtgatgctctacgactacagtctacgactacagaccaaaaactgcgtctgttttcggtccattccaatataagaaaattttcgtaatttcttttcgacaaaagatggatttgggccattagataggcagttggctaaccatgtggtagttggttatagaacccgtacctataataccatatagggtgtcgatttgcaaccggcaccaacgattgaagtcatcagtgccgctagtattgtgccagcaatgatgaatccagaatgaaaatagacgggtgtcttgttcgaatgaaagtttcgggcgagaagcgttgactattataaaattcaaattttgatttattttaattttgatgaaaattctacataagaagttcttgctgaaatatcacaatgtttagtggtttgacaagcatatgcctacagaaattaagaaatttggttatctgtttattctttaatttgagttatttctggtacaaataagaaatttgatttacagtggattgatgtgtatagtttactagctttaggccatgtcctttcagatttagagttttttgcggtactttatgtatttgaaatttaactatatacccttcccaaaattgaacttctaggtacaaatatatacgtctcatcttagatacattttagatactgatactaattaaggtggtagaaaggcagtgtcgcggtagtatcaggaattaaacggtgtaatggaagaatgcaagctctaataattattttgtccgtgtcagttgtggtatacgtagttacgtacggtgtatccgatagtactctgttagggagtgtaaccaaatatccacaaggctgtatctgattgcgaacgtggccgaaacaaacgacttttgaggggatataactccataattaatcagattacttccgaaataatcagaattgaacaggttctacgacaaataattgacatggtgacaaaagcaatggaagtggataagcaaagattttatacaacatgcaattatttgaaatccttgaatccctgtgtctaactttagtcactcgttttttgagtctaatcctgggcgagtggatgggaagagcaccgtcagtggcggagctggacggaaaatcaaaggggggccagccggcttttgacagctcaaaaaattggcaatttctcctttttttcgtgtattggcaatacataaaagcgaatagtttgcagaagcggacaatatacttacatgttcatttaaactatacggcacgagtcttcactgtattgaaatcgctgctatgggccagcaagactgaattgggccatacggtggcctgctagacctggagaccatatataggggtaataaaaaatttctttttattgggaggggccatggcccctgccagcccccctcaattctgccactgagcaccgtgagcgtgctgtggagttaacgacccagctttttccgaaaagcacgatgcggggcgcacgggagggtgggaacagcacggacatgatgtggaacggtgcggcgtctgggtcagcatttcgtcaaacaccctgtgtgcgtgcaagtggctatctcaaggaaggagatggtgaatagttgcgggctgggttgggcggcctgcttaggggaagggaaaaagagaagaaaaaagtacaccaaaggtccctcaacttgtcatcgagttacaaaatcgtcctccaaccgtaaaactagatatatgtcatccctcaacttataaaaaccgttcactttaggtactttgatggttttgaccctagttttgtcctacgtggcggctgagtcagtgtaggccccatatgtcaggatgccacgtcagcaccctctctctccccctcttctctccacatatgttcacatattttcgctgatgtggcaaatgtctgggcccactcgtcaggcatggtgcgtgcaagaggtgcctctgccgctgtcgggagcaggaggctggctgccaccggtctcagccctcaccatgctcgcacgcggagatgccggagatctcggtggaggcagcgaagatgaagactcatcgtttccccaaccttatcgccgccgctaacagaggccctggtctaggaaggggcgtcctagatcatcttcggcagatcagtcgcgtgcgtcgctggtgagactgaaacagacccttggcgcctgatctgccgcctgtcacgctcgtcaatggcgtcgagcggatctagaggaatagggaaggagccggcgtcgacacccagtgttccgcggggggcggcggcgtgggcgcgtggggcggtgggtgtgcgaggaatcggagcttgtatagcagctccaacccgctgtaggagtcggagggaggagctcgtcggggaaatcctcggagacgagcgagcaacggcgacgtggttttgcttgacgacagagatacccgtggtctcctcgattgttgacggcgtgaacccctccctagacagcgtggagttgagcggcgtgtactcgtgcggtcgtgccacaacccgagcccgatgatgcttttcctccccatcctcatccgtcgtgctgccatgtcctcctcctgcggccgttgtctcccctctttgtttcgttgttcacagggcgggccggtcggtggggcaaggcgaggcgggataggaggaggtctaacggccggacacggtagcgctgggcagcagatagcggtgggtgcggaggaggctgccgaggcggctctgggcaccaccgaggcacggcgcgccgccaccaccgtcgaggccgagacctacgtggccgtcacagagtcgtcctccagcgccgcgcaggcttccgtcgaggacaggatcgaggtgctacaggtccagctccgccgcggctgctccggcagcggtgatgggtgcgaccatccatcgcgaggagcacacccaaggacaaattcgtcgttctccacatcaacgtgtcaatcaatcaatcaatgcatccatccttctagaacacgatggcagcagccactgcaacggcgacggcaacgaagctggcggtggtggtgtacacgaaggagccagcggggtcgccggtcggcgcaggggcggtggccggggatctcgccgggggagcgggcagcggagccatcttagacgccgggatgggggccgctccccgggcctatgcggcggctgtgacggtcggggaaaggcgacagcggcgctcgccgccggctgccgtgcacaggctggccgtctccctccgctgcttgagagcgaggaagaagagacatgtttacacccaaatttggcacctaggattaaaataggaaagatgaccaaaatttagaagtctaccggttttctccgagtgggccgatctgaccgccgtgtgttgggcggtcagaccaccggttgagggctggtcagaccgccggtgtgtggccggtctgaccggcaggtccaagtccgactgtgtttcgtcgggtctcgaggtttccttgctcgggaaagcatgtttcgggtttcctttggtttctatcccgagttggacgtggaggagggcctgtagagggcaagatcaacccctatataagagacatggccggttctattgtaactaaccaatctacagtcaatcaattgaatcgtttttcatattgcttttagttttctcttagtttgtctatctttctcggtttgcgccgtaaaccgttcgccaccgctgcgagagtgcgacatctctttgtaggtacgtcacggtgaacgagacggcggagcgcgcgctgttctactaaaggcgaggccgacggcggctccactacgtcgtccaaggcgcccctcctcctctggctcaacggtggccttgtctgctcgtcaatccggtacggcgccatggaggagctcggcccgttccacgtcaagagcgacggcgagacgctcagcgcgaggatgaggtggccaccagtgttatcgcaccacgtcgtgctgacctcgccccactgctctctgaggccgtcatgccgttcccgacgatgtcaacgggaagggggaaaagaagaaaggagaaggagaaaaagaaggaaagagaaggggcaatccgggtatttagaaaactatctcacctcttttatccctggaaataataaaataatgcgaccggtgttctacggccaattatacgcatttttagtgtccattagctgtgttacgttttttagtgttttctagctaattacatgttttttacgtgtcctgtagcaaattttgccgaacaaaagaatagggggtatagagaaaacgaaagaaaaaaagaaatagagaacaaggagtgtgaaaatgaaaactagtcagctagataggagaagagaaaaaacagagaaaagaatatgggttacatttaaaatgaaaaaaaaaagaaatagaggataaggagagaaaacgaaaaaaaaaagctatataagggatacagagagaacgaaaaagaaaatagaggattaggagacaaaaccaaaaaaaaaagaaatagaagataaggagagaaaaaaaagaagttatataggggcacaattggggctcgaacctagcacctcttgtctcatactctctccatttttataacgtaagactttctaacattacccatatttatatggatgctaatgaatctagacacacacatatgtctagatttattaacatacatacgaatgtagacaatgttagaaagtcttacattatgaaacggaggaagtagctatgatatctccatcattaaggacttgtttagttggaaaaaaatttgggtttgattgtcacatcggatattaaacgtagtctaatgacaaaacaaattatagattacgtcaggaaactgcgatacgaatttattaagcctaattaatccattattagcaaatgtttgtaccacatcgttaaatcatggcgcaattaggcttaaagattcgtctcgcaatttacacgtaaactgtataattagtttttttattttgtacacatttaatactccatacatgtttccaaacattcgatgtgataggtgaaaagtttttattttaagaactagacaagacctaagccaagcaaaccttttgtaaatcaaagtgcatatttatggttttatcctatgaagctctcagcaccaagtagtattgcgctgagctcggatgatttagcaagtccttgccatcttggacggaatctcagtgctaatattagtggcgttaagatgttatagcttagcgccaagcatgatgacaataagtaaaagatttattttttatttagtttttatcatggttcaatcttcaaataagatttctgaaagaaacattttgtcaaattttcggccgctttttccactgctcagcctgcacatgtatcacgcacgggaccagacgcagtgtgaatggcctgataagacaagcgagggcagtacttattccagcatcgtgtcaattggcaagttgattacaacacggaaaatcgaaagaacgtaactcacttgaaatatttttatatttttttatgtttaaattgggaagagtaacatttttttattattctctcttatttgtttcttttactctcctatgaaaattagaaagaacgtaactttcttaattctttttatatatttttatctttacagataaagaaagaaaacaaaaaataagctagataggagaaggaaaaaaagaaaagggcaaaatttgccacaggacacgcaaaaaacgtgtaattggctgggagacaccgtaaacacataacacggctaatggacactacgaaaaatgtgtaattggttataggacaccggtcgtattattttattatttctaggtcaaaagaggtgagaaaatttttaaaatagcgagattgcccctgacgccatcttctccaatccgaaataacaaaagttttgtagctgccggcaaggtagctggcggcggcgaccgcgcgccaggagcggcagatggcgcggaggcggacgtgcagcgatggctgctgcatcgcactgttcttgctggtggcagcagcgcaatgcctcgtgctgctcgctggcgcagccggagcggcggagccacgcacgcgccagggagactacctggacagactgcgtggctcgccatcgtcgagggtgtcgctggccgtcgtgtcagccgaggatcgtagcgcgccatcactctccgataggtggcatgcggcgccaacgacagcgccggcggcgcttgggagccaggaggcggaccgcatggtgatgctgctagggcagccgaacagcctgggcttcgcacaatacgttgggtatgtgtgatggtggacgaggtgacggggcgcgcgctgttctactacctcgccaaggccaacggcggctccgccacgtcgtccaaggggcccctcctcctctggctcaacggtggccttggctgctcgtcactcgggtacggcaccatcgaggagctcggcctgttccgcgtcaagagcgacggcgagatgctcagcgcgaggatgagatggccaccagtgtcgtcgcaccacgtcgcgctgacctcgccccattgctcctctgaggttaccatgccattcccgacgatgtcaacgggaaggggaaaagaatgaaggagaaggagaaaaagaagctaagagaaggggcaatccggatatttagaaaaatatctcacctcttttatcctggaaataataaaataatacgaccggtgtcctacggccaattacacattttttgcgtgtcctatggcaaattttgcccaagaatagaatagaggatacagagaaaacgaaagaaaaaagaaatagaggataaggagtgaaaacgaaaactaataagctagataggagaagagaaaaaaatagagaagaatatgggatacatttaaaacaaaaaaaaagaaatagaggataaggagagaaaacgaaaaaaagaagctatataggggatacagagaacgaaaaagaaaatagagggtaaggagagaacgaaaaaaaaaagaaatagaggataaggagagaaaaaaagaagctatatagggggacaattggggctcgaacctagcacctcttgtctcgtagctatgatatctccaccattaaggccttgtttagtcgagaaaattttaggtttgattatcacgtcagatatacagacacacatttaaagtattaaacgtagcctaataagaaaacaaattatagattccgtcaggaaactgcaagacgaatttattaagactaattaatccatcattagtaaatgtttgtaacacattgtcaaatcatggcacaattagacttaaaagattcatctcgcaatttacatgtaaactgtgtaattagttttttattttgtccatatttagtactccatacatgtgtccaaacatttgatgtgatgggtaaaaagtttttgttttggaaactagacaaggcctaatccaagcaaaccttttgtaaatcaaagtgcatggttatggttttatcctatgaagctctcagtgccatgtagtatggcgctgagctcggatgatttggcaagtccttgtcacctcgcatgaaatctcagcgctaatattagtggcactaggacgctatagatcagcggcaagcatgatggtgctaagtaaaagacttagttttgtaattagtttttatcatggttaaatcttcaaacaaattttctaagagaatcattttgtcaaattttcggccgctttttccactgctcagcctgcacatgtatcacgcacgggaccagacgcagtgtgaatggcctgataagacaagcgaggggcagtgcttattccagcattgggtcaattggcaagttgattacaacacggaaaattaaattggatgatccttaaattggaagtatgtcagaacaataaaagagtggcagccgtgcaaattagctttatgcaaaatctaattcgcgcgcgctctctgttttgtcttgttgcgccacatactcatcggccgtccgatccaacaagctctggtgcgtctgtacatagcctggtgattcacggacgtgccatcatccagaggaatccaaattggaagccatgtgacgctctacgctacgccggcttcaaaaataattttctcttaaacaaatcatccgatctacgatccgattacaccgttgtgttcgtaagaattgaatctttataacaagatctcatatgattatgttttgatgaaaaattagaaattacttttataatatatctaaattacttttagatttcactaaattacttcttagacccataaaagtaaatttaaaaaagcctaaaagtaatttacatatattatagaagtaacttagaaaaaaaaataactttatcacgacattaaaagtaaatccgttatggaggtaaaaacatgagtctatatagaaattaaatttaatcagcacaaattacatcattgactaaaaatgattataaaataaacaactcacaacatgaatgtatagatttcttttaatgccgtaacaagttacttcacttttgttttaagttacttttataatataggtaaattactttctggctttattaaattaattttatgactaagaagtaatttaatgaaatctaaaagtaatttagatatattataaaagtaatttctattttttcataaaaatatagtcatgtgagatcttgttataaagatttaattgctatgaacacaatggtgtaatcagatcgtaaatcggatgggtaatctaagagaaaattctataagaagaaaaaaaatacatgcacttttgaatataatagtagtaactagatatgaggttgagaggtagctggttatgaccatacagagaacggtctcgttgtagacacgtcctagctttatctattgttgccacgtttattttgtagtcatgtctgatgacaggtagctagggtggtggagaccatttgattttttttcacgaacataaaaaaatataaacattaatatattaaaaaatagaaaaaaataagtagaacccatatatcagtaacatatagaaaaaaaaatatttttctcctctcatttttcatttattttttcaaaattaaaaacaacattttattctttctttttaaatttaattgttttctatgtaactgacatgtggatcccactgacacgtaagcgttaccgtggtatgccacgtcatctcaagaatcaggttgaagtctatttgaacctatatggcattcatgataagtttagggattcaaaaatatattggtatgccacgtcatctcaagaatcaggttgaagtctatttgaacctatatggcattcatgataagtttagggattcaaaaatatattttaatagtttagagatctaaataacacatctgtaaggactacccgtgtatttcactctaatgttaattgtttagttatgtgatgttcttcataataataatagggatagcatgggtattctaattaaattaattttctcatgcatgtacttataccagcattgcatctatcggcaagtcgattacaacacggaaaattaaattggatggtccttaattatgtcaaaactataaacgagttgcagccgcacaagttagctttatctatcattgccacatttattttcctacatgcgacactgtcagcacctggatctggacttcacgacgccgacggcctcgagctcctccccaacctgtcctcacctcgtccatcacgtgcacggtgccccgttacctcaccaccacatcgtcggcttcgctgccaggaactgccggcgcacggtaccggtgaaggggtatcctcgccatcacgggcctcttccttatttgtttatagttgcgccaagccgccactgccaccggcgggggaggcggtgacctttgaacgacgccagcctctcctcgtcgcccaccagcttgctggccttctccgccaccagcacccagtgtttgaaatttcggttcgaaattttcaaaatttcggaaattttgaatttcgccccccaccgaaatgctaacatctcgcccgaaaatttcggtttttttgtatttttttgtgaatttggttacattttattcaaatttattaaaaatctgtcaaaaattcaaaaaatttcatacgaattttttccgaaatttctgaaatttcaattctatcgctcagctgcggcagaaatgctgatttcgaaatttaaaaccctaccaacaccctctgttggcaccgccacctgctagcttgttggattaggaaagaagtttgatcctaagagcaaagctatcattttgcaaaaattatctctccaaaatagcaagaattcatacaataacgtgtatggtgtctaccagtaaattaccacgtttttgaagtgtcctcgagcaaatttacattcttgtggtgtctcccaacaaaaacaacattttttgagtgtcttgtagcaaattttgcctaaattctaataggtgttatattatgatagtgcttgctaaggcaaatttgcacatagcattttttttctaaactaacatttggaaagttattgatagtcaattttaaaagtttgatcaaatcttgtgatatttgagtttattgcaatatcctttttgtgtcagatgattgaagaatatataattcttatgtgtaggagttacattagaatcgaaattttggttcactgttatgctttttctaacattactattctcagaaaaaatgcaaaaaatgttaatgctttttctacctttaggaggtatgcatttttaaagtgatagtagaatacccatgcaagtgatagtagaggtagtctcttcactgttatatatatctgctaaactgttggagccatttatatcgtgcaatattatatctgctcctgaaatgtgtcttaactaatggcataccattccatatgcatcaattaattggcatataccattccacaactcaatggtcctagcaaaaggcgagttaatttgcgagatgggcttttctgaatggccttttttgaatgagctaattaattctttcaataagtacactatataaatagcatgacagtatacctggcctctatataaatagcatgccgcagggtgatcagtgtgttgcctagaattggtgtgttgttcccatcagaaaatacaaccatgatcaacacggaacgtgatttccacatggtcggaggggaaggagaaattagctatgccaggaattctagggttcaagtaactactctatctatctgtctggctgtcaatctgcatatatctgtctctcttactcactaacacatatgcgcgcgtttcactgcttttttccttaaaaaaaagagggtaagaggtttgcctcatatatattgatatagcagagttacttgctattgtgatacaaggtattttgccaatcatctgcatgcaagttatgaggtctgttagaacaatagctttaatttatgatagtatcagcaaacaagtaaactataagttgtgatagtgcaaaggtaaactaggttgtacccatgatgcatgattgcatggagcatatttatgaatttgaaaccatataaaattcactgacttcattagttaccaggaaaaaaaatgcttgtacagcatacaaagacaagattggaaattctttttgttggctcctagtatcgtacctgatatgaacctagaagtacaatgttttacgtacttttcatccgaagattaaagtggattaaagtgtattccttatacaccagttagaatagagggtatttgcccggcgaaaaagaaaaatagagggttttttcctctatccatggcgatcaagggagctttactcaggaatcattaaaaagaaattctgatgagtacagctttttggcttcctttgatttgtagagaaaacgaagaaagcaataggttccttgatatagaaagtaacatgtttcattttttgacacgaatgaatcgatgttttctttctttttttatcagattgatcaatgcacaatatttaattatttgattatgttatactcgaatttaattccagctaatgatacatcatatattagtagcaataattaacaatcttttcacatgcatgtacgctgttagaacaaggctatgatggagactaagtcaatcctcgataaggtaacccaagaagtatacactggtcttttaccacgtaacatggttattgccgaccttggctgctcttcaggaccgaacacattgcgttttgtctcggaggtgataaatatcataactaagtgccaaaataagctaggacaacttgatttaatggatcttcagttcttcttaaatgacctacctggtaatgacttcaatcacctctttcggacattggaaacgtttaagaaggcaaatgaaacaaatcatgaaggagaaatagtacctgcatactatatttgtggagtgccaggttcctattacacaaggctttttcctcaacaaactattcatctctttcactcctcgatatctcttcactggctctctcaggtacgcaataaaattaatcaagtgtaacatctatatatagtactacaagatgttcatacacatgtggtctctgccaatgcaagtcaaatcatcagcatgatactttgagttaattagcagtgctatcatttacttaggtgcctgaggagctgaatggcaggaaaaaagtgtacctaaatgaagaaaacatatacatcacaaagactacaccacagtccgtggtgaaactattccaagagcagttctacaaggacttctccctcttcctcacgttacgccatgaggaactcgtgcttgggggccagatggtactgacattttgtgggagaaagaatgaggacgcacgcagtggatcagaactaaacaatctctttggtttgcttgcacaatcactacaatctcttgtcgctgaggtacatatacaattatctatgcgaatttggtgtcactctctcaagatgcgatacaagatacaccctctatccctaaatgtttgacgccgttgacttttttaaatatgtttgaccgttcgtcttattgaaaaaatttaagtaattattaatttcttttctatcatttgattcattattaaatatacttttatgtatacatatagttttacatttttcacaaaagtttttgaataagacaaatggtcaaacatgtttaaaaaagtcaacggcgtgaaacatttagggaaggagggagtatatcatatataaaaaggaaattttcaggtgaatacatgtaattaaaataaactctcggcatgtatataacagggcttggtggagaaggaaaaccttgagtccttcaatctaccactgtatgggccatccgtcggtgaggtagatgaaatagtgaagaacgtcaatttgttcgaaatggatcacatcaatctgtttgagtgtaattgggatccttatgatgactcacaaggtgatattgtgcatgacagtgccttgagtggcatgaatgtagcaaagtgcattagagccgcactgcagcccttaattgcatcttattttggagaagacatactcaatgcgttgtttgaagaatatgctcaccgtgttgccaagcaccttgagaaggagaagggtaagtttgcttttattgtcgtatctttgaagaaaagatgctacataaagatcgggagctagtactcgagtatatcactaaatgtattgctacgttaaacatatttcatatctgctacttgtttgtttctttcacctacttgcatgttattgtcctccctggatgtatatgtgcatgatcaaatatggtcattatatttgtgtttccttgtatctctatggatataaataaaggttaattggatccgtaccattataaatttatctgctaagaataatatcattgctatttaataatttgctctaatgtcattacaattttatacttatttaaaatatatatataccccgtacttaacccttcactatattttctaatatttttagaccaaatcaaccccttctccttgctcgtcctctcatctcttcaatgggtctaaatccaatccaaatccgcaccaacccaacaccttttcaaagcagctcactcaaccaatccaccccacttcttcacctctgggacccaatccaaaccagtccacaagcagtttcaggccaaaccaacccaaaccataatagtcttagtggattcaatccatttggaatccatggattcaacccacatgcagtccacaacggtgctaagcgcatcgctcaatggccgcacagataggaatcgtacagcaaaggccggaccccaccatggacttcttcgataccaatcttgcgaggaagaacgtgacatccacacgcagcgatggcctgcttcttttttaggtggatgaaatcaaggcgacggcgagcaggacgaacccgacgttcgcggcgctggcgctgcgtttcgccgttcgcgtcgagctcgccggccaccacgcagagcccgaacggcagtaggtcgagccccagccatggccgcggtgtagtttgtcgaaggatttgggtaacgtgcacgtgaagcgccgcgacggcgcggcctccgccgcagcccgcagcaatgcaggtgaaccctcactcctgtccgcatctagccggctagcctccgaccgtgctgcgctctcccgctccgccgcgatggcccatcccgccaagcacgcgccaccagctcggctgctcctcgatgcgctccgcaccaccaccgccgctattcgcgtgcgtgcgccagctgcgctctcccgcgccgcctccgagaagatcgccgtgccgcggatcgcaccaagccacgccgtgccgcctccgccgccgccgcctcaagcacagtaggactcaggccattcagttcatccactcctattcctgggttgaaccgatgggtagaatccatttttgacccaaaaaatttagggaaaattggaaccatgccattataattttgtaaaatttaagatatgtcatcctgacccacatgtcattgactcatgtaggtcctacatgtcattgagataccgatggcatatctcaaactttgcaaaattataatgacatggttccaaattacccaaaaatttattacgacatcgaaaccaatccaacccatatttcagtgagtccaaatcgctccaacccattccaagtcctaccccatttcaatccaaccgaagacggtccatttaaaaacccaacccattccaccatttacatccagttgtcgtcctcctgcatcaaaagcatcatacggatgccacacggcaccggaaagcttccaccaattgaggtgcttgaacagggtggattgtatcaccatttgtgtgagacctgcggcgaggagccctctcgaacagtgccacccccaacaccagcatgtcgaagccctagctcgtacagcgccaccacctcgtgcttgcgcctctcctccttcatttttttgcatgatggcgttgacgatgacgtcgaccggcacgaacacaaccttacttggccttactaaaactagactgaatttagaatctaacaatcgatgtcaaacgtaatctattcgccacaaaattatctacgacaactttattattcgatcgagataaagtttaagattgttattaggctgtaaaagctccttaataaaatctaagtttggtgaaactagtggtaagaaatctgatagagtaaggtgcgatctacgtttatcccaccaccaaacactacatcaaaaactgtaaaatcaaagtgtttttgattctttattctgtgatgaacaagtggcgtctgtgattattggttttgatacttagagattattggcgaagtggttttggagatgattggtttttacaggtgatatacaggtgctgctggatatgtggtccggttagaccgggcagtggttgctggtcagaccggcgtgtatcgcgcggtcagaccggctagcccgcggtctgaccggccgattctgtatttcgggttgtttgttgggatatccgtgattgt

SEQ ID NO: 69545 - DNA, 24524 bp, Oryza sativa
  unsure (1)..(24524): unsure at all n locations
ccatcacctttgacggctttgagcatggtcagtgatcagtggtcactagtgagtccagtcaccttttacgggtggccggccgtcacaggtgacacccacctctgacgggcaagttactagaaggccgtcagaggtgttggtctccgctagcctagggccagttgagacccgtcacaggtggctcatctctgatggccctttaagtaaaggccgtcagaggtgatggtctccgtagatagaagcggtcacaggtgatctacctgtgacggccccgaaagtaaaggcccatcacaggtaggtcacctctgacgggcctttatttgcgagtccgtcataggtgaggttacctttgatgaattttggttccgacccgtcactgatgtattaattccagaaaaaaaaataaatgctaaatattggctagccctaggatttgctagccatgccctttaaaaacagaaacatcacaaatatattccagttacccccctaatataacatcacagatccatctcaaacatcacagatccccaacatcacagatccatctcaaaaattgacatcattcacatatgcaattcaaatgccacaattttgcacagcaaattcataccccttgaaagccacaatttcggtcgttactcatagaactgcatatatgcttaacaaattgattaaagccataatgtccttgacctccacgacctgtcaattagaaaaaaaggagagaacaaatgaatagtacaacgtaaatcgtagttgatcaaatttgatgacaatttagcaaactaccataaatattgcacatatgaaagtaaattacattgcactccataatgtagaatcataaaaacaactttttttacatcacaagaatttatctagccaagtttatgagtctatttgacatgaaaacatcctttcttgttcattatttccgcaagaatgaaggtggacacttcgcctctaatagcgggagggttgatgggtgagatcttcaagccagctctacctttctgtttaataaatcagagattagcacgtttagaatagcaatgttggtattgaaatgagcttattcaccattagcaacaacctcagtgtcgaaatctttcacctctcttagaagtgttgacatgttgtggcacacgtggaaaccacactgatctccgatctgttgtgcacatgcaaacttggtgtcatgatagagttcgtccttaccctccttgtgcctaccacccttttccacatatgggccccaaaccatatttaaggccttggtgatttcagtgaaatcataatctttcgtcttattggagttaaggtaggtaaccctactccacttaggtacgatgactaaaagaatccaatgttgcctgtgcggtggttatgtagcattagtaataagaaccttaacttcaataacaatatgcacaaagggtattgtcctcttaatcctggttgtgtgtacacatgatgtactccttgtcttggtgggcccataaacaccggttgagatagtcaaccacatcagtgaagctctagagtaaattgacctcgttcaccatggatggatcatggaacccaacctaattaccaaggcgacgacgctcgatccaacacaaccttaaaacatttacgtattagaactaacttaattaggagatatagtccaatcatatcacaagtatagaaggtctgcacttacaaggagtagcattttagaagtccagtgtccaacttccggatcctgaacaagtcgaagaggtcatcaaagcctataattatataggcaggcgacgataggaacggctgctggtcgtgatgtccaactatggatgactccctcattttccgcttggcattacttagctccatgtattgcctatatagctcttagcaagcaatacccatcacggctaacacattgtcctccaccaatggcatgcctagttcaaattgggctggcgccctcacgacctttcccgctttgctcaccgacatcgatgtagcagccttgcccctttttggcaccggtgccaactccccgatcttccccttgccgcgttgacgcttctggcccttgacaagtggtggggaactatcggcctttcttgtggtcttaattggagccaagctttgagctatatctgccaagtccatagcagctccactaggagaatgaggtactgacaatgccgaaccacggggagcctcaattgatagcttagacttgggaggtgtaagctccgtcggttgacttggacgaggagtcatcttcacaactatgtcttctttgggccattgtatgaacatcttgcgcgcatcgcccaaagtcatgatttcatcattggggggcacaggcagcggatagactgaccaggtgtcctttactgtatcgatggacaccttggcatacccagctagcaagtctgcgttgtggaccttatctataaccgagggtttgaaagccatgccctcagcgacttcgggagcgaaagttggttggaccctagccagtaggatacactgtgctacgccctgcatatgtaaagtttgaatttaatattggaacgtgtaaaggtttttgattagatatggatcggataacatcatttacctctatgtggtccactgcagctagtggtgcgaccgagagaccaggtgccggcacctctgtggatgcacaactactcctacgctgtgacagactcgcgttgtgttgtgcacgaggagttggatgcatagcgtgtgttgtgcctcgaggtatattcatgtcggcgaggacctttttaaccctttcttccaccctagcgtccatgcttgcttctagttcttgaatgacctctaccttaagctcggccttcaaacgagcgtctctctcttccttggagactttccgtttcctatattgggagctgtattgtggcagtccatgcttccagggcacatcgctgccaattccccgagtccggccaggatgttctttggttccgagcgcctttgtgaggatgtcatcttcgcgcctcttcggcgtggactcaacctcgctttgtgaagcttgttcagcaaccaaccccaactataaaaacaagaatcgtttattcaaacttctacttcatgcgaacggtaattagttaggttaagtagtgaactcaccagttcctgatagatgacggcagcacttttgttctcaaatgtgacagagtcgttcgggttgaccttaccacatgcccgcgcccagttgcgagctctttgttcagggatgttcgaaaacggggcagggacattcgctgctgcagtggctgcatcctcttgggctcatattagctccttgccgatgtacccttcggtgcccagccgatgcgggtgctcgagaagctcctagttaattacctccgtaggtctaggtctgcgagagaacgtccgattaagctgtctgtggtcttcttcgcttcgcactctccatacatggtgtgatagtggtagatgtgcagatgtgggagccagcagcgatccacggcctcgtcggtccgtgcgccgatgttggtgaaatagtcttagcatcgtcttcacccgccctcgtcgtctagcctcctcagtcttaaacgacatgttggtgtagattgcttgatgaagacatgcgtggagctgcgtagctcgaatagcttgatgtcacaacagttgagtcgggattatattaggaaagggagaagtcgttggagatggtaggtgcagatagcggactccacttagtatatagcgatacacatccccacagccaagtgagtatagcttagtaataaagcatttgattgtttttgtgtgtcactgtagtgtacagttgcatgcatgcacaagcatacacacaatgcagtgtacaacactagcatgtgaggattgtgtcacaatatatggctccgtctatatatgacgcgctcatctccggggaccttcacggatgacttggccagtggcttcacgggaaaaccccgaccacacggatgcataacgcgacgcctgcggcgatgaagatggagagaacacgtcaagaaggaggcagtgccggcaaggatgattgagtagtcatcgacgatgcccaaagagaccgcgacgagcgtgaaggtgtcgccagccagtggactctcagtgagacatcctcactcctcattgttgttgcaaaatccaacatgcatggcaagggcatctctcccataggagaaaacccaagcttggtcccgagtggaccaggagagtggatggaagagggtcagaatcagtggaatgggggagagatctccctctcttgcccttggagggctccttttattcatatgtaacagaaaattacttctttgccattgatttattatacatatacaacacccttttagaggtattttagtcattttatacattagtttatgcaacatcctaagtatggggttattccccaacactcactcgacagacgacgttagcagtagcgtctgaagacaccatcgtgtcttttaggtggtgctgcagtggtcacaatggcggcatcctcggtgcgacgatgtcggcatgcacgtcggccaccttcttcagcgggatggcactcggcggacggcatcacggtggtctgacgggtacgacaagcgttagggcgttgcccacaaggaagacgagataacctcacggttgacagcggctccgctccatggggacaggtagcgtaggcggcgatcgaccgacaatctgacatgatgacgatggcatgccggccggcggcctctgatgggatggcatggacgagcaccgcttggtagtgcttcagtgactctatggtcttcacaacatggttttaaatttcgaaatcaacatttctgtcgctggtgggcgatagtaccgaaatttccgaaatttcaaacaaatttcgtatgaaattttttgaatttttgatagattttgaataaatttgaataaaatttgaccaatttcataaaaaattgcaaaaaatcaaaattttcgggcgagatgtgagcattttagtgggggcgaaattttagaaatttcgaactgaaatttcaaaccctgcttcacagacgcgggaatgataacaatccggcctaggtggggttggccgaggcccaacaaattaaggttgaccagaccccaacagttcttagggacacccactcagggaaaggcccaatctctctaaaagactagtccaataggggaagggtggctctctcttttaaggtagcttcctcctcccaagctaagcaaggtgggattatttagagcctcacacggtcgctgtccgacgttggtgtctttgccagcgggtaatagtggaggatgtcctcatcagggcagcttggcggcatccgcgttgttgtcaacaagacctcctgaatcggcatgaggcggcgtccgcggctactctgacgatctccatcacgatatgacgaggtgcactactggagaaatgctttgtactcctaattggtaacccctgtagtcccggttttctaaccgggactaaagtttagtctcggttagtcctgttggttcaaatagtcccgttgcttttataaaccaggactaaaaattgttttttgtcccgatttttaatggagcctggactattgtagaatttggtcgaccgaccaaaagatggtttctccagtagtggtggcgtcacgatggcgattagtcgacaaaggcgagcactgcttggcagcgcttcggcgactcaacgaaacggttgatggcacggatggagtagatgacaccgtgcgggcgtgagtgttggcgctccggctgatgttctcctcgagcggctcgacgatgagtgtgaggaaaatggcaaagccgacgagggcaagcagacgttggtggtgtcgcgaagaggaggctgcgaccggcaagttgacgacgtccagcgtctcgatgacatatcacatcgcccagctagagacgtcgtgaggtagagattgcggccggcgaggcgaggacgtcgcggcagcaggtacatgtgtcactggtggccggcgtctccgacgagagggaccaacacgatctccggcaggcagcaccggcaactcgtctcgtcgccatctcgtgcacgcatgatgaactgaactgaaagagaaagaaaacaagaagaagactcaagaagctatatatatccatggcgatggctgactacgtacgcgctcccctccgtgttctgcgcagccgctgtccacgcgttctgtccggccaccggcgtgcagcgccttgtcaccaggacgatatatcgatggctgtgctgtcgcgaggtgtagatgggctgtagctgaatatcgatgaaggtgtggatgattctgaatcggaggtggatgttgtggttgtgcacttgtgctgtggagtgtatgtgaaatggctatgtgtagtgtgaggagatgaaaggaatggcagtggatgatctgtgtggaatggcgcctgtcgatggcctcctttttataggcacaggagtaaccctaaccagcaccggccgcgcactcctcggcgccgccgcggccacgcgttggtttgctccgaagcctccgggcgccattgctgcggatatactgtgggccggcggcctgtagttgcgcttcacgctcatcgtgtatatgcggccggatatccacgcctgtacgcgtacgcggccaggatttctcgccaaatggcaacgacctacaacaggccgccggcccatatatgcagcttcggtgttagtcccagcttgccgctgctttaattaaacccatggaaaaccatccggcatacatataagtatacgtatacggtaggtgcacggccacgagaactcacgtataactgtacaagcttctcacatgtcgctcaagtcggggggcgctgatgcgcagctagtagcgcggccgtgcacgcgcgcgatcagctgcctccctctagtctctcttcttcgtatcactatcgctacttacttaaaaaaataagaggggcttctatagttcgtcaaaaatatcagacgaaaaaaaccgagaaaaaaaaaccggacgaaaaaagtccgatccaaagacggagtgataaaaaaaagggagaaaaaaaaagtccgataaagaaaacggagcgaaaagaaagggcgagaataaaattctgtccgacccaaaaaaaaataggaacctaacgaaaaaaacgagcgaaaaaaacctggtgaaaaaacagtccgatccaaaaaaaaatcggagcgaacaaaacgggagaaaaaaaaatatccgacccaaaaaaatacgggaaaaaaaagcggaaaaaaacgaaacgagtcagtaaaaaaatagggcaaaaaatttaaaaaattgtttgattccaaagaaaaaggaattatatgtgatatggtaaaaaaatcgaccgggcgaaaaaaaccgagcgaaaaaccgggcgaaaaaataaaaaaaagtccgataaaaaacggggcaaaaaaaaaatctgtccgatccaaaaaaaaaggaaaaaaggggaagaaaaatcgaaatccaactctatcgacacggtaaaaaaagggctaaaaagataaaaaaatatccgattccaaagaaaaacatattatatgtgacgcggtaaaaaaatcgaccgggcgaaaaaagaaacccgagcgaaaaaccgggcaaaaaaaaataaaaaaagtccgataaaagaacggggcaaaaaaaaatctgtccgatcaaaaaaaaggcaaaaaaaaaaggggaagaaaaatcgaaacgaatccaactccgtcgacgcggtaaaaaaagggcgaaaaaaataaaaaaaagtctgattacaaagaaaaatgaattatatgcgacgcggtaagaaaaagaatcctattatatccagaaaggtccgacactgtaataaagtggtgaaaaaaaccgttcgtaaaaaaaatgcacgagaaaaaaataaaaaggcagaaaaaagcgcggcggaaaaaagtctaatttctattcgttgttttagttgtccttttatatctcttctttatctctaatctaatataacctaactatttaaaaagagaagtttctaccgtatatttaaaaagaaaaaaatacgcgagaaaataaaaacggtttaaaaaatgcgtgaggaaaaaaatgccagaaaaaagtgcaaaagaaaacacgctagaaaaaaagttctatagtccaaaaaaaacacatgagaaaaaaatacgtctgtaaaaaagcaaaaaaaaagcatacgaggaaaaaattgttagaaaaaaacgctaaattgatggacacttggtcggataggctccatccactttttttcatctcctacacgacttttgtttgtcatctattctcctatagtggagaccctgcacatctttataggcaattatcatactattttttgaagtatagctattattcttgataacatattatatggaaataatcttagaaaataaacatattttaattgttatttagagaagagtgcacagtgacactattttgtgtagacttgaccatacgaggcagtgtaggatttgattggttgcaagaatgagattaaaagaatattttagattatatgcatgttgttatatgaataattcaattattggtaaagcaaacatcttaaggttgccatcatcgaggttgggctattacatttaagatgttccaattttctgattgtcattgacatggttatgaatgaaaaacgtatattatcattacgtctttttcacccgttgcaatgcacgggcatgtttgctagtatatatactatatataaaagctttgtataagcgtatacaaaagtttatatacgggtatataaactttctgtcgtatacaaagtttgtatacgtgtatttttttggtttttatatgtacgtataaaactttgtatgcacgtacgtataaaatcttaaaaaatatgcatatacatttttttatacacgtatacaaaatttatatatgtacgtataaaaaaccgaaaatactgaaaagatatggaaagaaaaaaaggaaaaaaaagaaaaaaaaagaaaccgtgcgctgtgaaaaaaaaaaccacgggctgtccgccacccttctctccgcacgtgacacgtgtgcagtcacaagggggagggctcacgcggctggtcgctaattagcattctcggctgaacaaatcaaatatgcgcaacatgtcgaactctcccgaccctgcgaggcgagctagcgcacgcaaatgtgtttcacctcctctctccaccacacatgcttcaagtggctaggagggcatcctcccttttaaggaggtccccctctcctagaataagtaaggtggtactaaactttacatgcatgccatcccaggtccccctctcctagaataagtaaggtagtactaaactttacatgcataccatcccatgaggtgggcttttgtgattttccaaagaattaatcttcgaatgggccttagcccatctattaattccaacagcatacgtatgcaccaatcatgctcacatatatgatatatgtgattgtaccgcatacatgcgatcttgtttgcttgatgtataaaacgacgaaatatcatcaaacaaatatttcatcgctcaatgaaatatatttctaaatagtttgatcagatgcactgattgcaacgccctgttatgtagaacatcgaagaaaacatagtgcacgtatgtacaaaatcctagtaaaaagatgatgaaatgctcaaatacagcaaaatggataaatgatggcctgaaacaagcccatcatgcggcttcttcctctatttcaatgattggatctgtcttcttctagagtggttatatctgccttcttcctccactatggtggatggatccgccttcttcctctggcgtcaccacatgcgtggccagacagagatcattggtggcaaactgggcctccataatgagagaaatcaatatattgtcgtgatatgagaggacttgtttgatttgtcgccaacggtggatgagatatacccacacacaacgaaatgccattgatagagacttcattcacgtctgtgtactcgcaacagcatagattgtcccacctgtatgagttgaggctctgcaggaggttcggaaatgcagtggagcgtcacgtcttatttttatccccgtgtcatttctctataaaaaaatgcaacttttatacaagtgaagttcaattattgatttgctttgttttttatttttttattaatctagatgcatcattgtgcttaaatacattatatataatttataatttcacattggtacgtaagaatttaaaccaaagcacactttatttcatgtaggtaagcatttagaccaaaacattctctctttttttaacatttaaggttggaaccttacttgtttcgccattagaaagaatatatgttaaaaaaagtgattgatagattacaatctaacaattttgcttcttctacctttattttagcttcctaatcttacatggtgctattaatttcagtagcatgaaattaaacatccaagttccccgaaaggatcaatgcatagattagtcgcatggtcgaatgtgtttctagctaccactaaaaattaagtaccaccgtcaagttatttgctgatttactgaacttttttatcatgctaaagtatcactgcctcagttaccggctatgtttcttcaggaatccaatattttacacgttccctcgcaactaaattagtgcacaccttatccacttatcctttttccgcaccgctcgaatcccttcatccgtggttcctcctatgattcttttcttccttctatggttactgttctgtcttcacccggtgacgcaactgacttgggcaccatctacttactcctttaccttctcttaaaccagacgatggcaagctaatcacatcctagtggcttgtagggcattgtctttttcatctcttcaacaacatgttgctcccccctaccccgcctcctccaccacggcataccagtaagcctagacttttgtgttccgatgacctcctcccttgctgattcgccctaccgcctcttcctctactagactaccacgacaagatgcttacaaccgtgggctcattcttcctagtgagatgtcagtgcccattttttcctcctctttatcagacccagataggagtatctgtagaaacttccactgatttgagtagaaagtgttgatttttttagttgaaacatttcaattgaaatacttttgatttgaaagtatagggattttggttagaaagttttgagtttttcaattgatttttttaaaaaaatatttgaattgcaagtttagcccacaacttaaaaggtttttagatttttaattgaaaattttgtcattttttagatgaaagatttgatattttagttggaagtttcatatttcatatcaaaagcttttttttacactgagttgtagttttaattcagcctagaaaaatgcctatgcgttgcaataggggaagataattttcatgattaataaaaactcttccaatttcaacggcaaaccaaaacaagacaaacaaagcaatagtaatacaaagtcagaaatcatgtatagtattgtactcagttgcgctcgcttcattcgtcatcacacaaaaaaatccattactacacatatcggtagcctcaaatcgatcaggtggctattccataagttgacacgtgtgtgttctgctatacgtcattgatcaaatatttaaattttgattattcaattagtgaaagtttttcacctgtagatggaaattatttgcaaagtaacaaactttccttatacacaacataatgataattttaaaaggaagatatttatgagaggaatttggaagagaaaaaagagggaaaaaaaagaaaaggaggataaaagagaggagatagaatggagagggagaggacaagatgatcaggagaaaaaaaggataaaatagaaaaaagatgccatcggggtagagacgcgtgccgccaagttagggctttcaacgagcaccccaatagattacagacagaccataagtatccgcatctgtaaaaatcaaatctcattttccaatagggctcctaagacatccgtataaaaaaatccatttttccagacaacccacttaaaataagggtattttggcatctcgggctcttaactctcccgcatgcaaatttttattctccaatcctctctctctcccatcaccccactccactcctctcttctcccagcacacaaacacacactctctctctcccactcctctcccacactcctctccccactcgtccgtctcgggagcaggctctagcggcggcggtagcgatggcatcttcctcttctcccccactcctcctctccactctactccctcttgacggcagtggaaggcggaggaggcatgcgacagtgtggatccgacggcggccacgctccccatgtgcggtggggacggatcggacggtggggaagtgcagcagcggcggatccggtggtggggaggcacgagggcgtcggatccggctccggtgacagtgacagcgacgggagcgggataacctagccgcccctagccccctacgcccccatgacgatgtcgacgacgatgaggatgaggtcgacggcgacgatgacgacgacggcttccagcaacgatggtgacaacgaggaggacggtggcggcttctagggttagggtttagtattttttggtttttatttttttcggatttttatttttgtgtgctgacgacagattttcgcgtgcgggtacaaatagtgattttcgcagaccattcggtgcgtgcgtctagccctactgcatgtgaaaacccctttcaggccatctgcaaaaaatccttttttaatagtgttagcagcccccatatttcctctgagatgagaataagattaaatatcaatcgcttttccacctatgatttgccataattatccgttaaataatgtattttttatgagtgatatatgatcgatcgatacttctccgtaatccatatttgttatattggttctgaaatctatctatctatctatatctatatctatatcaatatctatctatctacctatctatctatacctatactaattagtcacttcctacgagctcacatattaaccagaaaaatctagcccttgattaactagatcgcaacatctcaaccattaatcactatgtttaatattatgggcttctttaagagtcaatctgtttaatattatggcctatttgaaagcccatcttgaaaaaaaaaaataatccaatctgttattgcctatacccgtacgtctatctatctatctatctatctatctatacatctatacatatactaattgggcacttcctacgagctctcatatatattaaccagaaaaatctagcccttgattaactagattgcaacatcttgaccattgatcactatgtttaatattatgggcttctttcagagccaatccaaggcctatttgaaagcccatccaatttgtgttttgaaaaaaaaaatccaacctgagcctctcgcaacaaaaagaacagaacgcgagacagtatcatgaaaagcagctcccgttgcgcttcatcctgatcaataacgaatttggactccatccgatccaattagactgtgagcaaatgggaacgtacatgagcacatgagacttccgctagaaagatgggagacgttctaaatacactttgttctgatttgggctccaactgctgctgattatatcagggatgatccttcccagctaaatcttaggtgtgattttattatttttttaagctgaaaactctacagaggttcgacatgttctatgcgcatctgcaggtagcttgcagtaatgtttttgtttcttctgttgcttctcccgtcttgcacatctcagtgtgatttgctgataggccagttctgttatgtgatttatgttttatagcaacctaacaatgtatgatcagtctagaatttgcaatagatcgactacttcattaatttgagtgtgggcactgcgtatgatcagtaattaaaatcataggaaaactctttcttctttaagaaaggaacaatgtattttttaagacagaaaactataattttttacaaaggaaaattgcaaattcacacaaaacccaggaactgctttatatttattaattacaatttcaaaagtaatagatcatgtataagggataattgagacttcaaactccgtacttattaatttccaatttataaattaaattagtaaaataactaaattaaaattccaacatggcataaaatgtcgacatatagttaaattatgattttttttatttttataacaccgacaataataacccatgcaatgcacgggtagacgactagtaattctaattgtttaattagcagtacagtacagtagaacactagagggcggtacagacgtcaggggatatgttacatcctgaccagtacatctgccgacaccacgcactaaaatgtcgtcgcgcctcaacatggatctacagtcaaactaatcgatctacagtcccgtcttcccttcagtcccactgtcgctagcgacaccgaaacagctgaatattaatcatctcgctaaattcgccgccaatttagtggatctagctagatcgtgccattgtcacacgaggtcacgacttacgcgtgatcaattgtttaattgaacctctcgattacgcgtcatcgctctcgtactgccgaggaggcagactgatcacccggccggtcgtcctgctatacgcttgaatggaaactggatattggatagacttgagtagttctcaccttgttgaatgctgtgtcgctctgggttttcttatccaacgtttcatttcaagtgccgtgtcccttcgtcctatttcaagtgcacttgtgagttttcgtatttaacatttgaccgtccgtattatttaaaaaatctattatatgctaaaagtccatgaaacttcctacaaacgctctcaagccgccatgtaggatttctataaacgctcctaagccatcatgtggcactccaataaattaaaaagattctaaatattctaaaaaatctcaaccgttgatttccccttaactgcaggacccactatttaaattgtagatgtattatgtttagaaatagttacatgtacgtactccctcctctcccgtgtcctcttttttaagctaacctctcctattttctagctaacaattaaataaaaaataatttaattagtatttcttaatttagacctatattaaaaaaaatatggtacatggatgcatattctaacactgtacataccataaaccgatgtgcaaatattagagtacaatttaatatgtggattaagaaatcatgcacttcttttgttccaaaattataagtataaaatataagcatatataaaatattgacataccaaacgtgttaaacttaataaacattaccacatacatacttaaaaaaaatcgtagcaccaacaagtacattgcacacatatagcactctaatcaacaaatccccaatttcaacggtcaaattcataaatttggggaaaaaaagggttatagaattattctctgatctataaatttcaccaattaaaaccaaagaaagagaaagagtgggagaagatttttttttaagataatggaataaatcctggcctttacttcaaagaagctacaactacttattaatctcacaaagagaacaagcactcaggcaactacataaagagtgactaaaaaccaacacaaaggacaaaacaaatttgagagggggaattgaggagtatatcttgctcttcgatgtccccaaaagttcccgcaaaaaatgtctccaaaacgagtggattttgagaaggagaggtgagaggggagagagcaagagctcttctcaggcttgcgcatgggacaaggggggaatggatggggagagggaggggggaggggtggggcctgtcggttaagtgctacccaccacccaggaggagcgtgcaaaaggcactggcgccttggggtggagggggggcatgataacaccagctactctggcgtaccaaaaaggatcatttctagaataagttttttatgggtctatttttaaaataagtttttggaaaggaccaaatggtaaacaatctagcatctcaaacaccgtaccaaaatccaaatatacatatattttagagaccgagtacgtattgatctataaacacgtgtatctaacaaaattgcttaaaaataattaatttcaataaataatatttttggaaaaaactacgattattaaaggtacaattttcgatagatgacgccgttgaattttcggtacacattcggcagtttatttatattaaaaataaataataataatttattttttgacttggtttataacttaacatgacttacatttccacatgttttcataaaaatattaaataagacaaatggtcaaacgcgtgtaaagaaaatatacttacccacgcaaatgcgcgggttaccttcctagtttatgaaatagtcgcacgctataaaagacggaaaccatcatcacatccctaatttcattaaaatcttattgaaagcccagctacatgtttaatatttataaacatcagaatttaaatggtgagtgaaatctcatacaccaacgattctagtgttccctccccacgtttgaccaccatcagaaacagaaatagtaaccatcgatttttatacagccagttcctttactattgtcctgttgtttgtttcttcgttgctgaatcgatcaagatttgcatgggagtgcttgccgtacggagactgatagtataatcaagtaggccacctgcatgaaagcccagtaacgggccaaaaatcagagtaatcaagtttttgaccccgtagaaaaaaaatcggtttcgatgacgcgtaatatagcaatacactaacattattatagaaacgtactaaaagaaggactaaaaccgatacctataatacttttcccacctaaacacgtgccaataggacgccaacggctagaaaccggtacccctgtgaccaaatagttgccggtttttaactgaatcttcacctatctttcctgccagagaaaggtgcatgttccagcaaaaagctagcaccttttattctagggaaattttgctgtaggacacagtgactttgtgttttagctctaggacacatcaaaagttgatttttggcggaatgcattctgaaaatatggttattgactgatggacaccgcagacattaaaatattgatttctggttgaataggagagatagacagtgtgaaaggttaaaaatgcacctaggtccactagtcatattcttctgcaacatcagactccctcctggcatcatctgactccgccacggtggcatagcctggcaaaccctcagcgcatgtgggtggtggcacagtctggctaccctcagtgcacatgggcacagtgcggcctggctcgtgttgctgatggaggtgcgcgtgaaggtagccgctgcacacggagggagggagcttcggtggcgacacgaaggaaactgcggtgattccggcggcaagtagaggacattggggtggtgcgcaaccctcggcgtccccggcaatgcgtgaagggagttgcggcggcgcgtggccctcggtgaccctagatgcaagtgtcctcctccccgctgcggccggcttctctaactcctctattagcttccccttcccctccttgccgccgtcggttggcactatccattcgttggctttccctcctccttcccgacatcgctagcttcctctccccctctggtgaagacctcgacagcggcgctctgcgctgtgctctatgcacttgagcacacggcgtgccagggttaattttgtcctgacgcgtcaaaaagtgggccctctctcgcctagtcagcattaaaacactaaaataattagcatggtgtgctcttgcaaataaccaaaattacagagtattttcctccaaaagtgactttgtgcaacgtcttatagctaaaacaacgaaatctcaatgtcccgtagcaaaaatttacctttattctatcccatcatagtggttggttccgaggcccagtttagagccaatacttttgagacattcactcccggaagtagacattggaggacccacttaaataatcagtacctatatagctgtcaaacatatgtgtcggttctagttaagaaccaacaccaccgacacctatgagctctatatatagctcatccccttcctctcaagctgatcgagtaaagaacatattttttggtgttgttggagattgattgctaaaaggttatttttatttctcactccatttcactcttgcttgttgaactgaactatttgctatgtatatatataaagtgtgcaaccgaaacaattatttgtatttgttttctacggtaaatatttttttatctgttttgtttatttaattagatccatcctcggatgaccacatgacaattttgagtttaagtattgacatgacggtagttgattttgtacataatatttattattaggtgctttaaataatattcatacagtagtaaagagaagtgtaacacaatgttataataattaaatcattgaattgcttgtaaattataaaatccaaattgtatttatactgcatggtttgtaacaaaataaattattatattatttttcaaggggtggtaaatttattttatctttttcatgttcgttttattaaattacggctgtttttggtccatttcaacggaagaaaattggtctctcatggacacagggtcatagtttcttttcgataaaagcaggcctcaagctcgagttcgctttgtttatcattctgtcttgacagctcgcctgcacagttactgcaactgctgttagtgtgtgcccgatagtgttcgtttagggagtataaaccaaaatgtccacaacgctgtatctgattgcaaacatggcggaaacaaacgatttttgaggggataactttataattgcttccgaaagaatcagaactaaacaggtttgatgacagataattgacatggtgagaaaagcaatggttttgtccacaagcaaaggttttatatatcgtgctatacaaaggaaacgaatcttactgtatactgtattaatcatgtcactaaattcgccgtcatttcttggatctagcaagagttggtaactttttttagaagaagataatcacgatcgagacacctaaacgccttgcggtgatataggaaagctagactaagatgggttttgatagattaaactgactagcggagccgatttagatagaatgatggataactacccgtctcatgggcaaacggaaggtttatgggacaaatctacaaaggatttcgcattctcgcagcgaaggcagacgatttgtgacgcaaattgacaaagatggacgaactaaactagaaaagtatatgcgatataggaaaaaacgattcaatagcttgtatgtagattgtgtgttgtatattacaattgaaccggcattgtctcttatataggggtttgtcttgccctctagaggccctcctccatgtccaactcggggtaaaaaccaaaggaaacccaaaacatagcctcccgagtaaggaatctcaagactcgacgaaaacagagtcggtctcggactctgccggtacgaccggccaaatgctgcaggttagaccggcccatatatggcggtcagaccggcctagtagaggaaaccgacaactttctcaaatcttggcaattttccttgttttgaacctaggtgccaaattcaggtgtaaacgcatgccccctgcctttttgatgaataataaagcatcatattcggcttgattatttgtacaaaaatattccaaacaaaccgatgtttcaaagcatgtaccattgggcgaaaacaaaacatatcctcttccgccataaagatttgattgtagccggcgttaccatccaagaaactaatcaccttatgtcctgaagaatcattgatcaacatgtgggctataggcacggtaaaaaaaacatgtgagctataggcatagaatattcatctttaggagtaggttttttcaaatctctaaaatctatgcacactctaatcataccactccccttcttatcaaccggaataatgctagacacccactccgcataccgacatggcctaataaaccccaccttcaataaccggtctatctcttccttgacccgatcatataatagaggattaaagtgacgaggtggtttcttataaggcctaaatcctggttttatcgaaagccattgttcaacaagatcagggctaagttccggcatctcatggtactcccatgcaaagctatcaatgtattctttaagcaactcgattatcttaaccttataatcgttaaccttataatcggctttcatgtttttgtttacaaaagtcggccttggtatatttccatcacctatatctatttcctctaatggatcggccgatataaacccttttcctagcttttctacttcatcaaaatcttcaatggtttccctaatatagttctttgtagaccgatattcttgcactcacttttgtaaccactctaaattaacgtatgagaagacgaagactctaaccattagcacatcaaagaaaactttattactcttctttcggcttccttggtcatcccaatgccacacaactttttttagaggttacgaggtggtgttaagcgatgttaagattttcactcttctcttatatgtcaccaaatatttttcataactagtaaggtgaagatctcactgttaaccgttctacacataccgacggacccctaatttaaattatctgttaaattttttcccctatacaagccaatgattaattatatttttcgttaattaaaagggtacaccaggggaacgagctaatacagttcattctccttcctaaagtggtgttaaaattaagagggtgctattttggcaacaacaacatgagtgtgactatgttaaagtcgaatgaatgtttttgtttaacctttagaactttgatttcaaaaatttacatgacaataagtttataaaacctaggcaaaatttgctatatgatattaaacaaatgtggtctttgttgtgtgctgggtagctctcactgccaccgctccaccctaacttagatctcaccaccacctcttcagtacttggatctagacttcatgacgccggcggcctcaagctcctccccaacccatcaatcacctcgatctgcgttgacctcggccgacatcaatgtcctcacctccttcatcacggcaccccatcgcctcaccaccacatcgtcggtttcgccgctaggaaccaccagcacaccggggaaggggcatcctcgccatcatgggcctcttccttatttgtttatagctgtgccaagccaccactgctgctggggggagggggtgacctttgaacaacgccagcctcgccttgtgacgaatctactattcctccttttttcggccagcacccttattctccatatttttcttatttctattttattcaaattataaatatttactctaggtgtgttacctttttagaaggttgcaaattgtactttctccctctctgggctctaatcacctactttttgtttcatacttctagaaaatgacaaatctgcctggccttaatttctataaatagcacaccataagggagagccagtgcaacattattgtattagctattattcccattggaacacacaaccacgatgaatgttaacgtagaacatgactttcacatggttggaggggaaggagaaattagctacgccaagaattccagggttcaagtaactacccatctctctccctcccttaccccccccccccctccccctcgcttggtgtgtcaacagcttgcatgtaagtaataagcaatgagatagcatcaattcacattggcaacaatacttgtaccatgccatgattaaggaaaaactaagttgcaccatccatgatgcatggagtgcacatatagatccatttggaacactactccctgatcagcgtctagattaattgtagaaagttgctcggacctctttcaaacactattaattagacgttattttcgtttgtcataactctcctacatatgccatgtaagtatttttatagtatgcagctgtcttaaagaactgcctgtgtaatctgcctataggaaatatttgttttctacaggtctattatcacaggcagttggttaaaagcatgtaaaatgggttaccggctgcctgtaaaaagtattttcctagtactatgctatctaacaaaaaaaagagttcctatacatagatattagatggtctatccttctccttttctttctaaagatccaatgtttaattataacaataaatgaattttgacatgtatgtatatatggtgctaggcgaaagctatgattgaggctaagtttgtccttgataggcaatccgagaactgtacgcaacccttctagctaatatcatggttgttgccgaccttggttgctcttcaggacagaatacattacattttgtctctgaggtgataaacatctttacgaagcaccaaaacaatttgggacaaagtgatacggtggatcttcagttcttcttaaatgacctaccgggtaatgacttcaaccacctctttcggatattgaacacattcacattcaagggggcatcaaatcacaaaggagatatactacctgcataccatatctatggggcaccaggatcttattacaccaggctttttcctcctcaagctgttcacctatttcactcctcgttgtcccttcattggcgctcacaggtaggtaatgttgatgatagtataatgcaaaatgctctttcaagtttcaaacatgtattttctccactcttattaagtcacataatcgtcatgataatgttatatattacaagtgctatatcacttccttaggtgccggagcaacttaatgggaagcaaaaatcatatctaaatgaagaaaacatctacatcaccaagactaccccactacacgtggtgaagctattccaagagcagttcatcaaggacgtctctctcttcctcaagttacgccacgaggaactagtggatggggggcggatggtactaacaatttatggaagaaagagtgaggacccatatagtggagatgtaaatgatatttttggtttgcttggaaaatcactacaatctcttgttgctgaggtaatatactcctttgatcccattctattttacttgtcatatatatgagacattgacataatcatctctgcatatgtaattttagcataacttttccttcaaatagatctatggaaaattattgaaaatatatctacataaaggcattcttgttgactaattattgaaaatataatctactaatcaatttcatttttttacatatatatatcatgtctcaatagttttgcatatatcgttagtaatttatgatttttatgtttgactacacacatcctaaagtgcaatagattttgtgattggagtattcttggttaaccaaatatatacctacatcctgtcatataagggactttgcctctcctatcttatcgatgatataagagatttttggtgtactatttgtgtgacactctgggcccaattaggatgtggcctatgagtgtcatgtacacttaattggtactatcttatgagttgagcaagagtaaaaccaacttataaaaccttgtcgctctaaccatacaacttctgagttaacccttttacatgaaacgagcacaaaagtataagtagattgctatgtgtaataagtgggtctgccgggctaggctgtgcggatttacagctattataggttgccacattaatcaactcaaattttattcaatcttatccaccaattaaccactaactctcacttaatatagctaggatagtcctttatctatattctaaatatctagaaaagagagaatatagataaatgactatcctagagacagtgtgtgtagtaaaattatgggatttccacgttaataaaatctaaactaaactttcgatgtgtattaatacttaatagggtctcgtggagaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69546 - DNA, 7842 bp, Oryza sativa
  unsure (1)..(7842): unsure at all n locations
acaactcttacggagtatttcaaaatcaatcaagtagacccggaagcaaggaaactgctataaaaggagttccctgaacactaccgttggataaccggacagaatgtgtggcaaaaaaggaaaacaaagagaggccaagttagacgggttgtgtacgctcaccctgcagagggggagagatactacttgagagtgcttctcaaccacgtgcgaggtgcaacctcatttgaagatttgaggacagtgtcaggtacaacgtactctacctttagagaggcatgcgagaagagagggcttgtggagacggataagtcacatgacgattgtttgaacgaggcattcactttccaaatgccatctgctctgcgtcggttatttgcaaccatactggtattttgcgaagtcactgatatccgtgcactatgggacaatcacaaggctgcaatgtctgaagattacagccgagggaacactaaccctgcagcagtagagcagatggtgctacgagacatacgtgatttgcttcattccatggggaaggatatcacggagtatggtcttcccgaggtcattgatataggtattttttttcttatactatcacgtctttttcttattagtttacatttgcaccacccaccaatagtttcatgatgcatatatttgttttcactaatcaggtgaatgttgcaacgacgtaatgacaagagattatagacgaacttaacgtgccagtggaccaagaccatttagacatatacacatcccttaatgatgagcagcgtgcaggatttaatgagatcattgatcatgtaactaataagaagagccaggtattttttatcgacggcccaggtggcactggcaaaacatttctgtacaaggcgcttcttgctagagtgtggtccgagggattaatagccattgcaactgcgacgtctcgtacagcagcgtcgattttgcctggaggacgtaccgcgcactcgagattcaaaatccctattaagatttctcacaatagcatgtgcaacttcatgaagcaaagtggcaccgcggaattgcttcacatggcgtccttaattatttgggatgaagctacaatgacgaagcgtcaagccgtagagacacttgataggtctcttcaagacattatgggttgttcattgccatttggaggaaaggttattgtttttggcgatgatttcagacagttacttcccgtggttacacgtgggataagggcccagataactgatgcaacattgcagagatcatatttatgggaaaatattaggaagatcagattgtcgcgtaacatgagggctcaatctgatccatggttttcgaaatatctccttagaattggaaatggcactgaaaacactatcagagatgattacgttcacttacctgatgaaattgtgattgcttacgggaatagcgaggattcagtacacgaattgattaatcatgtgtttcactcacttgatgatgaaaagaatgcaagctctgcatcttatatgagcacacgtgctattctatccactaaaaatgattacgtggacaagctgaatgcgaatatgattaacagatttccagggcaggccaaggtttatcacagctttgactctgttgatgatgaccctcacaacagttatcctctggactaccttaactctattactccaaatggtctgccaccacacgagctaatagtaaaaatcaattatcccgtgattcttcttcgcaaccttgatccaaataatggattgtgtaatggtactagactaatggttagagcttttcaagataatgcaattgatgctgagattgttggtggacaacatgccagcaaaagggtgttcatcccacgaatccctttgtcttgctccgacgatatatctctacctttcaaattcaagaggaagcaattcccaatacgtctcagtttcgcaatgaccattaacaaatcacaaggacaaaccatcccaaatgttgggatctatcttctagagcccgtgttttcacatggtcagctatatgtcgcattgtcaaggggtgtgtcaaggctaacaacaaggattttggcaaagccaaagaaagaaattgattcaacagggaagagcactagaaatatcgtgtataaagacgttcttgactagtgagcaaaggtaggttcgcatgatctaaattaattcaaaaaaatattgaatatagtaaattgctcatcgaatgttactcaccatcgtcctcttgttttgtacagcacaccatcaccttttatatggaatgtcgtgtgattatcttctacatactatctcacactagatgtgtcagtttgcaccaggctgtcatttgagattgtaattatggtctgtattatattaagggatacatatgcttacaaaattgttctggattattttttttatcatggttcatccatacaacttaaatggataatgcaccgtagacagcccacaccaccgccatcgccatcgccatcgccatcgccatccacagcatacagcccgcaccactgcaatcaccatcaccatcgccgccgcctccgcttgctctgctgtttttgggggaaaagacagagagggagaatagggctgacgagtgggccctacgctttttagtttttctcctatgacttacatgtgggcctcatcttgtaaagttttattgtgcccacgcaatatcatagtactgcactttacataaaatatattttatgtatgatatgaattgaattaaagttcaaatgcatagatcatgtaaaaatatttttttgctaacatgaaattctaaaaattatttaagacagatagaataaaatcgtagcgtttagcacgagcatattactagtatttaaaagaatgccataattcaatcctgatggatttagtcctacccctatgacaagattacaagtggcactaacaaccagtagagaaaaaaaatacagttttctttaaggcccatttagaattcaagaaaaatatatactccctccgttttttaatagatgacgccgttgattttttctcacgtgtttgaccattcgtcttattcaaaaaatttatgcaaatgtataagatataaatcacacttaaaatactataagtgataaaacaactcataacaaaataaattataattacgtaaattttttgaataaaacgaatggtcaaacatgtaagaaaaaatcaacggcgtcatctattaaaaaatggaggtagtattttcatgcaagaatgaaaccgtgttttgtaaatccaaatggaactagcaacagtttgcacgtttgcgtccagactccagagggcctattgccctgctaaattgcaattggaaaaagtacaccgaaggtccctcaacttgtcatcgagttacaaaatcgtccttaaccacaaaaccagatacaacgtgtccctcaacttacaaaaaccagtgcaaactaagtctctcgacggttttgacttcgattttatctgccgtggcagttgactcagcgtgggacccacgtgggtcccacatgtctgcatcttcttcccctctcctcttcacctctttctctctctgtcctctctccacgggcaattggcagagagaagatgggcgcgggtggcggctggcgagggaggagctgccaccggcggcggcggcggcgtcaccgagctcgggcgtcaccggatgccgaccacgctaccgtgctcggctcatcaccagcccacggagcgccacatccatccgcatgtcgtcgtcgtcgccgtcaccacatccatcgcatccatctctctctctctagccaccattgtccttgtcactgcagcgggacaacgccactcgtcggccaccgcccgcactcgtctcgctctccggaaacgcaatctccatgtcgtcggtgagggcggcgccgcctcaccaaatacacctacacacggcaaacggacaccgcggaaactcatcaccaacaaccttccagtcaatgctgtttgaggggagattcagagaatcggaagcagttcaatcccaaaagcaatttcattgttcctaaatcctaatcccttcgcttgtcgccgatgagcgcggcgacggagaaggggcggctggacggcgaggaggattcaccgcgcgcggaggcgttcctggagatcctcgccgggtccagtcgggggatgcggaagcggaggtcgcggagcaggtgctcaggtcccgcgtctgctactcccgtcccaagtccgccgtccgcttcttcgtctggtcggggcggtcggtgaatcacaccggctacgcctggaacctcctcgtcgacatcctcggcaaggccggcatggagtagcccatgtgggacgccgtccgccgtccgcaccatgaacaaggagggcagcggcctcgtcaccgtcgccaccttcgcctccatcttctcctcctaatgcgccagcggcaaccacaggaaagccgtcgaggccttcaatgtcatggggaagtacggcgtggagctggacgccgtcgccctcaactcccttctctctgtcatgtgccgcggggacgaccgcgcgcaggcggcacaggacctgttcgagcacacctgccgctcctaccacccgtgggcctcctcctctgccgtctcgcttcgccgacctcctccccaccagccggcctgccacgcccagcccctcccctgccaaccgtcggccgcggcccgtcgcaccagcctgccgagcccgctgcgccggcctgccgcgcccagcctgccgattgccgcctgtggagagggaaggagagagagaggaagagagatggaggggtggggaagaagaggctgacgcgtggggcccatgtgggtcccacgctgagtcagctgccacgtcggacaaaaccgggttcgaaaccgccgagggatttgcactggttttataggttgagggacgcgttgtatccggttttgtggttcaaggatgattttgtacctccatgacaagttgagggaccttcggtgtactttttccattacagtttgggttgaacatgttgggccttgccgcttacggcccaattttatgtgtccaatcataacccgatttcgttgtcaatctgtgccttcacggcttctcagacttctctcctctatcgctagccacagatccgctcctggctcctgcaaggctgcaacctgcaaccccaacaccccttcgagaatcgtcgtgcgcgcaggtatgatcccctctcgcctgcgcataccaggtccctcgctcgatccaatcttcggttgattgaagcgaatctggaggctttgcctctctagtaggtttttttttcctgattatttccactcacatttgcttgcgcatctcaaacactattgtggagaagtggggaggtggtgaaaactggcaatgggatcgttgtgggccggatcagggatgaatcttgggggattattgccttctgctcgccgctatagacgtatgcttgtttagttttagtattctgactcttttcggctgatcgtatcatcataaaagctcttggtccactctgtggtttgattttgtgcaagaagaaatataatatcgcatgattatattctgtgatcgtagattgggatagagagcagatgttattttgtgcacgcacacttttaaaatcctctgatatggttaactaattccgtgacctcttcattcagcaaacctgtacatgggtaaacaagcataactgaattacaggcaagccggtagcttggaaagaaccctcttactcccagtaaaaacaataggaggcccactactgctattttctttattgtgcttctgaatgcaaagtagcacaagtagggatattaggtatgggagagaaagtccttttgttttgttgttatcctcgttattgtaactgttatccggtgccaaattagcacctgttattgtaactaaaagtcagtggcttttattagaagataacatcttccattttttatttatacctcttaaaatgtatcttgtgaatgctcgaattctggcatatgttatgcaatcacattcatttgtgttctgttcatttaggacttgttatattccactcggctttcactatgtgttattttgtctaataataaaatagttcctcacaccatgtagcagaaggaagatggatgctaacagacgccaaggtggaattcagcaattattggctgcagagcaagaagctcaacagattgttaatgctgctaggagcggtaattgttccacaaatattcattaagaataacgcggaaattgatgggggggaattgcttatgttgtacgaaatatgtgcaatgattgcttcgatatacctacaacaagattttgctcgtatatttctttgttgatgtctttatagggtaattttgaatcatcctgtttgttgaataagttccattgtaccaacattaagcaaatcaacagtgggaaaattccatgttcagcagaatgaaaacatgctttctggaatttaaaacatgttcaacagtgggaattagagatggcctcatgttttctgttagttcctcgaaaattgagtgaaaaacatgctttcttgttactattcttctgtaccttaactaaggtaaagtacctgtctgattcctttgatatctttttagcatgtaattatcatggtattttgttcatatagttggacatcgaatatatcacatatattttggaaataacacctgaatggaaatgtataaaaaaagtggtatgttaccctgaattgtgccctttgacagcttttgtagaatgcgatggccttgtatgatcgtttacagaaaccatgttctatcttttgcttctaagcacgcaatacaaacatgttactcctactcattttttattcaacatctagagatctgacttgggtttgaaactgaatacctttcctattcgtcaggcaaaagaggaggctgagagagaaatagctgagtaccgtgctcagatggaagctgagttccagaggaaggttgcggaggtatgcatctttcaatcttgtatagttcgtggaattagaagagctattgccgctaaccttcctgtttctttccagagtagcggtgattctggtgcaaacgtaaaacggcttgagcaagaaactgacacgaaaattgcgcaactgaaggagcaggctgcaaatgtctcccctgaagtgatccagatgcttcttaggcatgtaaccaccgtgaagaactgataaaagttggacgtcctgccgacaaattaagcagagattgggctcaaattgtgtgctacctttttgttaattccaagatggattacaaatttacggatgtcagctatagccacgaaccctgttcttagtcatacaataccaataagccgcagcagatttattggtgaacacgagggatgattatacaataagcattcttgttgatgtgatttggcgagcctttgttgagctgctggagagaaagtgaatgatcctgtgtgaaactgacagttctagctctacctgactaccttatcgtttcctgccattctctcgtcagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69547 - DNA, 3344 bp, Oryza sativa
  unsure (1)..(3344): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaataaagttgtttctctgaaaataccttgaagtgaatgagtaacagcacacgttgcgtcggggcaacctggatggacggtcgacggcgaggtggtggtgccttggacggacggccggcgacgctgcccctggatggacggctggcaggccggcaatcccccggataagcggccggcggagccctggacggacggccggcggtgacctggacggccggccggcggtgacctggacggccggccggcggtgacctggacggccggctggcggtgacctggataggcagccgacggcgatcgggacggagctagcgcgaggagctcccataaccctagcctggcggcgtgggcgctgtttctcgcgagaaagaaaacgacgcgaggaaggagcgagaagaaaaaggaggcgggcggaaaaaaaatggcgcggacggtaaaaaaaatgggcgcgattggtgggattgggagggcgtacagcttcccaaattctgatgagattggcaccgattttaggagtgggtaaattttagaaccgtgattgacaatctgttagaggcctagttttaaccaaaatcctaaaaaataatttttaggaacctatttggccctctgttggagatgccctaagccaataggactttttttttgcaatgtttcatcgaggctgtagccaatgagttatcattattttaagatttagttatcagatgtatcggttatttaatcgatatacactcaaatctacctgcattggacttccagtcgatgtacgttttaaccattggatcgatgcagatctgtatcggttgattggttcaattctttctgtcatccttattagttgcaagattaaattaactagcacatccgaacctcatcaagatttagaacctgcactgaaattaagtagacctcccatgccttcgtgtgtcgcggcgccagatttcacatcacttactcagcatgtcacatcagctaaaactgggcataatattgtgtaggaccttgagtgatccggttttgtaaattaatagtattttaggttagggatgaatttcatacttagcaatatattaaaggacctaaagtgaacttattgcactttattcacggtgaatggcccaaacctcctggatatgcagcaacggatagggataatgagacaatgggcttgaaatctacccctcgcctatgatgggccatgccaaaaggaattgctaccgtgcatgtgccccgtgcgctaggtcacgctcacgttgcacgcgaatcgatcgctaggacggatccccctccctcccgacacctgttttttttttttcaccgtattactttcctattttagtaaatttatgcacttaaaagtttatacacctcaagtttacacatctaaagtttatacacaaagtttagagatctaaagtttacaatcaaaagtttatatatccgattcaaatttgaatttgaattcaattattttttaatatatagtatttctatacatctaaagtttatagagccaaagtttataagtcaaaagtttacatacccgattcaaatttgaatttgaattatatccgattcaaatttgaatttgaattcaaatatttttttatatagtatttctatacaactaaagtttatataccaaaagtttataagtcaaaagtttacatacccgattcaaatttgaatttgaattcaaatattagtttatagactcaaagtttataagtcaaaagtttacataccggtttaaaatttaaatttaaattcaaaaaaaattatatagtatttctatacataatcgtttttccaactttgtttttttattttttaaaaaaattatggtgtagtagaaaaagaagaaaaggaggagaaatgggggagagagcgtatagggggatgggatcgatcacccattaaccacaccctaccctttgttcctttactttttgttccatgggtaggaacagactccatccacttcgttgtttccaatatattgtcagaatcctgaatcatgtcatcaatcacaattacaattatatgatgggtctacaacataatagtcgtccttactccctccgtcccaaacgaaatgaatctagctaggactgaatgtgacatattctaatataataaatatggataaagatatgtccagattcgtagtactagaatgtgtcacatccaataggttagtttttatgggacggagagagtactctctaacacatgtgacatgattgtattatatatgagattagttccgatataatcctgtgggtcaacagcttacataacccataatgtaacaaacaatgttattccatcgtgtgttgtaccagggataaatcatgtacgtacatgtaaattcgttcaaacagtgtatctcgattaattgttgtttaataattttctactataaaacaataaataaatagtcttttctcctataaagtttagttactatcgtacaattttgtaaagttttaaaacatgagttgaaaagtttcaaaagtgtaaagttacattttgaatcctataaagttaattataaagttattcatcactgagtatagttaatgataattatcgtttctctcataaagccacacatcactttaattattttcaaccctttgatcattcatttatggtgcaaatcgttcccttcgtctctagcatgaatccacgtacaacatctcaattgtttttgttttttttatcaaactacctgtattgtttttaacatttgaatcattggtatttttccataatggcaagatgtgattgtgtaaagtacgtgaaggcaaaaagtttaactacaaagcaaatttactttgtacctcacgtttagttactatcgtataatttttccttagcaatgcccagactttcatctacatctattttaaagacaaattatacataaatctttttatttgcgtggaaaaagaaaattttccctcctgttattatagctaggagg

SEQ ID NO: 69548 - DNA, 14097 bp, Oryza sativa
tacatgctgaccagttttttttaagatgtgtttataggtgaatgatgtgcgtgtgtacgttcagatgataagtgtacgcacgttgtgagtggttgtgtttgtactatatttttttaaaaaaatggctaatgaaatcacttgagcatcatgatcgaccgtggaaaatgttacaactcagcgagggatttggaaacatgttttgagaatcaacaaggtttgtcgttggaaacggcacggaactaacttttggaaggctgattggtcgactgtttgtcgttggaaacggcgcggggcatccagctctcaatgccgtccttgttcagtcatgtagttaggccaaggtttacagtggcacaaaggcagcgtgataattgttaggaacgtgatatactgatatacaagtggcaccctccaatatagagcgattggtgagtacggagtgagtacctagttccgtgggacgacgtccaggagatcgagctgcacacaaggaggaccgaccaggttcaatgggcagcgtatcctatacacacaggccttaacacggtcttcgaaatgctactttaaccaaaaatgactacaaaagtaaaatattttaaataaaaagacttgcatactatgatagtaacattaaatttacatgatttatctttcttaatttatcgctattaatagtcaaaattaaaacagtttgacttggcactattctagaaatgtttatattttgggacggacggagaaataaaatggcaaaatttgctacaggacaccgaaagattgcggcctttgctgtgagacacccaaagatcgtgtatttgctcgtggacactgtaaaaatgtggtaattagctggcggacaccggccgcattattttatcatttccggacggagagagaaactttgattaaagacaagtttacccatgggcccacttgtcaatctctctttctctgttcatcttcttcctctctttctttgttcatcttcttcatcttctctctttctcattgcaccgccaccgagctccgccgtggccgagccgtcgtgcgtcgtcgccgtcgacagtgaacctcggcgatgcgccgccgccgcctcaccgtggccgagccatcccatggtgaccccatcgtggccgagccgtcctagttgcgagccacgatgcgttgccgccgccgccaccccgccgcggccgagccgtcgactgagccgccccgccgccactgccatcggcgaggacgaagaagccgttgagaagtgcgcgcgcttattggggctcatctcgccggagagcttgaagatgggggacttctgtggtggggattggaacatagggttggtgggggcggcggcgcctccgcgtgctggtggccatgggtttgaggtgggacaaggcggagaggtcaacgagaagggcaaggagcgcaccgacgagggagaagaggccggagaaggggaagtcccgccagaggcgtcgcgtggcaacgacgcagtcggcggcggcggcactgccaagcgtgcgccgcgctggcggtgagacgccggtgctgatgagcggcacgaggcacgacgcgatggcgatggtgaggctgacaaaggtcaggatgctgttcgtgcggtgcggtggcagcgtgaggcactcgtcggaggagtctgtgttggacgacgacatctgggccgccgcgaggaagaaggggaaaagaaaagaagagagagagaggaagaacagtgtcaaagggtattttggtacttacacaactctttctctctccatttcaactgaaaaaataaaataatgggaggagtgtccagtagctaattaccatatttttacagtgtccatgagcaaatacacgatcttttagtgtctcacagtaaaggccacaatctttcggtgtcctgtagcaaattttgcctaataaaatagagcagggactgaatcttcaagtcaaagaagaacatagtattataaaatatatacatatatctgcaaacacaagattttcgtataacttcgattacctgcattctaattaatcgttgaacggtattatgttttctgcaacagtgggcgggctaaggtgagatcaaggctaagacgagagtgccatcaaacgtcgaattcttcgtctggctagcaatccagggaaaatgcctcacagtttataacctcctaaaaaaattgatatcatcaacgaagttgtcactcgtgtatctcagttgatgaagaatatcgcaagcatatctattagtttcatgtgcttacagtaacagtttttctttttacacctactgacctacactaacagggtttggaggctatcaaaaggcggtgtttctttctaacttcttggagagctggggcaggattatttgagtgattggtgccttctggctggtagcaaggtgggcttttcagacgagctataggaaaatcctttgccaccttcttcatgttggtatgttggctgattcggaagaaaagaaatgctagggtgctcgaaaggacgacctcgcacgccatggtaactattcagggaaatcaaaacgaggtttaattcttgaaagaagtagttcctgtagtgcgaaatgttgaggttactagtgattggttgaggttggaccacgcctctctacagcgttctattgatatcatgtaatttctaataagctcccttcctggtcttaatgaaatttgcttggccgttttctttcgtccgacccggctaaaaaggctaaagctaatggagaaacgcagaccattcagttcagtatgcttcaacgtcaaacgccaaaattactttgaggcaacggaggagaaggcgaagttttcaaaaaaagttttttaaaaaaggagaaggcgaacgagcaaatttacctgcagagaaatcacctacttttcctccttgaacagttgcactggcctggttggaggggcgcaggcttcattctcccctatgcccatatactgtaccgggaggacgaggtacatgaaaaacctggccgggcttcatcaatccacgagtcctcccgcgcgacgactcacggtgcattggcgcccgtggtcctcagcacgttgtcctgcctgcgcatcagtcggttcggccagccggccggctaggcgagcgtgcaacgctgccaaaaagccaaaggccgaaggtaaacagcaactcgtgcaacaaccacccgcgacagcgaatgtacctacgaatggtgcagagctacaaatggcgagcgtgtgcaacgctgtcaaattaacagaataactggttttggcttctcctggcagaggagtagatcaggacactcgagttacagttgtacgcggccacgcagttatacttggcagcttagccgctacgcattcctctcgatgtctgtacgtgaccttgtcctactccatggaagacaccgggcttcatttcggaggacatagtaacagtgaccggtggattaacatttgttgccttctccatatatgcaaccagacgatccgggacagatagatcataagctctaagtctccatctccgacaataattgacgccctcgtcactcacttccaactagagccactatcgtgaacgcccgtacgtgcgccgttggcccgtcccctgtcccgttaatggatttccgcgcaacaccgatccgatctctgtttcctctcatatgtcgccatgaaagttaccataaaaaaccggcccaactccacgctatatcgtacgcagcgcgcgcggtgaggctccggtcccggcacgcacgacgccgcgcgcggacagacacgccccgctcctgccgatcgatgcaccaaatcctcccgttgcgacgacgacgacgaggtccacttccccacctccgcttgtccacggcccagccgcccgggttgcttcagctggaaggcgtctcgtgcagttgtacgagccaggaagtgagaattcagtagtactaagttgcacggagcgagagccttgctgctcccgtcccgatggcgactgcgccgtgcatgggggaaaacggcgatgtgtttgcatgtattgcatgtgtggcgtgtccgctccgcgtggtcgatcgcttagctataccggagtaccggacaagctaggcgcgagcggccagagcggtggcttggaccgcgcactagctgccactcgaatcgttcgtacgttgccgcattacacatgcatttatgctcgatctcgtcgcgtgccctcgcgtctgaaggtactcgttcgcatgtgaccgtgcagtgcaaagatgctacgcgtatgtgttgattggctaccttggctgtatcattatctacctggggacgcattacgagaggttggttgcagagaatgcaagcgcgttcaagcgttcatgcctgaggtgatcgtttaattatgacgttgttaattatatgcgtaggcgcggcatgtaacagaggagaagatgcggccaaatctgagtcgtacggctgctttgtcaccctgtcgtcgattagatccgggttgtgttaagttcacgttaaaattgaaagttcggttgaaattagaacaatgtgatggaaaagttgaaagtttatgtgtgtagaaaaattttaatgtgatggaaaagttaaaagtttaaagaaatattttagaactaaacgacgctggttattccagatgtggcattggctagctggaccctctacagtgattcacaatgctatgagatctgtagcattttttctcggtttgggtgtgtttagtttcacgttaaaataggaagtttgactaaaattaaaagtttaaaaaaaaagttaaaagtttatatgtgtaggaaagtcttaatgtgatggaaaagttggaagtttgaagaaaaaattgggaactaaacaagggcttcgttccctatctagatgttctcgttttgctgatgaactacgggtgtgtttagttcacgctaaaatttaaagtttagttgaaattggaacgatgtgatgtaaaagttggaagtttacgtgtgtaaaatagttttgatgtgatgaaaaagtttgaagtttgaagaaaaaaatttggaactaagcaaggcctgcgttacaccgcttctactccacatgattgcaagcctcctacctggaaaagtcagttgacaggccagaaatgattcagttttcattgtggacagtgttaatttctagagaaaatcccctatgtacccatgaaagttcacctaatcccttctatacccctgaattttgctcaatcccttacatacccctgaattttagtttggatcccttctatgccctttccgctagttgaccgttagttgaccgttaaattcttttgaaaaagtccattttgccctttgctatgaagaaacataataaattaatgaagtatattgttggaatgtaaaaatttattggatgggactattatatttatgagtatgtgatgcaccatattatttgtgacaaatttacttttacatatgatataaaaagttgatacttatttattattagttattaaaagttcttttatgtaacatatgtgttttcatagtaatacaacagatttgtttattacttcagaacacatatgctaaaaaaaatcttttaataactaataaataagtattaattttttatgtcatatctaaaagtatatttatcgcaaataatatggtgcataactatctcataaacataatagtctcatataacaaatttctatgctccaacaatatactctattaatttatatgcttctttataccaaagggcaaaatggactttttcataagaatttaacggtcaactaacggtcaactagcggaaagggcatggaagagatccaaactaaaattcaggggtatgtaagggattgagcaaaattcaggggtacagaagggattaggtgaactttcaagggtacacaggggattttctctaatttctatcacatctctatatgattgtttaaaatccaagtcttttttgtgctttatataaagttataaactactcacaaggtggcattgatctcaaatgatataccacaatgctgcctaaatattgaatccaacgccacaacttcaatacttttactatattgaatccaatttactactagcagtataagtttgagaaaaaaattcacataaatacatatactttgatcaaactatgtgtatcgtaaaactacaggtttaatgttaaatttatcccagaactacagatttaaaaaatatcatatcgtaaaactatatatttagtgatgaagttatcaattaagaactacacattttatattttatatccataacatattgagattacaaaagttataattttgtgatatgattgatcaatgtacatgtagctctatgaaatttactctatgttttttttggtattaaccctccatgggtagtttatagctaggatggtattattacgaacctgtacatacacatgaggcttcgatcgtagtataatttgtacatttattatcaaaaccttatgggcagtttatatagagtacaagacgacttggaatctaaataatcctagagagatgtgccatgatagccggatcttcccccagtctaatcgagtactcgaaacacaattaaccgatcagtggtagtagatcattattagtactttcagctgatccgggaatggtgggatttggggtagtttggtggtaaacaatggaaaactctgatagggggaacaaagttttgcgtgcatgtttgcttgttcgagcgatatttgcaatattgtttgtctgtagcctcacttccagtactatttgcaatacctcggtgttaatcgatgcattagtttatgtatacgactatatccctccaatctccagccaggcagaaattcaggattccgatcctaaaagtgagcattactcctccgtgtgctcgccccgtagcaaaacctggacacgggtcacatgcatgcgtacacgtcggtatgcacccctggttcctcggatactcatctcgatctgtatacgtcgcatttgggagatttctgaccctcgcaaaaagctggcctgaaaaggccacgaaagtgcgtcgtgaagtgatcggccaggtgaaaagagcgaagaattaagccgggtggttcacggttcaccggttacacgttgtcacgttgcagtcgcgacgggggataatgacgatatgccccccacgctggttgttgccgatcgatccagcgtcgcggaccgcgcgcggttgcagcggaggagctttggatgccgtgtgctcctgtgcgtgcaggtgcaggcgagccgcgatgggtgtgggtgtggccgcgcgtccgcgagagacgaacgcaccaaagtcagacgcgaggaatgggatcgtgatgcacgtaaggggtacggaccgatgccaccaccacgagccgttgctgcagcggcacagtattttatccgaatccacatgcattcctcctcttcctctacttttcctgactttcctcctcactctcctctgccacttcgcttgcgttctgttcttcatctcctcctcctcggtgccgcatttattactcgacagagtcagacagttcgagcttccatttcacacacactccaccggctcccccttcttctgcccccttgcatttcaccaacgcttacctgctccatacgacctccagtgcagtgcagtgcctctgaggtctctctctctctctcacacacacacacgtcctctggtcaccgacgctcctcctactactagtacagtggtaagcacagccatttctccatccatgcatccgtctatcttggcttcgttttgctacttcgttgatcgatccctcgttttacttaccttcgccttctcttggcctcgttttgctacctcagtgatcgagcccctcctcacttaccttcgccgaagatccatggcggaggactaagctccggctgctgatttcttcgctttggacgcccgcaaaaggtacaacacttctcatcttcctctggctctactgcctcaacgagtcactgttcagtccaggcgattttcctcttcctgcaatgtcggtgagcgagctaccgaatggtctagtagacgagaagccagttttgttgccagttttgtcgctaggctggtaaacggcgtcctcgcgagggtggtgcaggtgcaggtgaagcatcagcgatgccgggaaagaaaagaaagggagaaaaaaaaagatagcatgaacaatccccaaacttttcagctccgcccactttattacgccaatctttcccttcatcaggtcatggctttccgtttgtttcatgaccatgacttcagctgcctgcctagctagctagtacctttggggaaagcggccaacaaaaagcctacgtccccgtcctgttcctttcctcaacctcccacaccgccgtccagttcaaaattcaaagttcaaacacctcatcctccctccggacgctgcgctgcacggccgcgcggccctcctcggcctcgctgccctgaccggtcagcgtcaccgggcgtccgggccagtgggcagtggcagcagccgtaaacccgtataggtgggacgctcatcccgcaccataaaaatcccgtcaggacaacacgggagcggttagcgtgatccgacccaaatctaatctaaacccgtccccgtggattacgcatcattaccccgcatctgctcgtggattttattagcttctcctctcgctacgtttggggtttggtttttgatgggctaattattagcggtggtggaacctgaaaagtcgcgtgttttgtgctttgcgttttgctcgcttgccgtgtgtagcggtggactggtggcgtcgttcgtgtcgcgcaccttttctctttttttttcttcaccgggaccaactggggaagaaagatttggggggtttttggccgtttcggcgtctcatctttcttctcgccgcgcgcgctcgtgtccagtcgccgccgtagttgtacgagcgctatccttgagctttggctgcacgggattcattgcaagggatgcggtggccagcgtcgtaacttgctcgtttcagatcgtgacgctgtggggttctctttttcagttactgctgctactgccggtaccggctgccgaggaggggaatgaggatgaagacgctggcgtgctgccggcggcggccgcaggacttcagcatcgacatggaccaggagcctgacagtaagcctgaaatctcgaatctcccccgtttttgttttcctgcctcattttttttttacatttctttttctgttcgtggtgttcttgcccggttcatgtgcgtacagctgccgcattgtctcatttcacggtgtatttgctcatttcggtcctcatttctcaagtgcatgagttggttgtaagtactactagctgtagtagttgttagttgttggatcgatggtagctgcagcatgtctacaagccccgggcaacctgctgctccaaatctggccaagatttggagctgcctaacttttcttcacaatttttttacccgcacaaccaaaatccatacagcaaagaagtaggagcactagtagtgtgatgaaacaaaaattttcagagatatattttcttctagtactagatgtgaacgtgatagggtcatggagtgtgggatagcgctggtgtcagcagcagtagatttggcactgagcagtcacgaccaacgcgactgttcatgcctcacgggccctcctctcctctcctctcctctcctctcctctcctccctgctatgtgcttggtctccgacggaggctgcagcacagtgccatcagccactgacgttaggaacgtgggagtaaatgggagtcacgaaagatgcggcaactctacgagtaaaaaaaagcaaacaagagagagcaagcgagtcatggcctctgctatcttgatctgacgcgaatccgggcggcgccggccgcattcacgcctcgccactatccaactgcttccggtctacactagtcttgacttttaccagcctagtgatatttttatactcttttgtttgcgtttttgatctctctcttgtatccgttagcttctggtgtgtttgttcatggagtggtagtgcaggagtacaagactacaagcagtagaaactagtactagtaccttttatttttggagcggcgtgtgtcggggaccagctagctactttcagctgggtcaagtgcgacatctgcggcttcattgactttggaggataaagaagtaacgtagtggtaccctgctttttagacggtgagcactgagcaatgtgagcaggcaggaagttggggaggagtagggagtatgacttaacgactaactacaatttagaactataaatcgtgtgcgccatgtgagcatctcgtgaaagtgtaacatagtttttttctgtagggtagataaagaaccttttttctttgtcttacaggggaatctgggaatctcagtggtggttagcagtaaaagggaccacttagaatgttttgaagctatcggctttcaatgggagtgtctgtttgtgggttctgtggtgtcacaagaacctagcctggtttaatgtgtgcctacctgtgcttatccgagctaggtttttagtggtagcaagcttgaactagcgtagtttgtatggaagcggaatgaattatcagcttgtacattgcggtggagtgaggcattaagcgttacagatggcacactgtactatctgtagacagaagcacatggagttggcaaaacatcagaacatttgcaatggcatactcgtactgtcatgctaaaggcattttttttctcaatatcttgagtgtattacggtgtacagtgcataattgctagacttttcttgagttatttgtgaagtgctcttcaaaagaatcattgggtcgttgggaaatatttgtgttaaaatgtatttctgaatcagcacattagagtatactgaaccaaaccctgatctccatgtctgtgcattttaaatgtaatatggcggtataactaattttattcaccgttttcattatcgcaagatcaggctccctggaaattcttaaatttatgtcgcatggtcatctgaatgatttaaaatcttgccaaaataagttgaaaataccaaatgatgtaggggtgatgacgtacaatggccttgagagctgtattatcaacagttcctcttatgacgatgatagtggccttagtgcaacaacgggagcagatgggtgtgtaaccactgattccgttgatgatgaagtctcaagttgctcctcaagtaaagatgtttctagctcttcgttctcttcacaatgccatccactgagaaagcaagaggagcattcactttacgagttggatacactcagtgctgtccatctacttcctctcaaagggaagaagccaatcacgtataccttgagtgcttcagacattgaaaccatgaaggagaagtttgggaagctactgcttggtgatgatgcttcaggaggagctagaggtgtttgtgctgctctggctttgtccaatgccattattaatctctcaggtatgcttaaccatttgtttggaaactatgatattgtccattgtagaatttttttgggtgaactatcatctttctttcctttctttttttgaagtatttgttccatactcctatcatcatgaccaaaatgatcatttcttatgccagccactatatttggagaactctggaagctggaaccactctgtgaagagaaaaaagtcaggtggcggaaggaaatggactggttgctttctcctacaacctacatggttgagctggttcctacaaaacaaaatggagcagacgggtgcacgtttgaggtaaagatccattgaataaagcctgtaatttcactaagtgctgtgtctaatgtttcttttactgcagattatgaccccgaaagcacgttcagatgttaatgtgaaccttcctgcccttcagaagcttgattccatgctaattgtatgtttttgttattattatgttacactctagtaaatgaacatgcatatctgacaaagttgccatctcttttcattttattttacaaatcaaaaaatgttcataaaccatcgttcacttaattatgcaatgtcatagtttgtatctcctaatcctgcatgccacaaatgtgcaggaagtgctggactcgatggtagacacagagtattggtatgtggagagtggtagccgagctaatggccggggcaaaaagaatggtctgaggcagacgaagaagtggtggctcccatcacctcgtgtgccagatatagggttgtctcaatttcagagaaataggcttgtttttcaggctaagctggttcatcaaatcctcaaagctgcgatgtcaatcaatgaagaagtcctgcttcagatacctattcctccagctgtcacggatgctcttcctaaggcaagtaccatttcaagttaacttgtttgtgcttcatgacaatctctgtgaatttcatgcttcttttctccctttaattgatgattgtactgaatatatggtcttaaattcttttgcagtctggcagagctggcttgggtgaagacttgtaccatgctataaccacagagtacattcccatagaggaaattttcctctctcttagtttaaaaacggagcataccgtgctcgagactatgaaccggttggagggtgcagtttttgcatggaatcaaaggatctcagaggaaaagagcaagaaatccccaggaaggcattcctggaatttcatgaaggatagttcatcagaactcgataagatgtccatgtgcatagaaagggttgaaacacttatgcagcttctgaaatccagattcccgagccttcctccaacttttatagaagttgtaaagatccaatacaatgtggtaagttcgccattacataacaaccatttgtgctcgcgcagagcatgtaacctttgtccaaaatgcattatgaaaccttatgaaatccctgaacatgttttgttctgcttgctgaattttttgccttttgaacgaacttactacatatctacgcaggacgtggggcatgccattgtggaggcctactcaagggttcttgttggggtggcattcagcatactgtccagggtagcagagattctgctggaagatgacctgatcaagaagcccaacacccctctggccacactcaagttcgacctctcctccgacgtgtacctcgccggcatcaccgagacgccgccgggccacatccggcggtcgctgatggaccagatcagcctggtcgacggcagcctcgacgcggtcgtcaggaagaagggggtgaagcagcttaggtggtgaaaaaggacatgaagctgtgaagtttttctttttggcagttgtacagggtttgtgatgatgatgcatgctgtgctgcgcgctggctggctacataaagttggttaagttcaccttgctaatacgtcctgtatggaacgggctaaatagtgtatgcatggtaaaagctactagcattggccgcatcgtacatcaacgtttgcagcgatcaaagcgtgctgttgcggtgcattggaccgtagcctgtggttgactgctggatggcacggcttgggtgtgtgtgcgacgagcagggtttatcaaactgtttgggaataagttcaccggaggtccttaacttaacagattttgagatcccttaaccacaaactagaaatgtgtatctctaaactcacacaaaccattcatttaaggtcctatgataatatatatggatggtttcgctgacgtggcatcctagttaataaaaaaaatttaaaaaagtatgtggagcccacatgtcagctgtacattctcttgggcgaccgcggatacgggcggcgggcggagcgacgatgggcgaccgcggatacgggcggcgggcggagcgacgatgggcgaggcgggatgcgggcggcgggcggagcgacgatgggcgagcgcggatgtgggcggtggcggagcgacgatgggcacagcgatgggcgagcgtggatgcgggcggcaagcgagtgcggcagtagtcggcgggtggcaagcgaagtggtttggg

SEQ ID NO: 69549 - DNA, 26032 bp, Oryza sativa
tggcggtcgagtcacaggggagctctccgagatggaccttcacttcgggaggcttgtcgacgaaggggaggagcatgacaaggacggggttacggtcggggtcgccgtgcaccacgcggagccggtggcctctcccctccccccgctgctcttggatatgtggtccgccaccgccgcgctcatcccccgttgccgctccactgccgcgctcgcccgtcgtccgctccgcccgccaccactctatcgtggtagtcccgcggttaggtggctactacggttatcgcgaaaaccatatggttatcatgaagtatatcattgtttcaaaaattgaaaatgttaccatatatgataaccacgataatcgcatggttttataaacctcactctcgcttccctcgttccggagcaagacccgttcggtttcctgcagggacacggcgagaggaacgcgacacggacgtatcgctgtcagctgtcaggtcaatatttggcgtcctggacgggggctagagaccggtgagctgatgacctcgtccggtcgaccccgtcgccgaatgcttcagcgtttgagaaaaaaaggggaagcgcagaggcgttcacgggtcacggcttccacggtcgcccgggtcctcgagcgtccacgggcaccgccggcgcggccggcggacgcggcaactggcagcgtgctagtcccggttggttggagggttgacatgcgccgtgtggctgacttgccgtacgttggtcggcgttttggcgtggcattggagatgggagattgggagtgggagagaagggtggcgcgctgcgacttcgcggcgtggactccacaggagctttttacggtgcaactgcacccgtgtgcccgtgactcggtttggtctcgacattctcctcgactcctcggcgagatcgtcgacggtcaaaacaacgtgtcagctgctgtcgcgtcgcgacaagcccagaaacccgtgctcggagaaacactgatcccacaaatccactggcgtccttgctttatcaaagatctaaattccatgtagtttcacgagctttttcttttcttttccacggaagtagttccacgaactgtttataaaagaactacgctagtagtttcacataaatgtatagtgaaaaccatatctaggtggtacctgcaaacaacggtataacagttcttagaaaaatatcatacatatagctaagatgatattagacagccccagagttgtaaaaataaactcatcttcgtttgtaagatacttgtcattggttagttcattttcaaactaaccatcgttaaaaaacaaaggaagtataaaattgagaagaatattgctatattttaattgtgtgattttttgtgaaattccagtcacataaaaattgtacactaaattgttgcgatgtgcaatacgccatttacttttttatgcagttttattgatatatatgggtttactttatttttatttgagtttgaaaactttttgtatgtatttttgtaaacctttatgtattgtatgtttcttttttatgtagctcggtgattcttttcatataggaatagtttattgcttgaccttttgtcgagcaatccccttacctctggtcaggctgtcgggggaaaaccctgtcttggtttccctgagatctggatggacagcggcggtggtgctcatcgtcgttcattttcctggagatgtcattttggaggtcccttgccaaaacttccttctggtagttagtgcaagcttcctctatatgcgttgttttcttgcggcggtgctctagtttatatgagtaggcgggctgtagggggagagcggatccattattctttctcaccctcccccctcaatcccaaaggcgtgatcagagttgagttaggtgcttggttgtttgggattggttttgggtggtcccgactgtagcttccttgttagcctagcggtggccgatccaatgctagccttctacttgagtatgtatatgtgttgtcggtgcgtgtggtggtgttttttttatttctttcctaactactgccttatagggtacttgtaatttttttcctactctattcaatggatcatcacgcccgtgttgtgctgatcgctaaaagaaaaaaatgagaaaagtgattgattttttttctttaaatttgaatttcctgatgctcccaaatgaggaatagtggataaggaaaaaaagaatagtgtttttctttgcgatttggttagtttttgcatcctataatcaaagttgagtttgttcttattggatggctgtttatttaaatctaaacttcttattggatgattgtttatttaaatctaaactactccctccattttacattataagtcgtttgatcttttcctagtcaaacatttttaagtttgatcaagtttgtagaaaaatatataatagtattttcaacacaaaacaagcatattatcaaaatatattcaatattagatttaatgaaactaatttgatattttagatattgctaattttttctgtaaacttgatcaaatttaagaaagtttcactagaaaaaaaagtcaaacaacttgcaatatgaaacgaaaggagtagatgtgtattttttttacttctaacaaaaatgttttcaagtttccatagtatatgttctgcggttatatattcaaatcctgtgtcatgcattaatttcaacaattcttgggatttattcatacaaagtatggaataaaattgaaagccaacaaccttttcacatctaccaactctgaatatcgaaccaattctgacaaaggctgacctaacacatatctctttttttcttttgttccttgaacgtgctgatttttacattgttttgatattggtaccaatgacgaaattgcatttatctatctttccatgtgatgggtcaatcacatcgaatatatacacacacaacccaatatatcaatttttctagcacttgcgttaacttcttgttggtttctctatgttgtagatgacatgaataatttaaaatttgagcatcatatgatgatataaacacatcctaaagctatagtgtcgatgaattttagcaactatctatcttgaacactcaatccactttatgtttcataacacatctattgtaagaaaataaatatattgatttctacttaagttgttttcgtattaatatcactgacaagattgtatctatctatctagtctatagagtgaaattacgtcggatatgtaacacagcctaacacgtcaaattttctagcacttgcgtccactttttgttggtttttttatactttagggttgatgtactctagcgactacctatgaacactcaaccactttatgtcttgtaacacatctatctcaacaaaaagtcctacgtttctatcttttgggtcaattgttcacatttatttgtaaaatagcaataaatcacacatcaattatactatttcgttgtttccatttttttttaccaataatgcatttcacatattttcccactaatggtattcacatgccattcaaaatagcaacgaaccatatacaaccggagggcgaaatatgtactactttcagaacgtggtcaacaaatttgaaattaccgtgtaacctcctaacaaaaagaaaaacacaacgaaacacgagttggtctttcatcattttccacgtacaaccgcatgacgcgaagatcagaacgtatcagacggtcaccgtgccatctggacgacaaagcagcgtgggccggagcacgtgacggcgtcgtcgataattagaggccgttgctgctgtgcttaccactgtgtgcacattgtcatttcaccccctttgattaattaaaaaaaactcgacgcgtaaaaatatatagaagtactaagctaatcgctggacggaaaagggagcgaaaaagaggcgagagggaggtgtgacggagacgagcaaggaaagggaagagagaagagacgaaacagggaggaggggattgggactcgccgcccccctctccaaattccccactcctcctcctcctcctccgcctccgcctccgcctccgccgccgccgcagcctatcccctcgccaatccggcgaggtagaggagtgggtctcttctcgtgctctccccaaaaccccgcgcgcccaattcaccggggtcccgagctcccggcggaggctcgggagcgggagcgggcaggggcggaggagatcggatcgggggaggggggagcattgggcgatgaccgccgcctaggatgcagctggactccgccggcggccgcttagctgctgctgctggtgccgcttatttggaggagcgtgttggtgtgatcctagtgggagccgggagccgggagccaggtggattgggctgaggtggtggtggtgggcatttgatctccgcgggggcggcggcgattgggtgctgggaggcggttgcgcgtgtggtgtatggaggtttcctgggaggtggacgcggcggggccgccgtggaggccgagtgagtccacggcgttccttccgttcgctgctgctgcggcggccggggaccgggcgggggcgtcgttgtccggtcgacgcaatgggcttgccgcccgctcaagcaacctcagctccgtcaggaagaggcctgtacgtttcctgcaccttccccttctcacagggctacctaagatgcttgcttgatgcggctgcggtcaggcctcgctttgctgaattgtcaattgcattgagctattcgcacatggttacttagctggaatgcgattagcatcaggtgcttgcaaggaaccaatagcttaaactctggtcgcttgaactagctgtatcatatgatcacccattgttgctgccattttttcttattgcttgcacgcatggtctagattattcgattgctcagattttctattgattcttcagctacaaacttcatttctgaaagctctcagcattgctaaccagaaatccgacccctgttttctgctaaattcgaatgcactgttaagtttaatgtacactagatttgtttgcttagcttgttcttctaatcgtatagtcactagaacaggtactttactgctacaggcggtcctaattactttgatcataattcatgagcgaatgggaggcattgcacaactcaaattgacttgaggatcctagctttttgctaagttaagatgttcctttaaattggtatttattttttggcagcataactttgctatctcatccaggggtaagcacaatactttagggacaattttcaactttgttgatattctgaatgtattatattgtaaaatgatgagggaacagtctatgtgacattttttttgttacaattgttcaactgtgtatgacacctccttcatatacttgtgatgcttcactctaaattatattttcttattcctgcagtttgttgcaagattaaccacagacattgtccaaactttcggaaaatgcaatcctgagtttaagtactcagattcactgaaccccaagcgctttctcaccaacccttcagttccagctcacaatgatggccttgataatgcaaattctgacctcatcttgtatgtcaacttggaattggttaataaaaagtcggaccggaggttagttttcttcttgacttgttaacccttttatgtgattcaatatttgtgtctgttgtccatttcttagtgagttagagcactcaaaacatttttaccagatatatctcttttcactattttgttttttatgttataagttagaaatatgtatgcacattctgactctccattatactaagaactcagatgtggaaatatgggaagatgaaatatgtccaaaggactgccatattgccacacattgtagtttctttcaaattttcaacttattgaacttaggcgataaagctatccaattgatcaattcaactttgtgttcatattttttttatcagagttcctgatggttaaagttaagagtacctttacggtgctctctagtattctactacaagtattattgccaatagaagtgatctcaactattaatttatgagttctactaccagtagaaaatattattatactaccagtagttgatgtggtagtataaatagatatgatctattggagaaaaaaaatgatctagattggttctactaccagtagagagcattgtaaaacacctctaaagttaaactatgaacagcatcagattggactgcactcatctttttattgttctaagtagggtacgttattaaagaaatgcttggccaaggtacgtttggacaggttgctaaatgctgggatggagaaactaacagctatgttgcagtaaaggttataaaaaatcagcctgccttttatcagcaagctatcatggaggtctcactgttgagcatggtacagtagtttacctagcatttactcacttgtgattgatgtatgtaacgactggcatcacaactgtgtatgctcaatcttgcagctgaatgagaaatatgatcctgatgatcaacaccacattgtccggatgctggatttttttctctaccaaaatcatttgtgtatagcatttgaaatgcttggccataacctgtaagattgtcgtacttctcttcgctaatctattatataccatgtaactaattcatgtatcacttaaactcccacatctagttatgagctgctaaaaaggaatagtctaagaggtttgcaactgaaatatgtccgaactttctctagacaggtaaggttttattttcatatggtgcttgaatttttgaattttaaatgcattgattaccatattatctatgtctaattctttattggtcagatattggatgcattggttgtcatgaaggacgctggcattattcattgtgatctaaaaccggaaaatattctcataactccaaagttagttgtctcatctcaaatcagcacttgatttgttcactgtttgcatgctattaatccatccacgctatatctttgcagtgtaaaaacagcagctggggttaaagtaattgattttggatcagcatgcttggagggtaaaaccatttactcgtatattcaggtttcattcaaactcacccatcagtgtgaactctgaattcatgttatagtaaaattgttgatttaaagaagcttctccttttttttttcttttccagagtcggtattacagatctccggaagtacttcttggttacccgtatcctgtgtgacatctatttttcactaggaaataccttaaagctgcacaaatgtcttatgcttttaatttgtttttctctgttatgtccattttaaatttgtcattatgtggtgcagcttttgtgaattctaacatctggatttgtaaacttaacaagtactagatataccacggccattgatatgtggtcatttggctgtatagtcgctgaactatatataggattgcctttatttcctggagcgtcagaatacgatgtcctatgccgtatgattgagattctcgggttagtacatctgattgaacttttccctcccttttcttcattacaaccaacaatttacagtgaaaataacttatattcaattactttgtaactgtctgagttctttcacttctgttcttaacttttcagaaatgttacaacattgcttttatggaaattcaaaagtgtttttaaacatgtttgcctttttcttatacagtggacaaccaccagatgatctgctacgggaggctaaaaatactgggagattttttaagcaagttggaagtatttatcctggtattgaaatgcagaatggccctatcagtgcgtacagaatattaactgaagaggagattgaaactgtaatatttttattttttttaaggttacatatttgtcctgtcctatacatttacttcattattacttatctataccctgtttacatcctgcaacacagagggagtccaaaaaaccaaaagtaggaagatggtatttccctcgtggaaggcttgacaaactcatatatacatacccttggaagaatttgaatggggaaaacttgccaggtatgttttgtgatacttatttttaaggatggagctaagtaggtttacagctgattttgaaactgtgtttattctagaacaatctcagctagcagtgatcaatatggcagacccagtaattagcgtttcttgcggaatacgtggttcatttggtgtgcattgccttaaggtttattgcctttggtgtacgactatactgtggcataaattataatgggtgcccaggaagttgcagtagttgttatagaactgatagtgttgcatactatagcggtaccttttgggaaatgatcaacctagttaactataccttatttccggttgcagttctttattaaacaggtgtatgaacaataggttagcaatgctggcacataccagaatcatgcaagatactaataatactggtgaacttagaattatttcttagtattagtctcttgaatgataatatcctagtccttatgatgaagttgcaggtttgacattatcttctcacctatttcaattttgattcagagacagaaaagacagatcgcttagcactggttgatttcttgagagggcttgttgagtttgatcctaataagcggtggtcaccattgcaggtattcactgatgataacatttgattcctatttggttgtactctttgattgtgaatgggaagtcttattaatcccaatatctgaatatgctggggaatccttgtttcgtagccgttaaataaatgagctttaggcaggtcagtttggtacttaggaaattattaacttgatttcctattgcgctatttttttttcttcttgaataatcaatggaagtacttcacaattatgaacctatttcaggcttcatatcatcccttcataactggtgaagcgtttactggtccatatgagcctatccaggagactccaagaattgtaagtatgatcttgtttccagacaacctgctgtataatttttctctccttagagactgttgatacggaacgaccatcatttgtaacaattgactttggttttgctctgcatttaattgaacgaggtatttagatatcttcctttcacattataacaaacatggatacatgaaacagtgtttcttcccaccaacagactatatattgctatatactactccctctgtcttcaaatacttgtcactaggtactattcatcttcaaactttgacagctcgtcttttttgaaaaaaacaaatacttaaaagtatgtcatattaacgaagtgtgttgcaccctaaatatcacaaaacttttgtgcgtcatgctccaccattcaaaatttgttgtggtcaaaattataattgcactagtcaatggtgacatatctgaaatcagagggagtagacaatgtggagaaaccttaaaatacttgtaccttaagcgctccctttttttcatacaagtagtccgtaagtcatatacttatgtcttgttgtgttgtgccattgtagcctgttggtcgtgttgcagcagttgatcataatcctggaggaggtcactggttagctgctggtctttcccctcaggttgtaagtatgttctcttatgcttttgttaagttggtgagttgtaagataattattatcataatatattgttgattatgtttgtaggttggaagcattaacagaggcctaccatttaataacgcttttgcaccaaagattcccttttcatatggaagcagctgtggcagcttcggtagccatggtagctttaatgacaatgtaggtcttgcaagcagctatggaagctatgatgtcaacagtgtgaacatgtatcattcaccactaggcccttctggattcaatttacattcacaagccggaggaacatttttgggatctagtccagatattagacgacgatcttatctctatcatggtggtggcattcgattaagccctgggtgtccagggcctatgtctcttggggcaagtccatcacaatttactccaccaaattctcagatgcaaatcccaagtactgctacaggaaagtatggttccacttctcctgcaaggagcagtcatggctcattgggaaaagctgctgctgtaggccaatacaatagaagaagaaatcttggtcacccacctatatcaatgccgcctcatgaatacacatctcagctgactcagggacaccatggggatggcaccattagtaatcactttgatggctatgctcgtggcattctggttacccacaaagtgcactccctaatcctggtcatttcagttggagaccacatacatgcgctggcagtggtttatcaacagacacttcgaaccatgggtcctttccaccatctcgatacggtggttttcctcctacgcactcatccaatgtgtcagcagatacactggcttccacctcatcaataccggatccagctgattgggatccaaactataggtaacagtgcatcatacagttttgtctttgtaatgtaacatgtgttgatctttttcactttgttttgatgtgcagcgaagagtcacttctgcaagaggacacttcactatcagatgcgttgagcgatctccacctgaaggatgcaagtggtcaaacaaaccaatccagcagattggcccatatccaaagccatgctattgcaaactcaaactctttatccatgaatcaaaggtacttaagtgttttctaatttgttcatgtaatgacatttggccgacgcataaaaagctaatataatagaggcacccctcatctgatagattgcttacaatccaactacaatgatttgctctctgtatagttcgctcatatctttaggaaaaaaaaagcatacttcacttttcccaccttgtgctgtgctgctggtttctgcttaattattcaccatttttacaaatgctaaaattgtaatgtgctaacaaatggatttgattatatacatatgtaagggtatgattgtcattttggatggcatgtgtacaaagaatcgaaagagctttcatacacgtttattagacgctgtggggtgtaaaatgtaatgcctctcagtgcaacagtttgtttcatgacaataaacatcttaagggataactggataagggaggtgcttcttttacacgaatcttgttttctatgtgttgctttattgagagtaataccactgaaaatattttgaattttcttgggtggtgctatattgtcaggggttccatattgttatatttagtattattaactgatcattgttcatgcttttcctatagaggtgaccgcctgttccatgcatcaactcttacagagagtagtgcctctacaggccatgtgacctatgatggttaccataatgcaaactattctcagctgaattttcaaagtcgccatggacaaccatttcagcggtataaccatatgactgcgagctacctacgtccaatggggaatcatcacaatggtcagcctgtatggcctaattatggcatggcagaacctccacctgctactatggctgacggaatgccttggggtaatatttccatgttgtcatttgtatgttttatttaattgggtgttgttggtatagccattgactctgcaaaagctatcgtagcactagatttactaccatctgtggtcctctttttttatgtggcatggccttctagtccaacttaactaatttttttttgaggtatccaacttaactaaatgtgctactgaaaacttgcaatcttggtattaattttcagaacaatggccttgcagtacacatagtttattggcaaattttgtttaatagtatattgaaacatgtttggtctaggcttgtaattgcacatgggactgcaatggccaaaagaaaaggtgtaaccttcatgcatgagatatgtatgtcctgttgatatagtttgctttccaattggatcttccatttttttttcacgagtgccttatctttattaacctattatagcttaaaagtcatttcaatcggtgcatgcatttggaaaccatagaaggtatgcatatttatgtctgaaacataattctgaatgttgtgcaggaggaaggcctggtcactcttttacagcaggcggactgccgtcttcctttgcaggaaaggattttggaaggattttctagtatggatctggaggaatgccattcaattggttgcattagtagtttgtatttgcaactcttggttgcattgcttacgggctgttgattttgcagtttgttgcattcctctaattgatcccttcgcaatgctccggctcatagaactgtatggtatgggtctgtaattgtagcattctctgttggtttcttcttttcgtttttggtttatttgttatacatcgagcggaggcttctgcctgctgcaaaaacccagcgggaaaaagaagttgagcagcccctactttcagaatgccatgcttttcatgtgacttctgacgatttagacagatcaaatcaaaccagaccagtacaaatgcttcaaaacgttgaagatttgttaaaagcccttgtcgctaggggaaaaaaacaaacgctacaatccgcccagtaataataccgtgtcattaaaaggatcagatcagaccactactgtgtgattgatccaaattaaagacaagatgcttcgctgacacctatttactcccagtaggtacaccgctagatatataaactggcagccttgcaaagcgagagagcgagtgatattttccctcggaggaaaaacatgtgtgtgctccatttatcatgcatctcccctcctctgattgtgcaagtgtggcactgtgttaggaggcatcgggcaagtcgacatctttgtgttcagtattctacctcctgtctccttcagtgccgcacgcctgcaccctagatagagcgaagaatctgaacgtagtctatcgagatcaactagaagaagctccttcacacactccgatcggtgcatgaatcgacgaaatatcatcccctcctcgagctcgtgctgcatccctcgctctgctcatcagcgccgcccgtacgtccgccgtcgttcgtcacgccgacgagggcagaaatggatctggcactcgttgacgtgcagacgtggtgatatgcggtggagatacgggggatctcacgccggagctcttcatcgatggccggcggggacgcgcaacggcggcggcgaggcgccgttgacaggttaacagagcgcagtttggttaggctccactttgatttcgaaaatctcactgaacgtacttgaattttgagctaatttcgagaaaatagcattatccatcccctcaccagataaacttttcgtgtttcgtgttcgtccaatgtcacttcagtaacattaatgtggactttgtcgatgattatcgaagatatggcaaaatattgccgacaaagcgaatcaaatgttggagacacctgtaactactgttggaagctgcatccagcctccaggcatcagatgagctttaagccatcatctgcagttattcctgaaaatcaatggttgcccacggattgccctattgcgagcaataagggtgcatcaaatataacaatgtgatgaatggtagtacgaggtgaggtttctgtaattgctatgcttctgaggggtcgtcgtagattcggttgtggcaggttgaatcgcaagggtaagggcaatcaatcttctgaaacggattgcggtcgtagaaccaatctccaactgcatccgctattgtctacacaagtgtgaagagctcttgtcagatcatcattagatagctggctctagcagtagccggctctagtagtaactttggtttaattttgagttaagtggtgttgaagttgaaggatgtagtattactttggtttcaagcatgggggaaccagatgcaaaccatgtctcctgcgtctcagattggcaatgcacgaagcatgagtttataaacaatcctctggtggagggagtcccttgttccttcagtgctttcagaaaatcgtctctgaatcctgtgatggcatttagaatccatgcaatttttaaactgggtcgatagctggccaactagaaaatgcagtattacataccaatacactatctagtacctaccttgcaagatttgaagttgcgatgcaggacattgatctatatcatgcttacagctatgccatttaccatgagggtctgcaaatcctggcaccaagatgttccttacctgtaacacacgagacctaaattaatgccaaaacatatttttagaaaatggattaaagtctggcctctacatccaaatcggatgtacacagccacaatgccaaaacatatgccactacaaagcatatttatctaagggcaacactaaaaggatcataatcatagaagtattgcagaacgtggatcagatgataacctgccaggaatcatacgctgcgttgagaatgaacaaaggtgtctgaatctgtttcacctcattctgaggaaaaaagcactgcattcaaagcaacatgtttttaacaagtattcaagtgtaatctgttgtctaaattcgtattgtaaaactgcctgaagcttacaccttaccatgcctggggacaatctggaggtgcaagcagaaggtaaattcttcgctgatccctagcacatttgtacaaaatgtatttaggtataggagaaaacaatgcaaatatatgtgaaatagaactttggaaaatgatggtttgcttttcactctgttaaattctgatcctaatttgtaatttacataccaggtaagtttttttttggggggggagggggggggggtgcatgtgtgtagaatccttgactatctactagtataacagagtaatgactgtatgtgcatacatgggttgtagctacgccattgaaaaaggccacaatgtactccactccagcaatatccttcctgctaacacaaagatgggataggtgttagacatgaactcaatgttcagaaatggtgtttttttgttctaagttaatatactaatggtttgtccttcatattaaaatggctagtacatccttaatgtggaaaaaaatacataatgcatttaatttttccttcaactgccttttgtactagtattgtcttactcattgatgaagaaaccagcatcagaaaggcatttaactttggtatccactgggaaaaggtcacgaaatctgtcacagtgtagtatggaagttaaaccaccagcagaacagcccgaaattagagcctgccataaattcgttagtcttgaaaaccttcttgttgtcaagaattatgctcataagaataacatacattattggcactgttcattcctttcgcaagcagatcatccataactgcttgccacaccctagcacctctgtagtgaagctttgttgcctatccatatggaacaaaatcaaagagaaacttaacactggagcagcactaatcctcatacaatttgtaactgtaaaatcaagaaagaatggactatggactcacaggatctactttttccacatcgccggtgaaagatgacccatcacagtaccgaaccttgaccttgttccaattgtagaaatctggttttgatgattgcacaggaatcgatcaagcatgtgaactatactactccctccgtttcatattataagactttctagcattgtccacattcatatatagatgttaatgaatctagaaagtcttacattgtgattcattaacatctatatgaatgtggacaattctagaaagtcttacattgtgaaacggaggaagtagtaagtagtaacattatcttaaaaaaaaagtaagtagtaacatggagcctaggcagtccaattcctgaggtggtagagaactaggacaacatagtacaaaatattatttccttcaaacaactagtgaaatacagtacccgggttgtaatcaggggtgttgctcagtattccagagaaggcaatctgctttgccatctgcttcgatgatcctaaccgagtgcgtttgcgttgcaggcaggtcgtcacattgctgcaccatcctcctccctaacatttgcaagaaagacacagaaaattgagccgggcaaacatttgtagtagagttctaggctccagtagcacaattgcactgctatcctcacaagaactaacctcgaaatgaaccagccaactattcacgccggagccaaaaccccgggcgagatggtaggccggggggctcccatccaaacagactagcacatcacaccacacaccatcgaatgcacattagcacaacgagatactaattcaggaaagagagagagagaaaaagagatactaatacagtatgaatgaacaagtaatgacagagaagcagctgcatccacacctgcgcctttggccacagcgctcgctacgtaagtaatgtccacgaaatcaccatccaccgtgagaaacaccagcgcgcagacaagtgcagagcacgagaggcagacacccccattcgccatcctaacgagagcgcgaaaacgagatacagataaaaccacacgagctgcagaagaacacacataaccaaaccaaccacccaagaactcacccttttgtgccggagatggaacagcgcttaccggatacgccgtctcgatctaatctcgcatgctctttgttcttgccgaggcgaggggacgggacgggacggggggctcaggcaagcgaacagcgcaaaagcttggagctttccatccaagctcggcctttttttttctccaccgcgcctctgccgatgcaaaacgcagagtgggcggcccccgttcggtttccacgccgggccgcgtctcttgtgtgagctcgtgtgtcctctctttttccccttgggtatcatctagtgcgtgcgtacgccaggatctcgtcatcaacgcaacgcctgccattgatgccgcacgttaagacgtgcagtggtggtgaattgaacagtgaacacggggattgaatacagtgccagtgttaggcacatctgcactctgcagaaagtggaagtccagcctccagagcaaatacgggaaaggtttctgcgaggataatggagcagagttcattccgtcaggattggaatggttaatactccgtcatcccatgaaacccaatctaacatgagatgtaacacaacataatataataaatttgaacatactactctatcttaaaaaaataaattctagctacaaatctggatacgcatgtgtccagattcgtagctagaattggactttttttcttgagacgagggtaggtgttatatccagctctagattcgtcttttataggatggaggagtaggatcgagcctaaactattttttctagattcatgatctataatgatcaatccaccacgagatcatgcattatattgataggttatcatagacatccaaatgaatcaactatatattactaatagatcaagtaattttcaatataaaactgggacaaaaattcttaaactcattttcaggctataaaaatttttcaagttcagttaattttcatagaaatgattattatacagagtaatagaccgagagaaaatttactacacgtgcataaaacttggaccaaaaattttaaatcagtgttcataatataaaaacctattaaattcagttcatttttatagaaatgatttattatatagagaagcaaatttgcacaaatttagaccatttatacatgtgaagctgttttagattgaacattttagacataaattttagagtgaacctaaaatttcattagagtaaatttatatatcagtttaatggacaagtggagtcgaaccaaaccattgccatcctcatcatttggtgtaactttcttttttatttttcgaacgaatcatttggtgtaactttctgaaaatgtaaaaatggagaatggtaatcctgtcttgactccttgactcttgaggtacagctgcatctgtgtgagagcatgtactacctcaaaagtttaaccatccgtcttatttgaaaaatttataaaaaaatttaaaaaaatagtcacacataaagtactatttatgttttattatctaataacaataaaaatataaaatagtaatcataaaaaaatttcaaataagacaaatagttaaatgttagacataaatagcgtaaaactgtacttattttaggacggagagagtactaactatcattgttgtgcggccagcaaaagccacggtacccaatggcaatgtcagcatgtgacgagtcgtttctcgagaaggaaaccgatgctacggagtagagtagtatctttttgaactgttgatgaaagcatgtacctcgagtcgaggtaaaataattcatcgctcgccgaatgtctttgccttcaaatggaatgtccgaaggatgtctgtctactagtcttcggtcaaaaggtgagttccattttccatttcccccctagtgttcgtgtgttgtccagcttgaagacggttgctactctcatctcatggcagttggcactgcagagatggaggtcggccggcgtgtgtcgactagagatctggctgtgtctttaacgggttacggcactgcggtttaagtccacattttctcgttgggccggaacggaacgggattgccacgcatgtacggcctgctatacttgggacggaacgggattaccgtctacgtgaggccctttctacttgggcaggccggaacaggattatgatgcaagggcgtcctgtattgtatacttcctccgtctcataaaaaaccaacctaatatcggatgtgatacatcctaatactacgaatctgaacatacattattccagattcatcgtactagaatattcatatctggtcatatattcattttttatgggacggagggagtagctggctagacgagataggtcccaactcgcgccctgtttttttttcccaagaatacgcaaaagagttgtgcatcattgtattaagactttgagagaagcaaattaatacaagattatagcactaggaggctatactcacgataaaagagaaaacacaccacgccacgtgcccacacaccaccacaccctgaggaatacacagccacctctaaaacgacgccttcaataagatcacaacattaaaaatgctgtcatcgctcatcccaaaaggataagattttcacctagaggatccctttgaagagggaagggaggcacctcgacaacgctctcaagaggtacctcgaccactcgcggcctgttttggttggcctggaacttaacgccacgtgtttcggaatgctaggagacgagatcctatctcaagcatccgcattgtatgttgggatcctttataaggtaggcaataagaaatgggtagggcaatctgcatctgttccccgatttcatcccctaactctagcactagcttctttgggagagaagcctccctcactcttggtcccagcgggttctctaccgcttaatttgaccttacacaagagccaataagttgtagtgtttgacggtattttgtgatcttataaatccaaggagtatttgtattatcaagacaagcaaacaaaggagctgctatgatcgtcgcattcgttaatatgtgagactgtatatagcttgctcaattgcatgggatgcatgagccatgcacgtactacatatatatgtccatctatatatggctatatccatgtgtgtgttcagccatatatatacatgcttggctaatctgtacgtatgcatgcatgcacaaggagacttgagtgacatgtgagcagctcatacacgagcgctatatatgtattcaccgtacatgcatgtatacgtatagaaataccgcgtgatttctgagttaagaagcaacagctagctacacgtacggtggaaatgtgaagctgcccgtgggccggcagcccatggccacatttcgttctcatcgtatatatgcgattgtatatcagaatacacgcgtacgcgggatatctcaaccgcaagctactgatgtgcgcggctggcgccggataaacccaagcaacaaactccgccttatccaggtgattcggatgaaagtgatctgcagcaacgtcgccggaggcttcggagcgaaccaacgcgtgtggccccggcggcgctggagtatacgcgcccatccgttaggttttcctagcgcctataaaagccaccgagagccagccagccagaggccatggacaatcaatcaactcccatcgagatcaatctatcaacacacagttctatccatcggcatccatctgtctctgcccagccatcttcaactcatatccatcgacaacacaccggccggcggcgaagcagtatcacgtacgccggtgtccctcgggaggggcagatcgccgagaggcggcatcagcgcacatcatcggcgtccggcgagctggtgtcagtccgatctactaccatagattgatcacggaggggaaaaccatcggcgcgttgctccggcagcctgtagactactcgtcaacatcggcatcaatacacatccattcgtcggcgagtacagctccatccttttgtttgttattgtctttttacagattgatcatggagcacagacaaaggagaagaagccatgatgtggagttggccggtggccggaggacgcgctggccgacgacgccacaccaacgtgtgcgccaccggtggctgccggccggcagcatctgacgctcggcgagggtacatgcagccacccaggagacggcgccaggcgatcggcatccatattcatctactccgatcccatctcatccacagcatatatcaaatagcagagaagcctccagcgcggcgggcgggcgtgcacagcctcaccggcgctcggcccggcagggaggccgaggccaaaggaggagaaagccatctacgtcgtacgcgcacgcgccgacggccagcatccatctaccggcccccacgaagcgaccttccgacggcaagcaacggcgtttgacctcggcagccggcgacctcactgctgcacctcggcgtctaagacaggaagtgtgcgctcggtggccaggttaccacggctgcagcacaccccagcgtccggcgtgaggacgcgcacgccaaggaggagacatgtgccaggaaggagcgaggcgatgtcgttccaatctgttgtcatggccagggagaagtcgggtgtattgccgtcgcccggggtcactgggccagccgatctattcacgtcacccgcaagcctccgtcgagattgacgtcacccgttcaagccactggtagtgtcactaccgtacccaacgctgtgacaccaccaacacccgtccgccagagaagaccatcgtgacgccactccgtcggggcgcgccggagatcgtcggagcagccgcggacgccgccaagtcatgttgatccagaagttcttgtcgagaacgacacagactccgctgagctgcccgcgtccgtgaacaacatatcctcatcacaccggtagccacccacgccatcctgatggagcagccccatcgtcaaccgggaggcatctcgtccaccttatcggcaacgcccagacgctcgccgtccccgtcaagctgctggtgacactgtccgccgagtgccaccccgtcaaagtttgccgttgtgccggcaccatcgcaccgacgccaggctctcaggatgtcggcgttgtgatctctactgtgtgaggacatctcaccgagactccactggccggcgacgccttcacgctcgccgcggtctcttaggtcaccattgatgtctactcaatcatcttcgacggtcctgccattttccttacactcgtcgttgagccgctcgaggagatcgcctgtcggagcgccgctacccggagcccgcacactgtcgtcgtgccgttcggctactacacctctgcttcatcgcgccggacttgtgatgccatccgtccgcgatgactattcttcgccgagtcgctgaggcgctgccaagcagcgctcatctccgtcaactaacaatcatctgccacctgccggagaaggccgttgtgacgccacccagccggagcgtgccgaagatcgcatctacctgatgctacgacgtcgccaagacgtcgagcgtccttactttgctggtcgcaacctatgagaatggcgacaccatcaacatctactcaacctatgcaatgccggagtgccactgctgggtgcccgcacgctgtcgtcaagtccgccggcccatgatcccttcacttcgtcatgccggagcatcatggtttgcagtcatcgcgccgttcgtccgcaatgtcttcacctcgtcaagccggcgtcgtcgtgacgtctcctctccacaccaacatgatatcgtgacgtccgttcgtgatgcgttctcttcattatgccgagatgagatgttgtccgtccatggtgcttttcccctctttgtcaagatctgtgtcgtccgtccgtggcgctttccccctcttgtcaagaatcgatgtcattcgttcgtgattctctccttcttcgtggagattgatgtcgctgttcgtccgtgtattggagtgttgctcatcttcatcaacataaagcaagaatggtgccgtctgtgatgctagggaaccgttcgtgctgaatctacaccaacaatgtcctcggccgttccgccgaagagacatttacttcttccaaggtcgccgtcgttaccggcgcccttatatagccccttttatgggctcgtcatcatatcaactggatcaatagtagatccatcatccgaaggtgctaaagccacgttcatccggctattgtctacattgacttcttcatcaacatcttcattgcaagtccctgttgtataagggacatgacgaaccaagaggtgcccagccatgtgtaatccagctaccgtctacaccaaccgtctttgtcaactcttcgtcactttgatctcacctagccaggaggtgcctagccaccgtatattcggctgttgtgtacaccaactgacttcaccaattcctcttccctttaacatcattccgacgctactactgtgacgtctctaccgtccaagctatgcgagtttcatgcatgttgaagatcaacctatctacaccaccacgtcgctcaagactgatgaggcggagcgacgagggtgggcgaagccgatggaaggctacgctaccaacatcggcgcacggaccgacgaggccgtggatgcgttgccggcgcccacatatatatatccaccatcttcaccaacattcatcatgcatggagaacgtgaagcgaagacgacgagacgaccacaagcaacttaatcggaggttctcctacaggtgtagatctgcggaggtaattaaatgggagtctttcgagaccccaggaaccagaagaccacaccgctgatgtcaagatctgtccaacgacaggcaatggcgcgcgtattttatattatacatggaaactgtatcttgttaattcaattaataaagatcacgtgtttctgtgtctcttttgtgtttattttacattgtgtatctaggtacactggcacgcccgcgcttattttctttctaaacatagaggattatattcgtatttttctatcctaaacatgtagcacaggcaaccatgtgagagatggtgagataaagataaagtaaatgcatgagagcaggcgtgtagcaatggaagaagcaccgttgcggcctgcgggagctcgggaggtggaggtggaggccaccgcatgggagcaaaagccctagagttgcaagtgagcatgagcggatagtgaagttgtgtcgggaggcggatgcacgaggtcgtcttgtgcgtgtgatgcggtcggagaattgagggtacccatcagcgacaattagggaaacatgaggttatggttgcattttgtttcataccgacggtgagtagaatgggggttgaattgggcctaaatgcatacacatgtttttctaatgatttgtgaattatgataagttttttttttggggggggggagggggaggttcatacttttagggcttcacaggtcaatcattgggtgaattctggctacccctaatctcgtcctcagcataggccgtcaaactttcattggcctctgctcacgatgatgtgcgactctatgagaaggatgttgcaaacaaagcgaccactgccttgggcccaacgacgaaaaaaaaccccgccacctctgaccaggcatcgccaccactatccctattgccctctttcgctaggggtaatacaactagagacatacctagattaggggttgttggcggtatggcatgaggcccttcgaccaaaacctgccgaaggctatgcgaggagtggggatccaagcccgagacgtcaaagttagtcggggcgaagccccccccaatggcgaagactatggaacaaggacggcgagaggcgaaggatcgtgcgggtactctgccaagccggaggcctcttgggggaaggatgtagggcgaagagtatatgccgaagggagacgacttcgccaaagcaagcttgcccccgcgagggccgaagaagccttttccggcccatcaagcctaggggccattgggccgacgatcgcctaacggcccatcaggagtccatgaacctctattacactatgtatctatgtaaatgtccctttcataagggtaaccatgtaaattcccctgtataaccaaaaccctagtagtaagaacctgtaataggggctataaatagtctcatagggccatgtaatagggggatctaagaaaaattctctaatcaatacactttactttcaaccactgttgagtaaccacatctttcgacgtatgcagttgtcgtttcgacaacagttggcgtcgaccgtggggacctccgagcaaaaccactgagagcaaacgccaccgaagaatgtcgtaaaggagaaggttacaaggcgaaaggaaagcgacgccggggtggatatggctgccgaagagggagcagagccttcggcgcttatcgccgaagatgggggagcgccatctgcttccgcacctgcgccatcactaccgccttcggcccctgctacctatgtgccatggcgaaggcggctgcggcggcaagggcactccagaccagggcggagatcctttcgacaagccaactgctggtgccccaagccgctccgtcgcagccggcagcggcccaaactgcgctcgccgctgtgcaagcccaagtctaccctgaccccgagacacaaaccgaagccgacatggaagccgtgcgacagaacatgacacgactccaagacatgcttcgccaaatgcaagaatagcagcaagcgtacgaggcggcaaggcggtccaaggtcgcttcggcaccaatcctccagtattcggcaggctatgtcccaccccaagtctatctacaagtgccgacccagccccttccgccacaagtcgcgcaagcgccaatgtacttcgctgggcagccatcgaccgcagcagcgcatccggcccctcacgtgcaactgcaagctcaaccgatcgctgcccaagtacatcctcaacagcctggccaagtgccacaaacaatggcagaaggggcttcggctctgtaggcgcagctccaagctttccttcagcagctcagccaaccccacaacatttcaagtacagcgccttcggcccgcccggaggggaatacaagtcaaggtgcgcctagttgcttgccttcgaatcagccaggtctaggggcttcgccgtggagtcaaggaccgcagttcgactctatcaatgttgccaggcttcggagcaaaccaagcaccaaaccaggtcaccatgacatggtccagccaactttcgacccattcatggcggctcagcaagcatcaccatcggggccgagcagccgaatgccatgg

SEQ ID NO: 69550 - DNA, 8644 bp, Oryza sativa
caagccgtgatttcgcccttcgccacgccgtacccgcagcaaggtgtcgtgaacagcgcagggggcgaaaaggggctaccgctgagtgggggaatcaagacccgtccaatcccaccccagttcaagttccacccgtcccacgctacttaggcgaaactgacccaaaggaattcctctccatttatgaatccgcgatcgaagcggctcatggcgacgaaaataccaaggcaaaggtaatacatctcgccctagacggcatcgcccgctcttggtatttcaatttgccagccaatagcatttacacatgggagcaattgcgcgatgtctttgtccttaactttcgaggcacctatgaggagccgaagacgcagcagcatcaactcgacattcgccagaggccgggggagtcgataagggagtacatgcgtcgcttctcgcaagcccggtgccaagttcaagacataactgaggcataagtcataaacgctgcttcggccggtttactctagggcgaactcacaagaaaaatcgccaacaaggagccgcagacgcttgaacacctacttcgcatcattgacgggttcgcaaggggcgaagaggattccaagcgacggcaagcaatacaagctgagtacgataaggcttctgtcgccactgctcaagcccaacaacaagttcaagttgccaaaccatctcctctcgttgttcgccagccccagccggagatccaagcacaaccgccaaggcaaggtcaagcccccatgacctagaggaagttcagaaccgaccgtgcgggcaaggctgtgatggctgtcgaagaagtgcaagccctccgcaaggagttcaacgatcagcaagcaagcaaccatcagcagcctgtccgcaagaaggtccgaaaagacctctactgcgccttccacggacgctcttcgcacaccacagagcaatgccgaaacattcggcaacgtggcaacgcgcaagatccaaggacgcagcagggagcagcagctgaagcaactcgtgaagtagcttaagaacaagcacccccggccgaacagcgccaatatgcgcaacacagagtgatccaagtgattacaagggccgacccgccgatccaactgtcgaagcgatagaagaagatgcagctgcgaacggtccacaatatcacttcggcaggcgaaggggctccgcagtatctgaaccagcaaatcttttttggcccagaagatgccgcaggagtaatgttcccgcatcaagaacctctggtgatctcagccgagatagctggttttgaggtccggcgaatcctggtcgacggaggaagttcggctgatgtcatctttgccgaagcatatgccaagatggggttgactacccaagcccttaccccagcaccgacatcgctccgaggattcggcggagaagcagttcatgttcttggccaagcacagttgatagtagccttcggcacgggggaaaacagacgcgaagagcaagtattgtttgacgttgtcgacatcccatacaactacaacgccatcttcggccgtgcaaccttgaacaaattcaaagccatttcccatcacaattatctcaagctcaagatgcccggcccggcaggagtgatcgtggttaaggggcttcagccttcggctgcttcaaaaggtgatttggccataatcaacagagcagtgcacaatgtagaggccgaaccgcatgaccgggcgaagcacgcgccaaagcccgcccctcacgacaagatagtcaagatgcagattgatgatgccgaccccacaaagctcgtatcactggggggcgacatgggcgaagaagaagctaagaacatcctagaggtactcaaaaagaacattgatatcttcgcctggggccctgatgaagtgggaggtgtttcggcagatctcatcatgcatcacctggcagtcaagccggatgccaagccaaggaaacagaagctacgcaagatgtccgttgatcgccaggaggcagcaaaagccgaagtccaaaaattgctcaaggcaagggtcattcaagagatcgatcatcttgaatggctggcgaatctagtgctggtgcggaagtcaaatggcaaatggcgcatttttgtcgatttcacatacttaaacaaagcatgtccgaaggatgatttccccttgccacggattaaccagctcgtggattcgacagccggctgcgaactcatgagcttcctagatgcatattccggctatcatcggattcgcatgaacccggccgacatccccaagacagccttcatcacaccgttcggcaccttttgtcacctcaggatgcctttcggtctgaggaatgccggagcaacctttgccaggctgatgtacaaggtcctttacaagcaattggggcgaaatgtggaagcttatgtcgacgacatcgtcgtaaaaagccgcaaggctttcgaccacacgtccgacctacaggagaccttcgacaacttgcgcgcaaagcaagcttggccccgcgagggccgaagaagccttttccggcccaacaagcctaggggccattggaccgacgattgcctaacggcccattaggagtccatgaacctctattacactatgtacccatgtaaatgtccctttcataagggtaaccatgtaaattctcctgtataaccaaaaccctagtagtaagaacctgtaaaaggagctataaatagtctcatagggccatgtaatagggggatccaagaaaaattctctaatcaatacactttactttcaaccactattgagtaaccacgtctttcgacatatgcagttgtcgtttcgacaacaggggtcatgccctagcctacacggcgaggaaagaaagattggatttgacatggttgaagaagacctactcagatttaatcagactcagactgagaatgccaaaaatagctttacgagttcccttggaatatgagatgactagggatatactcctccgtccaaaaatataatgaatttcggacgattgagacactttctaatactatgagtctaagtctgagtctaaaagacttagactgagaatgtcaaaaatagctttacgagttcccttggaatatgagatgactagggatatactcctccatccaaaaatataatgaatttcggacgattgagacactttctaatactatgagtctaaacatgaagcatatctagattcgtagtattagaaaatatcctatccgtttaaaatctcttatatgttagaacggatggagtaaatatctagctccaagagaaagttagatatcgagattcaacctaggacacacaatcccgagatccatcgagtctgagcgaacggctttctccgtgctcccactgttctcccaaatcgtggaatactcgacgagactagcatataggcctatactggttctggtatttttgttgatcggatgaagaacagactggcagacgaatgatgcgtatcaaccaccatgggacgcacccacggtacgcatcccagccttcccaaaagaaaaccgagatctgcacgaatgttgcttatcaaccaccacgggagatcgggaggcatgcacggcacgcattccagccttcccgaaagaaactgaaatctgtacgccgaggacgactaccgctgcacgcaagggcggtgcacaggttcaactcggagattagcacacaaagactagcacacagcaaggcccgtagcacgcgtcaccacgggaagacgcgggtgcaggggaagtacagctcgaatcaaatgcaacccgaggccctgagcccctgagcttcgccatccctgaccggcagctgcaccacggcgcgccggctaaaccaaaacaaattctaacaagcgaggagaaccggacacccgatgttttttcacggaggtatgtacgtcgtgaaacgtcaagcgtcctcgcgtgcacgcacgcgcgcgcgaacgtgatcaattcgcctcatgctggcgtgacgcggaccgaggagcagcggtcagtgtcgcggatcgcgtgcagccgaaggaccaggagatttcgatacgtcgagagtttctcagatctcgtcgagtcgacaatgtggggatgggtccagcgcaggaatcccattcgattgatgacgtggcgccgccagccgatgtgtggacatgaccgagctccagcgccattcagaccggccagccgtaacgacggtgtgtgaatgaagggatagcggagtccgcggccgcggatcgacggactggacggggagttttgagattgcgtcagaaagcgatggaaaacgcatgaaaatccagccatggctgctgcatgtagccgttccgccttgctggccgctgactcctgtcccgtgcgcgttgcacggacgcggacccttgccggtctccccttccacactcgccaacacgtaagcacgtacgacgcgccccctttattaccgccctcgcgccacacgcgagagggaataccgcgccatcgagcgacagctccccggccgtgaaccgggacgagctgctacgcctgctgctgcacacaagctcaagtggccggccgagtcgtccgttcaccgcggcctactgcatctgccggcaaggagctgaaagatgagggctgcggggaagccgacgagcggcggcagcggcacgtcgaggtcgagcaacatccgtggcctactgcaggacttcctggagcagcagcaccggctggacgtgcgacggcaggaggcgctggagaggcacgcgcaggagcgggcggccatcgagcagcaatggagacagtcgatgcaggcgctggagcgggagaggctgatgctcgagcaggcgtggatggagcgagaggagcagaggagggtcagggaagaggcaagggctgagcggagggacgagctcctgaccaccttgctgaacaggctcttgcaggatgatgatttgtagggatgatgtgagatgtctaactcaaacagagaatttaccatgtcttaggatcatagctagatgggaattctttttttctagatttgtgtatgtgaatcttatgttgttccctgttgaattctttctgctaaatattcttttacccgctagaaaccatggaacggataaatgaatgaactgaaaatactgctgacgatggaataagtagtacagttcaaggactatactggtatgggcaaaatttcatgaaggttaaatttaacagagaaaaacaaaggaaaatgaaaatagctagctgatcaaatgtataatacatcattttacatgtacaaagcaaggataacaaaaatgactttcccatctttcttacctaggactgtctagtgcactaatctatcgtggcattgcaagataggtagatcaaccagggctacatgttactaagtaattgcctatcaaagcaagaaatatgcattacaaaattctgaatctctgataagatgtgtagacttgtgcccctttagatataccttcaggttttaataactactgcctgaacattgtattcactcgtctctttctgtatcggacatttgcatatcatcgtcagaatcagtgtcggtatcttgggtaccatcagagcctatgctgctaccttcctgtgttactaaactcgcaaaattgttcaaaacatgaggctctataattctccaaaaagattcagcattgctaccctgaaaacctatccaaaagaatctcccttcctcttcactttacttgttaacgactgtgtgtgcagggagttcacaattctctcaacaccctcgctattcccaccactgagcttaagaacaatatcacctgatgggagtttggagcctccaaacatgaaccaatatgctagaacacgtggagttaaccacctatggataagctttgggagcacaggctgacctttcagaaagaactggtcaacaaagaaactgaaatgctggtgaggtattgttgaaaactgatagggtatcttgctcccatcatcgaatgatctgcttgctgaagacaaccattcaaagaaacgctcatgaatgtgcacccttaaaactgaatgagcattggaatcttcctggaactgaaagtgcacaatatggacccctcgctgtgcataagattccattcgagtgcctcccagaagcaaaccaattaaaatttcacgctgctcttgatccagcttcatgctcacagtttttggtttaataactttcttgttgagaaggagaccactttggagcttttccaaagagtctgcctgtacatcatatttctttttactcatcatatcataaaccttttcggctttctgatagtcttctgcagaaagataacctcttagcataatgttgcacgacttcgtgttagtacctatcatcccattattgtgcatttcaccaaatacctcctcagccttctcgatatttccaacctttactagtgattccagataaatggtgtacaatattctgtttggacggcacctggctatgcattttaagaatgttaattctaacttttcatgcatatccagatccatgtacatgtacatcaagtcaaggaaggctggcatcaaatgcttcatatcactctcaataaattcattcataagttgttccacgatatctacttccagagcttttgtcattatctcaattattttatgatatgatgcaacattaggaggtatatttttatccttcatttccttgaacatatcgagagatttcataggctcaccagtccgggcataagcctccattcggcagacataggcctgaacagggaggtcagaaccactctgaagaatattgtgccacgtggcctctgtttctgcaacattcccttccttggaaaaggccctcatcactgacaccagcacatcaataccctcatcaaagcctgcttgcttcatctccttcctaagagctatgatcctttctctatcaatgacatcctggtagctgtgaagccagatgagcccagcgtagacatccttgtgcacatcaagattggtggtgaccacattatggtacacaaactcagcctgcttgagattgtactttgcagttccccctgtcttactaacaagcgcacggaacaaggagttatgaaggctaaggcgaggcttgtaaccacccatctgtatcatctggttgtagatagtgcatgcctcctcaaggcaacgccctttaggtacactgaggtaagcaacaatcagtatgtggaaggtagactctgcaggcacacggccctgcttgaccatcgcctcaaacacctcccggcatttctcaaccttcccatccctcccaaggcaatctgccaccctggtggctagtgcaaagttgaagcggaaccagtgctgccgtaccatccagctatacacctgaaaacaaccagtgaagtgagcaaggaccatccaacatccatgtctcaacctattgtgtctttgtgttcagaaagtctcttttacaacttgttcccttgggggaaaaaaagtcattttagaacttaagagagaattccttcattccacaaattgaaatagttatgacatattccataatagagtaaagttaaatctttcactccaaaaaatttcaagacaaaatattggacctacaaatgagaaaacaaagaatacagacaaatttatatttttcttgcactcttcacaaacacattggtctttttttttcctcgatacatagattgagctagtagttagtacatgtgggatggtatttagcacatattaacatcaatgttctcaatattttttggaattttttcacgactattagtaacaaagagtggagagcgtgtgaaggcgtgtaaaattccgccccccttgttgcctacaacaaaggcaattcgtcgaacagtacacgagcaagaactgcatgtatgcatgtttagtggggatgctaaaaaggtttagtcgagcgaggtggaagcgcgaagtactgacccggaaggcagcgtcgttgttgcggatgcggaggcaatggacggcgacgtaggtggcgtcgtcctgggtgatccacttgcgctgggcgttgaggatgcgggtgaaggtggagtgcttgtaggcggggagctccttgcagagccaggcgatcctggagcggcgccactgctcgggcagctcctccagctcgggcaccaccagctccggcgacctcaccgcttccctctcgtcggccgccgcccacgcctctccctggaacagcccaaactcggtctcctcgtcctcatcctcctcgtcgtcgtccaaatccaggattagggactccagcgctgacgctaccgctgggattccaggaggcggggacacggcgaggcggccggggagaagcttcgggccggcgagacggagggcgggagaggaggaggagaggcgaaggggtgggagagcgcgagagggcatcgtagcgatggggatggcgcggcgcagggagaggtggtggccatggaggattcgaccgcgtagcaccggaagccttgtcgctcctctatctccagttatcgcagtcggcaggcaccgccgccgcctaatcgtttccggaggctctgcgtgtacagtgtacactgtacacggttctcctctctggtgggcttggtaggatttgggcttttg

SEQ ID NO: 69551 - DNA, 7085 bp, Oryza sativa
aactgcagactgcacaaagtcaagggatctgtttccgattacagtgatgtaccagagcaattctctcttcaaataggacaaatcattaacccgagttgttgacagcttactgtttgttgaaaagatgagagaaatctaacattgttcatatggtaccaaagtagagcagaacacgtagagaaaacgagggctcgacaaaatatggctctagtataatctcactctcacagcttatagactgccaaaatctaacaaaaagaaacatctaaaaaaatctactagcaaagaacacacatctagaaaaaaactcaacctcagacgaccccggtagtttcggatagaacagttgttgaaaagatgagagaaatctacattattcatatgatctcatagtagagcagaaaacatatgaaaaacgagcgctggacttatctgtaaagcatggtacattcagttcagctggaactaacaagttaatttattgttgcattgtaacttctacaatttctcaatggaggacttgaacacaggttcggcttatcctttcacgcatgcttcttgttcttggcataccagttctcgatggtcatgaaccaattaaattggaagcaaattgctgcaaatcgcatgactccagcaccaataatctccaggaatgctgttagcggggaactctgtggggatagaccagcagtagctacagctaacattgctccctcgaaattgcagggtacaataaactttccggatttgatgccatctaaagccttcctagcaacatcatcagctttcatgccaccagatgatcctgctatgatattggtcaactctggcctccttttattctctgcaaccagttaatgaacagactaactgtgtaaggcacttgactatgaaatagtagtactgataaagtttagttgatggaaagagtgaagagtgcctccagaactagagtgccggaaagaattagataaaaaagatactttctcctgtgtacaatgtccaatgcaacttgtaacaatggcaaacacacaagcaatcaaccgaatgagtgagtattttggccctgaattctatttgcatgtgtgacatcatgattttgacaaatatagtatattacgtacaaccaacgaagtggcatcggtttcatcaatgcctgaagtaaaactgcttgtacacgatatattcacagaatcacagtgacataagcctgagaaatttcagtgaatatgaaagtgtgtgcctgtgaaaattaaatagggcaaccaatatattcagagatgcaaatccatcaatttaacatgtatggctcactgctagttcatcaatcgcttaaaagcatcaatggtcagcacataccttcagcgaaacccggtgtctctgtgtcaggagggaagatcaacgagacatgaatgttgtccgcaataacctcatgctgcaaggcctcacccaatccacgaagcgcaaatttgctcgctgagtaagcggtgtacccataaactccaacctacagcaagagcaatcatgtcagcaaaacctcatctccccaccatgaggcattacatcgaacacctgggctgcgacatgagcataacagcctgaatttgcttgtacggtgtacctggccggcctgtgaggacatgatggcgatggacgccgggaggcgcgtctcctttgtgcgttccttcatggcggggagcgccgccttgacgaggtggaaggtgcccatgaggttgatgtccaccatccacttgacctcctccatctcctgcttctccagctcctgcgggacgaacacgccgtggttgcagacgaggacgtcgacggggcccgcctcggcgagcgcgcgcgccacggcgtcggcgtcccgcacgtcggcggcgtggaccccgacgtcccgccccgtggcggcccggatggcgccgcgcgcctcctccagccttgcggcgttccgggccaggatggacacccgcgccccctccctcgccgccgccgtggccatggcgagcccgatgccgctggaccccccggtgatgagcacgtgccggcccttgagcgggatccgcgccgccctaggccgcgccaggaacgctagcgccgcgaggagcccgatgggcggcaccaggatgaggagcgagaggagcgcggcggccatggcgagcgaggtcgagctttgcgagtggtggctggtgggaggaaggggagcgaggcggagggggtggtttaaagtgggcgaggccgccgtcggagtggacccaggttgtactagttgtacaagggtggagacgtgaggagcttcgtggaggccgaggctgcgcggcccggcgggaacggcagatctgaccgaggacgaggtgcgggatgacttggtggagagtccgtggccgtgaccaatgagccggtcaggtttgccacatgggacactatgttgcaaggtgtgtgtgtgtgtgttttctcgcagtacatagctgaattcaaacaagaacagctaaaaagaaatcgacggtatgacgttctttgattagtcatttaattacaactattttggaacgatgtggctcgcaagttttctttttgttggcaagttcttgtgtgttaaaaataccaatcattgatcaacggaaaaaaaaacatatgagtacacttcgagcactacaagaaaacgccacgccggccattatggaacaggagagagggataattgaactcatttttttagtacatgaaatacgcatatactaactccatatatctagatctacaattacattagagtaaagtccatcaccgtctaaacttgtaccgttgtatcatcccgattcctaaactcgcaaatcgaccgttcaagtcctcaaacttgttcgagtgtgtcatcccggcccttaaacttgcagatcactcatttaggtcatccaacttgttaagttgtgtcaccccggtctctaaacttagatttgaatatcatctgagtcaaataggacggactaaagactttatatttaaaaataattcataactttttcatgtgaactctaatggagaaaaactttatatcaaacttgtagctcttgacgcgatctacaactttgtagttgaattttttttattgcaagtcattttttgtcccaaaatgtaattttaaaattaaaatttcaaaatctataaacatgcaacaatattttgggaccctaaacagttttaattcaaaaacttttcaactacaaagtcgtaggtcgcgtcgagggctacaattttaatataaagtttgtcttcattagagttcacatgaaatttttgatataaagtttttagaccgtcctgtttagggaccggggtgacacaactgaacaagttggaagacctaaacgagtgatctgcatgtttagggatcgggatgacacagtcgaacaagtttgaggacctgaacggtcgatttgcgagtttagggaccgggatgacacagcggtacaagtttagggaccggtgatgaactttactcattacattaacgacacttgaatgtaattgtgttcctattttagatgaaatataaaattctaaatcactataattgaacttaagaacttcatattcagtttgaatctagatgtggagctatgtcaaatgggacctacgaatgtgccctttaaaacacgtcaaaaaaataaagaaaataataaactcttttatatcattgtattaaaagacatctgccaataggtaatactatagtctaccctataatccaccaacaacagtcctacatactacatacttcatccttcatggaacggtcaggatctttcctcgttagatccaacgatcgatacccaccgtgctcccactctccggacaaccgcccacccgcgcccacccctatcgcgatctcctccccatcccccgtcgctcctctccctcccctgatcgcgcccctcgctctcacggtctcacttctccgccgccgccgccgccaaaatcaacgccaccaaatccagcgacgcctgcctcgctgatctcctccgcagtcgctgccgatctgcactactgctcttctcccgatctccatgccgccacaaacctgcgcccccgaaggcctcgccgatctcatccgcggtcgaccggcgccgccacccgcatcgccgatcaactccgcgcctccacttcgaggaccacatcaccgccatcatccttgacttctccgcccgatctcctctggattgccaccgactgtcaagcctcgacctccgttcatcgtccacatccacaccgcaactcgcattcctagaggctatccaccagcagccagacacttcgacttcaggttgggatcactgtattatctattgcattttgaatcatcgagggtgaaacttggtacatttatgttgaacacatgatagatagcggttcccatgctcaccatcatttttaatgaaactaaaaataaaccgaagtagcctcttgttatgtggttctcagtacataattgctattgggagatatatattttataaagactgagatgagaggtagatttcttgaaatgttctgtatgtataaagatgtcaatgaggtaatttttttcaaaataggaaaataaaagtgaatttgggtgaaagtatggactgaaaaatagaaaaatggaagctttactaaaaatggcagattcgttccatatgtaaacttttttatttaactacaactagccaacactatactgattgaacattatttcctaacattgcacgcttatatgtggttaaactagccagcactataatgatccgtgtctcttcgcccttccgcgcgcccgcacgtctttcaccgcccttccaccagatccctcccccactaccgccgccatcgatcctccccgttgcccacgccgtcctccaccagctccctccccaccgccgtcgccaccgaccttgccgtccctggctgccagatccctcccttccctcccccatttttttgatcaacatcatttttttaaagaacaatatttagaattttggaattttgtggactggatagtgaagagtcgatggtatgcattctaatgtattgaaactatctgtcagacaaatactaaaaaataggatgacatgtcagcttataaattccataagaacaatttgtgctgctttactcgtgataataaatcatataatctatagaaacttgtaatcttataaaataacttatatgacttgctggaccatttgtatgattgggcatgctgatcctttcccaagcatattattatcgtcagacatccaaattttgccatgcacatgattgatagctctacctggtgcttgacgttcatatgtacttttggtaaaggaaatttgtgtgctgatttttagctttggttgtttaacccttgacaaaccactgcatgatcaggtctttcattaagcttgactcgaatcagagtagaattgtgtttcccaacttggttctgtcactttcagaaaaagaaaaagacagttctgtctatttgcctgaatggtttatttttactgattctccccttttggattaaatacaagtcaacctgttcctatacatcatttttagccatgtgagaaaatgctctcctttgtgaatcattcaaagttaatgcaggtaacagtttctacacctccaaaattagagcaatattggcagatattagatcaatgaacactataggcgagttgcaaagtgcatagtacacttgtttgttttaaattcaaatagaactggttggatgaagctactaatgaaccctttcatgtttttatagggttccatatcatatactccggacttggcatccaatcgtcaccgcccacgatctcatgcacctcaccgctgccgccgcccgcgataaggttgagtttttacctctaacagattctttcctgattttgtgttatgatataataattttaaatgtgacatggtgtgtgtatgcgatggatttcatatgagaattaaatagattctttcacaaaagaatatcattttcttactctgttaagcaacctcaaatagaaacattactgaaataaattgacagattcgatccatagctaaaatttccttctctacttttagtgatcgggtgtaaactgttgggatttagttctacaaatgctattcttttccctttatctgatcagcaatgtaagccaaacttatccattgaggttatggagtatgggatttggctaatcacacaatacaaagacgtgccatctgaatatgtgttaattctcaagccaacaactgatgaaactcgtgcaaccaagttgtaaatccttccatggatctgaatctaggactctaaaagctcccaagctttaagatttgagcttccgtgcagaggcagtggaggccgagggtgccgccatccacagccgacaacgcgacgccgctgccgcctcaagagctaccactgctgaaaggtacaagaccccttccccacccctaccccatccctaatatgtctcctctttcccgtaagtatccctgccgtcgatcttttgtaaaaacatcatttatgctcaatatattcaatgtaaattgtgctagaaattgggaatcctcgatgagaatttctgtatatctacacccatggcccatcagtccttatgtttacaacattaatatatcacagtttttacctttcatgataaaatataagttattcagattaactccttttgcaaataagattgttaacattttgattatcctgttcaggtgagccactttttttcatactgtatcggtattgctctaccgctaatcattgacttgataactgatttgtatactgtataacttcttctttttatttgcaaccgagtcccaactttaaagttgacagtgaaatggatctggttgggcttgtattgttataagtataaaggttatattatgctttgttatttgtagtgatacattcaattgatgtataacatttctatatacagtatgaaaccacaattatgaattggatgaatctcaggtttgtttatattttatcagctaggtatggatccaaatgcttcagccaatggggggcg

SEQ ID NO: 69552 - DNA, 986 bp, Oryza sativa
aaatttggtgaagaaggtgtgacaaatgatgctataatgcaaaatttgacacagactgaattgttagtgaaagagaagaaagatgaaaagaatagaaaactgcgtgaatggcgagcaaagaggaaggctcagtctaattctgttgatggtggaggagcatcagccactgtcatgcagaatttgacgcatgctcagttgttagctaaagaaaagagagagaagagcagaaagcaatgtgaatggcacgagaaaagcgcaaagaggaaggcagagtcaaacaatgttccagatgaagtaacatcatacaaaacaattcatacaccgacctcttgccactcgcaagtgactgaaagtcaaaaggtcaatcattctaaaatgttgagcatagacaaaaagagtgaaaatgagatgtcgagtatagacaagaggagggaacagaagacgaaatatcagcgtgaatggcgtgcacgaaagaaggctaagttgaacaatgttgacggctggagtgctacatcaagcacccctgctattggtaagattaatgccttccgctaatttctccgtctttaatccaatattctgatattgttttgatatctaaggtgctttctccaccattaatgaaggatcgctttatggaacagtatgttccaccattctaaatgatgcgcaggtggccgacaaggagaatcatgatccagatgatccaaatgattggttacacagaaatgatgtctacaaacctcgattcaatgtaagaaaagcttcaaaccttgaacagacaggagccggtttagtcataggtgagaacattagatacaagtatgtgcattgctctctatttatagtgttaaccaatattaatccaaacatatacgttgtaaccaatggagttacacaaagtcaaactatacagaaaccaattgttcatcatgccattccacaaaccaactacgtcgaattcgatagtgcattattcgagcctg

SEQ ID NO: 69553 - DNA, 19912 bp, Oryza sativa
tacaaaattgaacattgacaatgaaagcaaacaaagataagaaatatttacttgtgtaattcaactctagtgagatgtcctcaaccggccagtcttgtttcttcccgaactttcgcatgacacggtgcggaaggtggtactcaactgcccaaaaacaaatcaatgggcactggtacatgaagtagtcagagtctcgattgcacatcgagttcagggtcaggcttgaagcctcatttgtatgtatggtaaccactcaatctgcaaaagttgaagagatgtcgttggttagtatatcaattaaagaagtaaatgtctaactagaagtgatattggaagtatttacatgttgaggctgtaagcagtccatctcattgacatgatgcttgtatgccacatcccggtgagcatgtgcagtggtagtactctcaaaaaggtaggccactgtcttctccatgtctggctcattgtaggggcaaggagtaaagctttgcctccacttaggccttccaaccggtagtcttaaccacatccacagctgaatcaatagcacacaaccactcatgttggatgatcgtgcctgacgacaacaggcctcacagagctgtctatatgtccacgccaacactgctgagccccaactaaaatggcccagatcaccaaggttggcgaccaaaggaatccatatcaccgaagcaatgtcacctccagcatcaggaaacagaacccctcccaacaagtgcaagatgtatgcacgggcataacactcaacacgccatggctcagcgtcgtcgtcaagatgtgagaagttctgactcagccaagacaggggtattccattctgcttcttcttgcccccttgcccctgctcaatgttcagtggaatgccaaacagctgctccacttgtgcacgccatccaggattctctgtcctgcccgtcacggcatgcccccgtaatggacggtcatcatcagagtcttcagcaaattcaacatcatattgctcaacacttgcctcctcgtcaacctcctctctattgacttctactgagacagaatcgtgaccaccactcaattcgacatcaaagtaatcatctggattcacatattggcctgctacttccgtcgggtattcagggttgcctccgtacgacaaccaatgaacactctccgacaaatgttcacttagatcaagccccttttgtactaactcccttttcatctccctcgctgcatccatatcatcagtaccgcaatgtctctttgatgatcctgcctcccctaaatcatttccaagcaaaggtctcttcttatctccttccccctccaagtcttctcgtaccaactcagtcttacttgcacccccttcacgatgagaagaatatgtcacaaaattcttctcaacgtaatgataagaaggagatttgtttagattcaaattttctacggtacgtaccaactttgatgcaaacacctctagagatctaaactgagactcttttaccaaatcaaagtaaacttcccattccaactgacctatgacatttaatatatacttatgcccttgaccaacatcgtatctcccataaaaacgaatctccacattatcctcggtccatccaagaacttctttcactcgtgaccttagttcatctagagttgggtgggtgggaaacaaaatggtcttcaatgacatatcctaaaactcaacatgtgcaccaacataaggttccaccactctaccaccgtagtaaacacgaacaagtctatccatctacaccaaaaaatcaaatgtaactttgcaacaaaaattaaatattcatttataaacgtagtccaaaccgacatattataaccaatgcataacttaatttgtcccaaagctactactccaaaaaaaatatttaatccacctacaactatcaacaagtttactagtgcattatacatcgaaatattacaaatactccgtcatacaacccaacctagttctaattaactataatcaatttctataatgcaaccaaaattttctccccttcatataattaattgttaaaagtttaacctataggctatagcatcaagtccatcaaattaaaattactttcatgcctcaaccctaatttttcatccatccatccaaccaaacaatccaaaaattaacattaccacatatatggttaaaaaaatcgtgacaccaatgcgtacattgcaaacatgtagcactacaacaagtaaatcccaagaacaaatgctaaaaatcacaaatttgggcataaaaggggttctagggttacccttcgatctacaaattcaaccaataaaaacgaaaaaaaagaggggggaatggaggagtctacctttctcttcaatttccacaaaaaatcctgcgaaaaatgagttcaaatggagtggatttgatgtggggaggtgagggggagagagagggggagagctgctgctgctcagctcgggctggtgcttgggcgaaaatgggagtggggaggagaaaggtggtgggacccacagggtttaaggggtcggcccacagagaaggggcgcgccagccatgttggcgccgtggtatgaggggtggcgccagtgtggctggcgcccatattctgaccagtcagcacctccacgacagccctagtgccacggtggcacgggcacggcgccagtgtgggtggcaccaccatgttggggtacggcgccagccactctggcgccccaaaaaggaccatttccggtttaagttttcccaggggtttatttgtaaaataagttttcaaaaaggaccaaaatgtaaaaatttcaggtgctcccgctgtaaacttttttaagatacatttcgtttagagaaaaggtcaaactttatggatcttgtcaacgattagtcaaactacaaatacttttagtgaaatagattcatatttcaaagtattttttataaatgttactaatattttctatcaaaaaccaatggttaaagtgtgatgttgaagactttttccaaataaaatgttgcatataaatatctatgcatggaggcagtactcttatgtatggcatgcatgctttttaaaaacaaaataaatcaaaccacatagaatttcatcaacaattagttaagttacaactttgtttagtgtataaaaaaatatgctgctacattcgtactataaagtattttgccaccttattgtctttgtaccctgtttattatgtgaaaaatcaatggccaaaccgtgcccaaacagagagaggtactacaatggatgagtatatgtatatcaactaaaaccaaaccagagagagaatactgcctctacatttttattcattagctagctagtggagtagcacgcctaagataggcgctgtaatcgcttcttcttcatttacattagagataatccattgtatgccactgagtttgtcataggtctacaatttgccactgactttatcacgttctataatatgccatcgatttttgcttaacttctacgatttaccaccgccatccggttagtctccgttagtactgtacactttcatccaaatgaccaaaatacccctgagacaaaaactttcaaattttggataaaaaatctgaaatgtcagacttaagtttttggacaaattttgaatgtttacaatcttatgtttataatatggcatttcagaatttttgtccacattttggaagttttatcccaggggtattttggtcatttggacaaaattgtacagtactaacggagactaactggacggcgatggtaaatcatagaagttaagtaaaagtcgatggtatattatagaacgtgacaaagtcagtggcaaatcgtagagctatgacaaactcagtggcatataatggattgtctctttacattaccttcgggcattaacttttcttttccttttgttggtgtgcacttttctactgtgaatgtgaataacattatatacataatttaccttccgcaaagtacatctcaaagaggctgcctctatgtcacttaataaaaaggaacgaaccatatggtaggatcaataattaatgcaagatgtgtggaagtggaaaggttcacttccatcctatgacacaaacttcacgccacgtaagaaacatggttagcaactactcatgcgctgccatctataaaattactatatgtaactctcatgcgacaacaacataactaaatagcgtgttcctaaaaacacccggtgtagccatttgtcctccatttaaccaatacgttcgctgcaattttcactttcttgtcacattcttcctcccactcgttttctccggtgtgtacacccatttttttcacagtattataccagaagtactgcattaacactaagctcttacctttcagcacatgcaaccatcaaccatgggtgatactatattgcaagtgcatgcacacggttgacaacccgtaactctagtctctagtacggcactagcacatgggattaggcaaaacggggagctcgtcaagcctctcctggctgaccagtgctgacgtgtcagcccgggaatggctaggaaaggaagagattatattagccagtagcagaagagcagagaatctagcggccaatcagcagcagcgtctcctccccccctgcatgcatgacgcgcacacgaacactgaaagtccgaaacatacttgtagtaaaaggcacatttccagatggatcatcggtggacgcgcgcgcgcacgcagtgactaaaaaaatgggcaggcaaaggccaaattgcaagccgacccggccgggcgcgcgctatcgcacgcagctgcctcctgcctgtcactgattgggctcagttcactcaccaataccacatcggtgtccatccatgaattccatcgatgggcaactgaataatgccgggctcgtgaccgcttgcctgcctgcccggctggctgaataattggcacagaggatagggttccatctgtctcgccattagagggagaggagacttcggcctccgctttcctggaaacttcgctttcgctctgttcctctgcatctctctttggctctttgcacctctgtttttttaagcgtctctctgtttttttttaagtatgcttgtttccatctccaaaagtcaatcactcgactcggtcaccaaccctgtaccgctgtacgtactacggcgcttccaaagttcatcccaagaaaattgtcaacaccatgtttaatttgagattcggtgggcgaatcgatagggaaacagatcctctcacattgtcatatcagtgtcacaactgtaaactgcacaaagttaggggagtctaatccaatcgatagggatagaattatggtatcatccaaacttcatcgttgtttcactagaaaagctcagtttcaacttgattaagttagttcatataagcatgggagattggatgaaaacaggataagtattttccacatacccatccactcacccgacctgaaacgtggggatgatattagagagaaaaatagatatgtggtactattatctaaacaacaaatatgaaataggatacgagttactgagtgatagattattgactctatccatactttctaactccgaaagaaaatatgggctaagatacggaaatacgatgagctgacgtaccaaacttgatttcaccccttggcagctaacatggtaaacggataagtaggtgagtttaagtgtaaaccatttttgatacctctataaatcaactggaacttctatcaagggaaccaaattgcatgtgttcgtccgaggtgaaaaatacttatcctgttctcatccaatctcccatgcgtatatgattgtatagcaacacgaatacacgatggaagaatttcataactccattaaccacattttatttgaattctatgtgatgccaacattatatttgttgtttcaattccctagggtgttgttccacgcgaccttggcctaattcatcgacgcttgaccaatgccaccgtgcccaatgggagcaacattacccgctacaatcttagtagttgttggccattatggttgtttttaacaaaatgaaatattttgaagggttaaaccatcatagtgcatttgggttgttttggagccaacatttagaccaagagtaacaatttgatttcaatcatctcctaattccatattcattttttttataaaaagaatcaagaacatgccattggcatccaaagttagcttctagaaccttaagattggagatggatcacagacgtggtacaaagagctagcccttccagtgctagagaggcaacagatagttttagtttagttttaaaagaactcatcatccacaatatgcatcattccatcagtttgactcgggtagtatcctatcccaaagtccaaccgatatttttatggatcacgctgcagattagaattagtttattggaagcatgcatgcatgcttacacacaagaagtgatcgaaaaaatcgcttgctcaactgcaatatagggtgctgggtagcaattcctgtgtgcgcgtgtatagggacaattcaatacttttctcaagaaggtcattttctcttgagttggacgaaacggtacagaggagtcgctctcccgtggcctggcttagcccgcgggggatcacgacgttcttcccttttgactctggcgatcgatgaatcgatccatccgtccatcatcgctcgcctcgattattcgacctatagctgcatctgcatgccagcctgctttcaggcgggcaacctagcttacatcccaatcagggcctcttcatcctccctgtattttctccccaatttctcttctcttctctactcttctcctatagttgttggccaaaaaaaaaactaagcaaaaaaggataaaaaatggttggttttacaattaagggccacttctttgtggcgctccctagctcagatgtctacgtagtgtttggtttttttcatcaactcctctgctcctcctctcgattgccaaccgtggtcctagctgaagaatctgtacaaggactctgatgatccgtgctaatacggaatccaccgttcggtctcccgctcccactgcggcgccaacaggtgtccccccggacggtgaccgccgcgaaaatggactcgcgcgcgctgcgtggcgccgctgcccgccgttgatgttggttttgccagctttccccagcttagctgatgctagtattcttcttcttctttttgtctccctgttcggttttcactcctgctcggtgttcttgcgggtgaagctcatggggaggccgttgagcggcagcgcgaaggggccgaactggacgccgctctcggacttggacgtggaccacctgtacttggttgcgaggtggtggaagagcacgagcatctccagcttggcgagctcgttgcccgggcacgagtgggtcccgttcccgaacggcatgaacgtgttgggcttgggcgccacctgcaacagtgacgggacggacgcggggtcaggaaaacccataccggccactgctcgcaaaccgcggaccgacttggctaggaagtcggccgcaccgggaaaggaaagggagggaagggaacaaaaacacggaagagtgggttcgtgatgctgacctcgaaccgggacgggtcgaacttttccgggcaggggaagtggtcggggttgtggtggatgttgcggaacagaggtagcactttccagcccttggggatcaggtaccctgcacagagcagacgatcgaacgaggttagattctgggacgactgatcgagttagtctatttcagttaaggaaccagtctgccccattcggtccagttcactcgcagcggaagagaagcgcgaggctgtctcgaaagggacggacaggctgccaccggacagctctgctctgctgctcaccttggtattccacgtcctccacggcctccctgaaggtgaaggagaggatggacgccaccctcatcgtctcctggatgacccggctcgtcatcttcatccgccgcgtgtccgcccatgacagcggctcgcccgacgcctctttctccttggcaatctgcagctgctcttcctgttccatccatggcacccgcggtcagcctcaccatcaaggactttgatatactatgagatatgaggaggcgaacttacggtgacggccttgaggacggcggggtggtcgccgaggaacttgaccatccaggtgaggacgctggcggtggtgtcgcgggcggcgaagatgacgccgatgacgttgtcggcgatctgggcgtcggtgagggcctcgcggccgtccacgaacgaccctagcaggtcgttcccccgctgccgctcgcgccgggcagagatgatgtgggccacaatggcgcccagcctcttccgggccttcatggccttgtggaacagggtgcccggcaggttcaccggcatcgagttgtaccccttctccagcgtcaggtagcactgcttcagctcctcgatgtagcgcatctcctcctccccgaagatggacagcaatgccacattcagcgcgtactgttgtatatgccatcaacaacaaacacatcggatcgatcagcaaagcagagtagagcagagcaaagcagagtgggaagaggagttaggcagtaagaactcacagtcttcatctcttggaaggtgttgacgaactggccgtcccaggagtggagggagcggagcgcgatggcctcgatggccgggacggaggcgcggatggactcgggggagaaggcgcgggagacgatgcggcggaggtgggcgtggtagtcgccctgctggaagaagatggcctggggacccagcatccgctccttgctcgccgggaaggtgggcttgaagaggtgcgcctgcgtcaccagcacgaaccgcgccgcctccgggctggacaccatcacgcaggggcatcccaggatgtgcgtcttgaagatgggaccgtacttgttccgcttcttgttgaagaacacgttggggttcttggacgagtacagctggaacgtctccccgacgtacggccaccccatcgaccccggcggcagcggcaggccgcacgccgccgcttccgacgagcccgcctgccggcggcggccgcggacggcgcagacaagcaagaaaggcgcgagcacgcacacgaacagaagaaaagcacccattggcgcctgctcacttcacttatctttgtcaatcgcagaggagtaggaggagaaggaagaagaagaggaagagaaagggaaatgggcggtggtgttgttggggggggtgtggagggaaaggcgagaggggtggcagctatttatagattggccgcgagctgagtttcccggtttctcctccgtttcgctctccttttctgcggccgcttgctgcccaaaaatctactactactagtagctagcaccaccactacgcgctagaatagccgagctgggtgcctccgcgcgcgagagagacagatagacgctgccgaataattgcgcaatcaatacggaaataaagggaaaaaggcgtgcgggcgagagagccggattaatcaactgatcggttaaaccggttaaccaatacagtgatagctaaatgggcctctcttctcttctggccagcgcgcgagagaatcatccctttctccagctcacctctccctttccgccctgtttccacaccatcagctactgtacgcgctctcgtacgtactacgtactgccccggcagcagctgctgctgctcctgctcctgctcctgctcctataatgctgctctcctttggccgcttcctctgatcatccccaaccagccatcatactggcctgaacactgttctgcttaattacttggtgtccggtgcggcggtgttttttttttctttttgtcggtaaacacatctaccgattgttcctgagtccatcgtaagatactcattttatgatttattgatgcgtgaataatctattttttcgaagtaaacatcacttgggaatttttgccggtatcactgaccgcggctagctaaagcaggttgcaaagtaggaatgcgtgccgaaatgcttaacctgctcatgatgggaatgacaggtgttgaacaaaccgttagtccgtcgcgaaatggtcgtgcgcatgcagctctacccctctttttttcttctgagaaaaataaaagcatatttttttctcttttctctcttttttgattcgggcaaaaaaagatcggatggtagcagttctagtagtaggttaacatcttaatcagaaattcaaaggcatgtgcattcagatctacaggttgacctttgcatgtgatgggacagctgtgagggtgtgcttcaattcatctcttattcatcaaatccaaattcagtcgttcaactcatcccgtcaaaaaatctttcaactcgaaactgaatactactagtatatgtgtattagggaaggacgctgaggaggtgtagtagtagtctactgtggaaactattagtaacaaaatatctgccatggtttctggacacgtggaccattgaaaataccctcttgttcggttgttcctaatctcttcctgactccatgcaagcaaaaggacaagtggcacggaaccatcatttgcgttcattcttaatccaacgtatcctcatcgctatgagcaaatgtaaaagaggctctatattagtatacaatataatgtaaaaggagtggcaggcatttcgtaatatagtctaacagttgtgatgctgaatctgaatctcacacaactttcgaatgagctgcgttataaacgtatactcaacctatttcttcatcggtcatcgcagatgaggccattgccttctagacgtttgcaacgcgccatgctgccggcaggggaggatattgatcgcttgttctcgttcaattatgacggcattatcagtgtaccggcccaagctaccaacaggctacatgtatgtgtgtacaaactcatgcttcacgtaagagaacaaatgaaacttggcctttgatcagtagtagtagcattctgtgaaacgaatatgcaatgcacaatattaaaatgttatagtgcgatttgacaggatattttctcgcaggcaaaggacaattacgtacatgcatggggggctaccctttgtgaattatgcattctgttccgtcctgtagtgtggtagctaccagtccatctttgtatctaaacaagtttatctatgaggaatatgagacccggtggtcaggtcccacgggggcaggagcccaatttggatcgggaagtggctgaagcacagcatgagtgtgcgattcggatagattcttgggggaccaaactgtccgtggtggtatcctagttgcacatacatgcagtgccatttcgtctcaggatatgcacggcggcggatgccgctagaaagcctgcaaggtttgcaggttgatgggcggaactacgtgcgagagagccgcacggtgctggcacggcgccgtccagggcacgcgggcagggaatttgcacgtagcaccccaccgcggcgcgcgcgcgggcgcggcggtcacgaatcacatgcgagcgcggggcggctacgttgcgatctaactttggagtcaaggcctcaagggcgccaaaatgcgtgctttgtccgggctcttgcctgcggtgtgcagggcgcggacgagagccgttgatagtcaaatagcctcatcatagccgcccagagccaatcaaccgccgcggcgcgcgcgcgaccggtcgtctcggcgccgtccttactccacgacaaccgccgtgggatcatcaatggctcctggccgcttcgtgcggtcgcgggacacctgtgcgcgtttcgatcacctcctgatgagacgatgcggcgcgcttcggtgtttgtcctggtcgacgagaggtggaaccacgcatctgatctgataggggatgcacgatagtacgtcgtcgtagtagacgtagcgcggaagcggtcccgggccgggaggcgcgcgcgtctgtggtcgcagtgagctagcccacggcacccagcaaagcgggctctagctaaaggaaatatcgggggccggagctcgcggaggcgtcgttgtggcgccggatcgacgcgcgggccacgttacggcggccgcaggacatacgtgtcttcaatgattgcgcggatgttcatatgtgcatatccgcgcgcccggtcgcagctctaccgctccttgaccgatcgatctcttccgttccgtgccgtgcggcgccgctccgcgcgcggtcgagccgccccgcgcgcccacatgcgactgcgtagtacagttagccttccccgttttggcacgtttcgatcagcacggacgatttgctcgctgctaacttgggtaacacgcagatcgatcgtccaccgacgggatatgatggagtcgaagcgtagcagtgtgcgcgtgcaataggccaggcgttttgcgtgcgatgtcgcgcgtgtccagctgggcgagcaataaaatagcccgatcaatcaaacacgagccggcaggcgtggcagcgacaatgtcactccggcggcggagggggcccggggacggcactgatcgataaggctggtgatgctggtggacgagtcggcgcccgcgacgtggccggcaggcgggcgcgcagcggccacccgacgctagctggccggtggaatactagtatttgagatcgtcgtgctggtcaggaaatactagtatttgagatcgccgtacgtgtcttccaacagcgagcgcatgcttgaatgaatacgtcggtactactcggcattcggcaaggaaacgattgaggaactatgtgtctgtttgaagagatttgttctggtccagcaaaattattttaaggtaccggtacctcacggtaccaaatcgtttccgatcgttggattagctagacaggataagcatggttagattcaacaattgaaaataatttttttggtaccatgaggtatgatacttcgagataccttttattggaccggagcaaatctactggttaaaatgagacgatgcatacttatgggtataagatctaaagatctaatatctgttgacactaaaccgatatttgtcagtaactctcacaatatttgacgtgttgagtagttgttgatatcgacaatatttttttaacgaacaacaatagtgtgttgttttatattgatatagcataccaataatactttcatgtcacccggtgtgccgaaatccttatttccactaagttagaggaaaactcattgtccgaagcatgattttctcatgcatcttgcaaactaaaaaagtttaaaagatagagaggcagcaagggccacaattatgacatttactctaatcaaaagactaaagatttcaatcccacaaagctatcacatccaaaacttaggtttagttctggagacagtttgacttgaattttagtggcacgtaaaatcaaatactccatccgtcccattttaagtgcagttatgattttccacgtttaaattagatcgtccatcttatttaattttttttaaaaaaaaattaaaaacataagtcacgaataaagtattattcatgttttatcatctcataactacaaaaatattaattataaaaaaattcaaataaaacggactatcaaagttggacacggaaactcatgattgcacttaaaatgagacggagggagtaagtgattagcaaataatgaattgaatactaattattataggtgtcaaaatagatttacttgattcttttaaataaaattatacataaacttatgcacgaaatttagtagtttggtaaacgttcatgacagggatttttttttcagcccaacctccctcgagagcccagcatagtgtaagtagcattgttctaagtaactttaaacggcgacccatttgttgcacttgtgacaagaggccggttagttcctgcagtacattgtactcttatttgtttcaatttaaaactcgcccacacgcattagaattttcatcaaaggaaattgcagtggttaaattgcccctgcaagtcggcactagactctgaattttacgtcccccgtcacctcatttacacccggtctctgctgggaccaggtcttcgtacaggtctatgtagacaatatcacaatataccatggaaaggtacatgttgatgttggaagaagcaggtcgttacgagtgtcagttagtgccgttgcattatttgtctgcataagacgatcgaaaggtctcctggatatctagaatctttgtttcgctaaactttagttgggtgtgtacaagcactacagcgacttccattcatgtctacatcggcacatcgcactatgtacgtacgctcacaatcttattttctgcatagataaattgcagaaagtatggcacatatcatccatgtaacttttgtcccgactgttcgttgtttgctggctcaatattggaaggatatccttcgctttttatcacataggcatctatcctgtttcctcgccgtacccaatctaatgtatttttttggggtttttttttttagctatacgttccggattatcagatcatcagctaaccggccgatctagatacaccgtacagtacaaacatattgacattgtgaaactgccgcagcatgcatggctgcatgcatgtgtatgcatgaggtacgtacgcaacaaataacaggttggtccagctacaaaaatagccgctccctcgcgtgacgttccgttccgtgcagaaccgtgcatgcacgcgtacgacggactccctcccctgacacgcacagcttagccacaggacctcaaattctctgtccggtatctagtctggccgcactgtggcacacatcgtacgcagcaacacgacgaggcgcgaggcaggggagatggatcgcgcattcgatcacgctagaagtggcggatcttagccagccattcagccagaggctgagaggcgtacgtactgcctagccgggtcctacgacgcgcgagcaaacagaagaaggagagaaggagagtctggttgattggggcgcatgcggatgcgacgcgcgcgagtggttgcctggtccctcgcgtagccagcgggcaggtacccagggcacccggcacgggggggtcccgcaccccgatcggctccgccacacatatctggatatatatctcgctcccatcctcgcatgtacgcgcgcatgcacgcgctaccctacacgccccaatcagggcacgcaactcgcgcgccccaccgtgcatgattcacacgaattccagacgctgatcctatcgccaatcgatcaacacccgcggattctgcgtatcaatcgatccaaccgtgcgttgcgtatctcgaattctcgatcatgcacctgaccaggtaagtgcgtgtacggtcgatcggtacgcctcgcctgccacccgcagatcgatcgaccatccatgtgctgctgcttgtataacggtcgcgatactgctcggctattcatacgagcaccgattgttgacaggtagtggccccctggaccgctagctctggactagcgagcgaacgaacgaggtcaatctacaccgtaccgtacgtcctcgcgttgtcataggcgaaccatgattttgtcgtccctaccgaccgggcaggggcaatgccgactatacatgcacatatggcgatagctaagctgcttgcttgtttcgttgcgtacttggctcggtctcagtcctatcagtctcggcctctcctctcatccaagtcatacatacgcatttgcatgaggaaggtcgcggtagttgacttggttttccacggccaagacaagctgctgtccgagtggccgactatatataacaacaaactggttatgtttcaccgctgtcattaaaaccgtttaaagagaccttatccgtcgatatattggaaacctgtatcgaacctatcaggaaaattgacgcgcgtagtttttgaggagtcaagttcaatgccgaccgtacatgcaagagggcgattcgtagtcccggttcacgtaattgactcatagaaagaaatccatgccgacttgtactagtaaaagaactgttccaccaagcgttaaaataggtatagcttgttgtgtttgtgaacataaacgtcagcataatcaaagagggtacgtctagctctcgccaaaatttctagattacttgctccgtctcagaaaccggatgtgatttagtactaaattaacttattctggatggaatctctctttagaaattttgctttgaaaagtgtgcagctctgtttgcacagtcgattttccaatttccattattcctcaatagtgcacgtgtaacttttgccatgagatgagcaaaggatatatgaccaactggctatgtaaagcacgcagcatgggcgaaccaaaacgacgcgtggttccatccatctgtcagttttctgttgcagcgaaaagctctttccatctcatctcatcaccagaggaaacgacgccacgcccacgcacaccaccggctcggtcaaggaccccgcaacggcctatcgtagcattccggtgaggtagtttctctcgtaatctcgttgggtttttccagtttcaaccaatgacgcgcgcgtgcgcttttagtttgctgttgattccctattcccccctccacatcttccgtcgtcgatgaaacgcgagcgcgacggctgactctgacttttccgcgtcgcctctgccgttatccggcgccgcgcgcgcgttccgtggccccacgcgagcacgcgccacttgcgcttgcgcgccagagggcgaccgcggtcgcctcgcgcgccagagggcgaccgcgaccgcacgcgcgcgaggcgagaggcgaaaacccggaacgcgacgggacggcgagaggccgagacagcgacgcgcgcaggcaggattagccgaactcttaaaccgggcaggttcaaggcacgcgcatgacgagagagaatcagagggagctgatgtgattagcgccagaggaaaaccacaaaagctgagacgggaagctgaaacagctctggtattgtgccgcaacttgatagccgtgatgttggttgctgctggggctgttgcacctggtcggccgtcccgataccgttaatcttacacccccgctacatgctaatatgtgtatgcgtgtgccgtgccgtcgctttcgctttccgtccccgcccgggatcctcctccctctccttttcctctgcctttctggtcgccttttcgggccttgctcccctgtcactcgggtggacgcttcgccgtgcactgatcctacagttgtactcctttgtcctaccggttgctctctccacatcgccttcccccaagctaagctaataagctaaaacagctagctaagctacgtgctcatcactgatgctactatgcttccctgcttccttgggtgcttccttacgttgtattttactccataatgatatccaaaaggcgaaaaggagcagcgatcgcagaccgtgctagtagctttgcatcactctctattatttagtggcaatctggctagattgggatacagctgctggtcagtctcaaagcccgatcaaacgcgaacagtagtatacactagggcctttggtgacagatcatcctttgttctgatctttttgccccacgagcactctctgcctggttaagcaatcgagtctttcattattttagcggaggcaaaggtgaggatatatatatgctagctgctacactaagccagttgtcagggtggacttgattgtaaggccggacccatgcattcgccatcaacttttctttcacttgtttttaattcagaaatctcgatgcgtaccatattaaaaattttcccattcagctgtcattgttatcctttttccgatcacaggccaccacagcacagtcctcagatcgcttagtttaagatatgtgcatccatgcaattgctcgagggagatactgtcatgaagcaaagatccaagctaatgtgtcagtcctttttttttaattcgttcacttaaggagtacattgctaaatcgatcgctttggtcgatcgagctgcacttgtgctttcacttaaaaagaaacgcgatttgtagccagaaacaaaatcgcagctggatgcgcgtcgctttagagaggggggggggggggacacaaattaatgacatataaaggcttctcatgatttgagatcagagtcatcacgaactacggcctcaggctccactagcgaccaccggttgatacgtggctcgatctgctttacagcgcatttttgtgtgtccgtctgacagtcgcggattggggatatcaaaacgcaccaaaaagacggctacagatcatcagaaaacggagataaccaggatcttttttttttttggcttcagcttttgccgaggacttacgtgtgcatgcaacctcacaaaatctttacacagatagccatgggagtatttctctgatataaaaatctcgttgccgatgtgttgtgtgggggtggtcactgaatttgattcttgtgagattgtggcttagatccaggaaccgggtacgtatccgtttcaatattttatgcgaaaaaagcagccaacatctctcctttttcccgtatccttttccattcagaatttcagacatcgtgagtcactcaccagaaaaactacgatgatacgatatgctacgtttttttatcacgagagttttcgtcaggattatgggccgaaatcgcaagtttcagaaacctgggctctcctctgcatcagccggccgaacacgtcgggcacaggaattttgtggggaataagtccactttgactcccttaaaagtgaccaaatctaatccatgaccctaaaccgcaaaactggatatctcgaccatgaactattgaaatcggtgcaatttgactctcttggcggttttggaggacggtttcgctgacgtggcgctgacgtggcggtgctaacctaatttgtggggttgacatgacgcttaggtggcatttgaattaaaaaaatatatgtgggacccgtttgtcattcacacccataaaaattgtggggcccactgacatatgggctccacatgccatcctctctctcttcttcctcccctctttctcccttctctctcagtacaggaacgagtagacgaggcaacacagcaccatgggacagcgatgccgatgtacaacgccctggcgagggacgccgcgttgcgccactctgcctcgatcgtgccgaccattcccgccaccatgagcaacccaaacaccacacccctgctcgtgccgtcgaaggagtcggcgacgaaggtgtatattgtcgggatttgcagtgccagcccgagtccgttcaacgccgccgtcaccgccatctgcatcgcaccatgtacgcaaaagcatgtcaaccatggaggagcatggaaaggtgaagggaactttgccatggtcatttggttggcgttcgtcgccgctgggctgctggcctactgttgctgtcactggtggagaaagggttattactcccggttcgtaacccccctatagtaccggttttcgaaccggaagtacgaatccgggactaaagatcgctatctttagtcccgggtgaaaaaaccgggggtaaaaacccatctttagactaaagatgctaatccggttgctctttccggttcctttttattattttcttttcttcattatttttaaatatattgatttcactctatcccgtccccaaaatctcaaatcaatcattctcaaattgcctccaaatccacaaatcgatcatctcaaatactcaaatacatcacaaaatcttaaaaaaaaattacatcacaacttctacaaaattcatcacatattcacatcacacacaa

SEQ ID NO: 69554 - DNA, 16070 bp, Oryza sativa
ttgaggagaggagttaaaggagaggaggaggtaccggcctcgatccgatcgcacacacctctccgatctccgcgtcgatctttactcccggttggttttaccaccaggactataaatatatctttagtcccggttggtaacagcaactgagagtaaagcgtatggcgatcttttttcctggttggtgttattaaccgggactacaaatagatctttagtcccggttggtaacaccaaccggtactaaagattgaaaaagtactctgtagcttttaaaccgggactaaagatatttttagtcccggtttttaatacaatcgggactattgtaaaatctggtcgaccgaccaaagatggtttctccaccagtgtgttcatgctcatgaccggcatgcttgactccgccatcccaacgatgagcagcggaaagaagtggacggaggtgatcaaccagttcctcaacgcgctcttcaccatcatgtgcctgtactagcagtccagcacgccaagatcttccaccacctcgtgctgctcctccggtggcgccccggcaccagcgacgaccgcgaggagatccacaaggtgtactgcaaagactgcgcgccgcggccgcacgaccgcgcgcacatgctcgtcgtggcagtgctgcttcacgtcacctgctcggcgcagtacttctgctgcgctctcttctggagctacgcgtgcaaggaccggctaggctgggctccatgatgccggcgtggggagagaaggagagagaagggagagagggaggaaaaaagagggaaggggagagaggatgacacgtgggccccacatgtaaagggtcccacaatttttttttaatgtgaatgacaattgggtcccacaattttttacaaattatagtgccacatcagcgccacatggaagtaaaaccaggtcaatactgccatgtatgcgccacgtcagcgaaaccgccctccaaaaccgctgagggagtcaaattgaaccggttttaacagtttagggagtcaagatatctggttttgtggttcagggtcagggtcacggattagattcgtgtcacttttaagggagtcaaattgaacttattccattttgtggtccatgaagaggccagagcaccagcctatcgaagttaagagatgggtcctgagcgtatctggagggaggaaggaaaatgtttaattgagtccctcaaagatagtcaagacttattcctacccctcaaccgcaaactaggtatagtgatttcttcaactatttaaaccatgcaaaatgactcccttaacaatatagttggtggtttcactgacgtggcatccatgtggcagcctagtcatcacgtaattttttttttaaaaaaaatacaatggggctcacatgtcatcccctctatctccttactttcctatctatgtttatccccttctcggcagtggtacgacgacttcttccataggacggcggtgggactgtagcaaaacacgatatgctctgggtactccatgcctccatggtggtgccaccgccttcgttcgccttatccaagaactcatgcaggcattcgttgtcgaccttgctttacattatatatggttttgtggttgaaggatatgaatttatcatatccgacctatatcgaaggagtcagattgaactttttccaacgaggaatgggtccgatctgagattgcacccactttattaaggactcgattgaatgagtcggtattgaggcccattcaactgtattggccaaacattttagtataatgtcccgcttatgcattaggatggcgaaaacgctaattggcggctagttgcgcgcgcccttctttttttccgtttctctttctgtttggttttctccggttttttttggtttctctttctgtttggttttttccggttttttgtttctctgtctattttggtttttccgttattttggggttctctttctgttttggttttttttgtttccccccccctttttttttccttttttctcttttcggttttttttaacatatacgtatacaaactttttgtattcatgtatacaaactagtttatatacgtacgtatataaagtttatatacgcacgtatacaaagtttgtatacgttatgtttttttgtttttttttattttttaatacgtacgtatacaaagtttgtacatattgtatacaaagtttgtatatgtgtatattttttatacatcaacaatatatacatataaaaatatattttttatagaaataatactagtactaatagtagtagtgtaatagtaatagtaatactagtaactactagttgtatagtatagatactaagaggagtggggggtggtcgcgcgcgatggggcaggcgcgaccagtcgccaggtagccacccccttaggatggggccaggatttatgcacatccaggttttgagctaacgtgcaaggttcaggttcttgtacgctttgaaataaaattcactttaggtccctcaactataggtcgagttttattcacaccactcaaccataaaaccggagtgtccctcaacttttaaaacgggtacaaattaaattcctcgacaatattgaaagcgatttctagttaatgtgacgcctacgtggcacgatgattgcttgacttattaggcccatcccgtgtcggcatgacccaacctttgcgccatgcctgggcctctgtctcgacacgatgggccgatacggcattggcccagtccaacgatcagggagttaaatagatgagagagacaaaatagatttattcagccatacaagaaatgacccaaacagatgagggatgaaaaatagatttattccaaccatataagagacggcccaaagatatgagggaagcaaaatagtcttttatccaaggaagagtgcaatggactttcgtggctttgggctagctcgacaccatccaagtcttattgggtcgtgcataggcagatggtgcagcaagtggatagacccggggcagcccgatgtgtaggtcgagtctgccggctcgactaatctcggcccgggcccggttgtgcctaggccagacggcccatttggtcattgatctatacgttggagtaagggcgtgagacatagtggagagtggggagggggaagaagtcacatgtgaagctactagtttatttttatgctgacatcgacaccacatgctgttcacgtaaacgccgcatagaaaaaaccagtctagtttgtatgaggggtgtaaattaaacagttttatgagttcgggaaggaattatgtcggttttagagtaaaatggattcttttagataaatgtggtagttgagggggatgatatgaacttatcccagctcataatgatattaatcaatatcaacataactgaatgtatctctctgtgaaaccagtcaacagttggtgcggtaagagcaagtttaatactactaactccaaatcatttatagttaatttaatagctaataaatatactacctcccccctatcatacacataaatctgtagcccgctgcttttctctctcttcttttatcttcttgatatgtgtttataactggcttatagtatgctattgtacatgctataatagagctaccgaatagtatacattttccacgaatttttgtgtgcaagaaaacaaagaacacacgaccagatgcaagcccgtatgaatgacagcacatgcagaatcctattgccttgtttcttccaccttcggcacaccaggccaacatgtttgctgttgccaacctgaaagaaaacatcgaacttgcccgcaacggcttaaaaatccccttcaccgttgcataccctttttagctttatgacctgataaagtgtactgtgtacggatagttctaatatgacgtttgcatttttctgcgttgcattgctctcccaatagtccgtattgttggaccagcggcgcgtatcattataactctgcaatttccatgatacttctagttcaaaaactggagattgccctatgaaaagatagaaacataggataatgcgactgcttatgagccaacgtgcttgtcattctcattgcaacaatgcgactgataaactcgggggccatcacatattatccccgtgtcatttttgtcttctcaccagaagaagaagaaaaaaaaaaggaatttacagtctacagagccaaaaagaattgttcatatgcattcccatcatgctgtctgttagactgttacagactagataatgtatagaggacagagccagcctttgccagcacaagtgaacatgctaaaacatgaggacctaatcaagaaacacatgctaggtatatataaatattactacagtaatacatctcctgttatctaaaaaacaaatatataaatacaataaaaccatcacgaaaatctggcataggcgagctaaaaaaaaatagaatcctgctatacatacgactaaatcgtacgactcacattcgactctgccacatccaccaatcaccatgttcgaactcggctatgtcttaagatgctgtaattaattcatgtacaacctttactttctttgcgtggatctgtttgatctggtttcatttacattttgcacggtcttggacctcttggtcagtaattttgtcagtaatgctatgtactacctttgtccagctaaaatatcttctaacccaccggtatacccgcccccacccatcaccagccgttggcctttgccagcaagcggagattgcccccacgccgcttggcctttgcgggacgaacagcgcggagcaccgtccacccgcctctcctccggttggcccgtcccgccccgcgtgttccgccccggccaggccggcgggtcactgcttcgatcgcccgctcgcctgctcggcgtccgtggccgccgcgtcgagacggattgtcgttgtggcggatgctgccgaggtggcgcatgaggatgatttggtggtggaggtgaggccgaggatgaggagcgccgtgacgacgaccagcgcggcggccccgccgaacacgccgttcctggcgacgtagcagtcgccgtccatccagccccggccgtaccgctgcccgtggttcatgctcgccgcggtcgccagcaggacgacggccagcgcgaagctcaccctgcgtacatccggcgcgcgcgccgcgggcggcgattcagcgatccacgctcgcagaaatcacgcattaattctttgtttggcagccatggccgtactatagggcgtaccatgagaggacgaggatggcgacggacgccgcgcggcgcctggtggtggacgacttgctgcgcttggacgcggcgcacatggtggtcgccgccgccgtggtgcccaccagctgcgccacggagaggaacgcgatggccgcgacgcccaattcgaaggcggagctcttgggcagggagcagaggctaccgtccagcttcatgtccttctcctgcgcacacacacagacatgatccagatccaagggcgtgagtgagaccgacccgcccgccaccattgccggcgtcggagagcgcaagagcaagcgagcctgaccttgactttgcggaattcggcggcgagggagcaggagaacgcggtggcgcagagcaggacgacgatgccgcagatggcggcccggcaggagagccccctgctccacttctccatcgaacccaacccaacccaacccaccccgagccgaagcaaccctgtaaacgcctcgcccacggctaagtacgtaaaattcgaccaaatccctcttcctacctcgctttgcttctccagagcatgtctaactactgcatataaatgagaggaaattctccgaacacgtcaagacgccaagactaattggctgctctgaataatcgaggagggttggtggcctctggatgatgatgatgatggaaacagaggaggagagagacgggatgctaaacaaaaccaaaccacatggccccgtcgactcattggtcaatacaatagtggtaattgtttagcagttttatgcacggatactagaagaagaagaagaacgaggaagaggaaaggagaacagaagaaagatggaattggcaaagatgagaggccctcctgatcgatctgatccctgtgtcgatgacttgacgggttggtaggctggtttggtcaaccggatagcgcctgtactggtttgggagaaggtggctgattggctaggaaaggaagcctgcaaggaaagaatcacgctacatcatggctaatcgcgttcgcccctgcaccagacactacctaatggtgcggccattgtttaagcccaagtcgtgtcacccatcgtcagatcagggcatcaggccacccaaacgaacaggaaacacgcatcgaccaataataaccggtgtttgtgactgcgtatgctgctgctgcactgctgcttgtgcgggcaaaaaggagaactacgaatgagaaagaccgggaggggagtgaggattgcgacgaatcgctttctttctttcgcagagttcccccccccccccccccccccttttccttgacgttttcgtctttgcgttcgctgggtggcagcggcagacggcgaggcgacggcgatgttgtggcgggggccgtgaggaatggatctcttcccggatgtttgggccgccctctggtcggtcaccttctgttgtcgcgtgcgatgcgtggactcggcttgggtggtggcctggtgggcgcgcgcgtgtggcccagcgttggggcgtggtggaagcggcattctcctcgtcggggcagacggatccatccgaatctggccgtttcgttcggtctccggtctccgccgcccatccaccaccaactggatgcgcgcatccatcatctcgctttcttctctttggttcgttgatctaggttgccttcccaatcgccagttgatccacttgagtcgtggggacgatcgtttgcgcgctgcgcaaacgatttcgcatgggtcaccggcttacgaacaggcagaaaagctaaacaaatcgtcacgcgtcgcatgtgtcaaatggacggacaatgacattggagaaacaaggcggcgttttttttttttcctaaactactcttcgagttcgagccttcgatggaggaagaatggaaaatgttcctctcgagttctagcctgcaatcgttgactgcataacgatgcagccgtcacccgtcagccttgcaagcagaagaggcagcccgacgtggactgctcgcgccaacaagcaacggtatcacatcagcaaaaccgtggtccgccgcctcgtattttaggttcggggttgaacggagaaacggttgagagccttactaacaatggggatattggattacgctatcaaaaaaacaatattaacccggggatttcagtgtgtctgctgctgtttggggttagttgaaagaggatcgccaattgtgattggtttggtcgtagtggtaatctaatcgtggtattaagacgatgggattagaccgtgacacatcgaacgtctcggttgatcccgaataaaattgacaacttttgaaaacgaaatcatcaatgatcaccccatctttgacacacgactctgctgatcccaaaggttgacatacaggtaccatataaagtactctatccgatattctttagacgacggcaatggatcattggatcacattgttttatttggttgttgaaaaatttatatccatattaattgggtgctcagagaaaaaaaaaacacccacaactatacctatagatattcccgaggaaactcctatgttaactgaaaattttagtcgttgtatctggaatcatgattgtatatcgtatttagagttttttaaacaatacatgcaattaaaaaaatcatctcttttcaacttctaccaaacatgttcaaataaaataagagtatgtaccaattacaaacttggaaacactaaaccaaaaataaaaattaatatatctccaaaagtctaaactgagtacaactcgatatttacaaattttaaatttcagaattattaatttatgaaatatagtacattgaatctccaacacaaatacaaataaatactccctccgtactcgtaaagtaagtcgtttaggacaatgtttaagtaaacattaggaatataaatcatgagtaattctcaagttgttgagtttgaaaatataaaaattatatgaataaatttgtcttgaaaaatactttcataaaagtatacatatatcacttttcaataaatatttttatagaaataagaagtcaaaattgtgttttggtgatcgtgtcactgtcctaaacgactttcttagggagtacttattaattaaaattttaaaaatattaaataaaacatacaaacaacagaaaacatatagaataaattttgatttagtgttgtatttaattctaaaaatcgaaattaataattaatgaatagtaattgacatggattattattttaacatgatctattttaatttgaaagttaacaaacatatttgacatataattaaaatttcaatatccatgttatttaacaaaaaaaaacccttgcaattattaaaattacagtgaacgggtcggcaagtagtcatcatttgttaatttgtttctctaccgcacaaaaatccaaagagaaaagtccagtttactcacccaaacaatttcattgtattacttaaactccaaaactattttgaactcattttaccctataagctactccctccataccaaattattgggcacccttatttctaaaaaaaattaaacttggtaatttttgactaataatcatgctaactatatcgataccaagtattatgcatgttatattattatattttcacgtgatgctaattttatattcattgggaacatgacatgaaataaattaatggccaaagtatatcattggagatcatgtaaaaaaataggccttataatttggaatggagagagtattaaaaatggttctttcatttctcttatttgtttctctttatacgagtcatattttaagcttatattttgcagagccacaaatgacaccattatcagagttctaaaatagtttcattttttttcaaaactatttgcttgaaatttaaattagtatgagtgtttccaacctctacaacaattaaaaaaaatcaaaaaatgttgagatataaattataatgcgtatatcaatgtcatcaaatttaattgcaaaatatgacatacatatagagaaaagaagaagacaaatatcattagggagtaaggtgagccattttcaatagttcgtggtgcaaaatgagcgaataaatagtatagaaggttaagtgctccggcgaaaggggggaaatatggactcttttttttttcaaatccaaatagccgtctgtggcatgtactgaactttctttcagtccatccatagaccgagggcctaggcccaagcgaggtactccagacgcggaataagttcacatgaggtccctcaacttaacagcgagaatttttttaggtccctcaaccacaaaaccagaaatgttcgcacctaaactcattcaaaccgttcacaggaggtcccttcgcagtataggtgggtggtttcgcttacgtggcatcctagtcagcaaaaaaaatattaaaattatgaggcccacatgtcagctgcagtttatttttcttctcttttctctcctcttctctttcctctcctctctctttgccggcggcgagcggcgatgggcgagcgcgcggctggagtaggtggaggggcggcgtcagcacgctagagcaggcggagcggcagtgtctgggcgagcgcggctgcggcggcgacaagcagcggccaagcgcgacggcgggcaagcggcggctccgagcgtgggcggtgcatggccggagcaggcggagcagcggcgtctccgggcgcgggcggagcagaggggggggggacgcggggggcgcggcgggtgagcggcggcgaggcgtcgcctctttcccccctcccgccggcctcatctccccccgctccgtccgttcccgccgctgcggcacgccaccacgctgggctcctccaaggagtgcgacggcggcgacgggaaccagcggcaagaacgacgtgctcgttcgctctgtccactttgtgtgccgctctcgccgccaacgacgacgcgaccggcggagtaggccgccacgctcctccttcggccacctccgccgttgcggccccctcctccgcctgccatgctcgtccgctcgcttgccgtccgctctgcccacagcccgtcgcgcttgccttccgctcgcccgccgccgtccaacgccgcttcgcgtgccgccgcgccgcccgtctccgttctgcccatagcccggcgacctgccgttcttcgacctcatgagcatccccggcaagctcatgcccgaccttgggcgctcggcattcgaccgccacccccttttgattcctccgccaccggcggcgacatatccgtcaccgcgggaatcccctcccggagcaggagcccgtcctggatcccgcccccacctcccgccgcggtcgcccgcagtcgctcttgccagcttcgcctgccgcggccacactcgccctccgccgccgccgccgctctcgccggccgttgccccacccgtctcggtcgtcgaagaagacgatagaagagaagaaaggggaaaatagaagggatgtggggcccgcaccgttttctctcacttacatgtgggccccacgtactttatttatttatttttctgactagggtgccacgtacgcgaaaccacctatactgccaagggagctcctgtgaatgagtttagggcgaggttaagggacctcgagggacctccggtgaacttattcccgagagatatcatgatgggcccaactgcttacatacagtcgattaggccggcctaaaacttttccgtgtgttccaccggctgttgatggaataagtccattgtgcgtccctcatctcttgtgcttgtgtaaataacatcccccaaccggaaaaccgggtataacgtctccttcatctctcaaaccagagcaaatcacctccctcagtggttttgctggcggtttcgtccgacgtggcgttgttgacccggttgacaagctgactcagcgtagtgggacccacatgtcattctcacacagaaaataataaaaaaatggtgggacccacgttttcccttcttctcgttttcttctcctctcgattcttctctctgctcttcctgtcgatgctgagacagagccggcgctgggcggcgatgggcgtggcgacggcggcagtcggcgcggcgacggcgatggcggccggcgcggcgaccgagaagggcggcaaggcagaggcggtttcggcggaggcggaggcggcgcccgtgcgggccgactggccgcgcgcggggtggcgctcgggccgatggtggggactggggaggcgatggtggcggcgaggcagaggcggttggcgcccgaaggcggccacgacgcgataacgacggcctgatgaagacggctagtcaaaggagcgcgcgaggaggcggcgccccggaggaagaagaaaccggcggcgacggcggtttcggcggaggcggaggcagcgcctgtgcgggcctaatagccgcgcgcggggcggcgctcgggccgatggtggggactgggaggcgatggtggcggcggtgaatggtaagtgaaatggggaggatgatgtgtttggggattttttgtgggggattttattgcagtggcttcgaagagaaggaaggatgggtgcacagtggtgatggcagaggcgacgcagcggcatgggcgtggctcacgagggcacgaggtggtgcaccgggtgtagtggcgttggcaaggtggacagctgcggtggcgtcgtggagtccagatccagttggcaaagagaggaggaggaggaggaggagatggtggggcagctgcttgctgcggggagtcgtcgatcagcgtcgaggttgcctcctccgtcgccgctccgaccacggcgatggcggcctccccgaacggagcctcggtagcggcgggcacggccgcagccgcgaaggggtcgagcacgtgcagcgaccgcggccgccgcagccaggtccacctcccgcgccgattcctcttccgcccacaaccgccggagccgtgcctccgccgctgcccttgtcctctcgtcgctggcgtccgtagttgcccatctccaccatccgagccagccaccgagttccccgtccctcactcgttcttcatccgtttcccgctactcctacctcgccgccgttcgtcggctcgccgtcgtgcgtcgccggccgtcgatctccccggtggtcaactgctgtcggtccaagatgacatcgctgcacactgacatgtgagtcccaccacgctgagtcagcttgtcaaccgggtcaacaacgtcacgtcggacgaaaccgccagcaaaaccaccgagagaggtgatttgctctggttttcatagatgaaggaggcattatacccggttttccggttggggatgttatttacacaagcgcaagagatgagggaggcaaaatggacttattccgcagttgatggcttcatgccaagcaccacgcccaaactgcgaccgcggatcgagcccgcgggcggacactgttccgttcgtggctgtgcggccatctccacgactccaccacctccacctgtagcatcgctttgatccatggaacaataaagaactcttgcctgcaactgtgcgtggccggtggcgatggcgactctaccctagtgtattctccgctctgccgcctccaccaggaccaccaccaccttcgctacccggcgccgtaccctgcgcagccgcggggcacctcggcggcgtaacgaggcgagggggatcggacgcgcgcgcgcgcgcgaggagaaaggccgggggggatcagcgatgagcttcgcggatctggaggccggcgcggtgcgggcgcccaggagggcgcggggccccgacgccacgcgcgcgctcgtcttccagatcaccaccgccgtggcctcctaccgccgcctcctcaactcgctcgggacgcccaaggacacccccgcccttcgtgaccagctgtctctcctcgctcccccccactcctcactcctttaattgttgtttgcctctacacgtttcatgtcctagaatgctagatgctcgcgattattattatttttttggctcagctcaagttaattgatcgaaattgtgatggttggtagctcatgccctcgaggcatgtcgtttaccatcactctggtgttctgattggttgatttctccacaggcagaagactagtcataacattcttcaattggcaaaggatgcgaaggagaagctcaggagagctgctgaggcagacaagaacgccgatactagtgttagtagtaatttactgtttatttataccctttgttttagcccagtgaatttgtcttggacaagactgtttccaactatatgtgtgatcatgtatgcatctttctgctcttagtttacttagctaccatagtgattaggaatctgggtatcatgtgcaggcagacaagagggttgctgacatgaagcttgccaaggattttgccacgacgatggaggagtatggaaaacttcaaaatcttgcgattcaaagggagatggcatataagccagttgttccccagacatctcagccaaagtaatgcttgtacacttttcattcgattcatctcaaacttttctctgtattgtttgattgtttcattttcctgccatgatatgccattggtttttaatagtataccgacgaatggccatgtgtagaagttaatttacatgcacatgttacttatcagtggcttccacatggattctaacaaatctatctatttatctatctataaaaaggaatataaaaaggagcctccacgttcgctctcacggcctagaaattctcatattaatcggagaaaaagaaaaacagagtccatatggaaatacaatttagaaatacttgaaattcggaattaaaaaataaggaatattggaagaggagactagagtccatatagaaatacaatttagaaataactgaaattcggaataaaaaaaaaagaattttagaagaagagtatagagtccatatagaaatacaattaagaaataatagaaattcggaattaaaaaaaataaggaatattgaaagatgagtttagagtccatataggaatttaaaactaactaaaattcggaataaacataataaaactaaaagtagagtttagaatccgtataaaaatacaatttagaagtaactgaaattcgaaataaaaaattaaagaatattgaaagatgagtttagagaccacatagaaatacaattagaaacaaaaaaaaaatcagaattaaaaataaataatattggaagaagagcgtagagtctatatagaaatacaatttacagataacgaaaatttggaattaaaaataagaaatattgaaagacgagtctagagtccatataggaatataatttagaaataactaaaatttgatattaaaaataattaataactaacacgtatataaaatacaatatgaatattacacattagtagtttcgtaaagttagtacaaaatttaaaattatgttgtcattttaatatattttaataataaattgagaaaacatatatgctattatatgagataaaatatagatgctagccgcaatctgcacgggccaccatgctagttactagtatagtaataaccaattcctttgccctcattgcttgataaaagagtttggttgaataatctgattgtcggcagaggctggagatgtaaaccatttctattatcttaaaaaaagttgaataatctgatactgttgtgtatgggccattttggtttggtgccaatttttgccctaccaattctttggtagttttgaatagtgcatgttagcattttggattggagccaatttttgccaaatcaatagagtggagccaaatctatgctatcaaaaatttggtagtgccaaaatttacccaaggtttggtaccagtattttgatagggtttcaaaccaaactagccctatgtgaaccattggccaagtaatacttctcacaactttttggcatagtttgttactgtgttcatcatgatccatttcatttgcttatgctgcaaccttctaggattctgcctagcttatattggcatttttttctttgaataggtcatataactttgcctatgttattgctccattagcttctcttcctttgaagtatggagatgggtcttattattttgcattgtaaaaacatacaatttaactaatttaaagacacattgccttctctttgtcagtgtcatgaccatccgttttacttgcagtttacctgatgacctcatttagtgacatggtttatcttaaaactaaaggtattcatgtgcagagttgactgggttatcttctaatatctttgagaattttggtcactatgatgtagctatactacaggtggtatagaagccagggattctggtaaaattcctgaacagcatgcgctactcgcagaatcaaagaggtcagtgttctcatagctcttctttttctgcttattttttcaactagtgatttagtacttactggtggaaggtcagctttaatcgtatagcgcatgttttttcattctatcccatcagaaaatattcaattttagtgacttcctgtggctgagttttcatctgtggtgcatggaacttacataagtcgcgtggcacgtcatttatctcatgggcagtatatcacctcatgaattatatacctggcacactttctatgtctttttgggagagtacatgcacctaaaatctgttagatcaaatgcttctgctggaatacataggccaagtggccatgcattattttgaccgagcctagattgtgtggcagttacagtaaattgcagtgttggtactttacacag

SEQ ID NO: 69555 - DNA, 963 bp, Oryza sativa
tgataatgacgatagtagtaaatctggcaaagggaaaaaggacaagtttgtcacagcgagggagtactattgcttcaggctgcaggttagaaggggacttctaaacatcatttgttcggaggatgacttttccaacaatgagccgttgacatgtacatcaaaatcgagtatatgagactcgattggtactcaaaacctgagaaccaaaaaaagattcgggctgagctataccaggtaaatggtataacatatttctacaactattgatattgtctcccatctgtgattcaacataccagttatttgatcatggtgttatttaataattgcagggcgtggttgacgtgctttcttctggagagacaagcggttcggcagttggtaagaggattgtgctacctcgatcttttccgggaggtgatcgcgacatgcaacgaaggtttctcaatgcgatggctcttgtccaatgttttgggaggccagattacttcatcacaatgacgtgcaacccatactgggatgagataacagaacatcttgaacccggccagcaacctcaagatcgaccagaccttgtcgcaagagttttcagggctaagctgcgagatgtgttggatcttattgtgaagaaaaaatattttggggaggttcaggcttacgcgcacgtcactgagtttcagaaaaggggactaccacatgaacacatcctgttgatcatgaagtcaagcagtaaattgacaaccccagatgagtacgataaagtgatttgcacggagataccagacaaggccaaataccctgagctacatcgtcttgtcatcaagcatatgctgcatggaccatgtggcacactgaataggaattgtgcttgtatggtggatggagagtatcgcttcaactttcctcgatagttcaatcaagcaacacaacaagggaaggactcgtaccctttgtacaggagaa
